United States Patent 9,487,797 (GENOMIC PLANT SEQUENCES AND USES THEREOF) - sequence listing, part 26

SEQ ID NO: 58425 - DNA, 55074 bp, Oryza sativa
attcttcttaatacgtgccatatttgatacttctccagttgtagcctcgacttgtgcttgagaagtctccccttgatctgaaacaaggtcagcttcatcgaatctaacatcaccctgaccccaaaggcttgcctgcaacctggcctccctttctttgttatatatggactgcagctttgacttgaaatatggcaaaacaacctacaaacatattaagaacaccataaaaaaaatattccaaacctgagaaatttcatcataacataaataaaatgtgacacccattttttatgagcattttgatagtgatatccatatgtttgtcgttttacttgagtcactgaggtagcacatgaaattgtatcataaatgccaaaaataacaacttcatcaagagcatcgctaatacatttaacaactacactaagttttggtgctgaatacgcattaaaggataatagaccaaagcaagattgaagactcgaaacttttttttctaatctgcaccaactttcaataagaaaataactgaacacagagatccagtaagagcatcgtagcttgtaactaaagcaaaaggacattctgtattcatactggagtagtacatagtaaaaatagactaggcattggtgtcagttgtaaaacgttgataaacaaggccagctttaataaaagagcagctcagggcacataatagaaccatgcaaaatcacacaaggttaacatatgggttagatttgtttctaggtgttcaactcttgaagtcatgataaaccaatttaatcaaattggtagagagaggtactgttttcgtagattttgatagtagctgcatatgcagagtagcaagacagaacagctcaaaagtatttaccacgaaaacaacaaagccaataccaaaaaaaaaaagcagtaatatttgacactaaagctgcttgctgctaaacgacatcataccaaaaaaacaacagaaaggactttctggcgcttccttagaacagaatcataggctttatcattggattctgcaccagaactacttctctttactgaaaccttaacaggtctccgcctgagaccatacaatgactccgaaaaagaaccatctgaaaaaaaaaacctggacagttataatcacagaggcgttgagatgtctcaaagaaaagttagtacaaaggtcatgaacacagcaaatcctttacagcaaaagaaccttatgtttctgtgatgacaaacctgtcgttcgcaaactatgggactcaaggacagccattaacaaggcaaagaattcatcctcgtaatctaaaactttatgtaacaacggccgtcttagtgcaaaaacctgtgagtaatagtatgagttagttagaactctatttaagaggcatgatgtactaaaattaaacacacacacaaagtgatatgttcaagaatttagagaaagcatcagctgaaaaaatgactcctctagtcacaagtttttccccttattaaaaatggtgcatatactacattaaactctgctttatcgctctccattgttgagacacttttttcaaacaggtagtagtaaaagcgcaattacatacttaactgcctgtgcaagaatcacaaagcgcaattacatacttaactgcatgtgcaagaatctttgtgaaccagatagagcagaatttgtatcatgcttttgacagtatgttgtgctaggtaaaggtccaaccttgtgtagggcaatccaaaaacttccattccgcatgtaatcctcttggctatttcgtgcccagtgcacactgttttttagtactttttaacagtattattggagtttcttcgtaatatacttctacatacgttccacagatgctctacaaaacacttcaccttcagtttgttgggatgctattctaattgcatcatttggtcacattcaatttgttcttaaacatgtgatatacaacaaccaatttaatattatttgtatagaaaaatgaacagcatcatgtgagctcaatgtcctttaaaagaagtttgctcaaaactacatatagcaatgatcccaatgaatcaacccaattcagtgcagctagccaaacaacctaaagagctgtaatatccatcagcagaagaaccaacttctgtgactgcgaattgcatatacaaaactagcactgatcaactatactccgagcttgcaccagtaaccaacagaatctggcacagaaacaaataaaacaacaacccagagcccgcaccattcaatcatctccaactcctcaagctagaccactacaatgcgcaggaagccagcatcgtcgagtgacactataattttctatcaccccctagaaaccccagacatctaaacaaattacagccacgaagtcaaaacacccttatcccgagcgatttggatcgaatttggaggagatgaggagaggggcgggggcgaggcgagttcatccactttaccccgagcgagtaggagagcgcggcgcggaggctggccggcagctgctgcgcggccgacatctcgaagaaggtgggccgcgccccctgccctcccacctggaacagcatcctgcctcctcctcctcccccgggctaggctcggccggctagggttcccgctgcctcttccccggcagcgcgactcggcctagctgcgggtggatccgccggagttgccgccgcagccgccggttagtgtagtcctcggcgtccacggcggtgtgtgtgcgtgtgggagagaaaggagaggcgaggcgcaaaagagaagccttgagggagacgggacgggggtggtgacgtcacgaggcgacgatgggccgggcttagagaggatgatgggctcttctgtcgatgggccttctcaggaaaacgatgggctcttcagcaacatccagttcatgcaaatacaaaggggctcattaattatttgagggcaactacaaaacgggatcccgttgcaacgggacaggcatattaactattctcttgcacgagtatcacaggtatcaggttttaggtatcacaggtaccgggtaacaggtatcaggtaccatgcagctagtaccacaacagatatcaggtatccgatactgtcttatagaaggtatcgcgttccaacgggataccattgtcttggttttctgtaattatttcgcttatatttatacttataaagctaagattaaaaaaacttaattttaaatttgatttttattagttcattattgtttattttacagcatttgtttttaattcactaagaatatatacataaaaattttacttacaaataactttttattcactaataagcatttcggataaacatattaataagcgaaacaatggagaatatggtgcttgaaagctgcagctaaagatttttttaaaaaagtaaaaatctccattagttttgtgaccagctagataagtactcagacattgcactgtctaatccatggcaatagcgacctgtatatatatgaacaatagtacaatgtgtacaaaatcacaaatgtgctagcagaacttgtattggacttggatccccctgactctagcaatggcaagaggcagaagaagtttctctagctaactataagatataggagccagagaagcgaggccgtcatcgaagttgcgggagtagctctccaggctgtacccgaacctcgccgcgccgccggctttcttccccggctgcgtcgacgccgagctcctccactttgacctcagcttccggtacagttgcctcaccggccgcgccatcgccaccgctgccaaccgccgcctctccacgccacccgtcgacgacgcggccgtcctcctccggctgccacagccgccgtaaagccccaacagaaacaccatctcttatatctagctccacagtatacagactacagtgcgggatcttttttttttaaaccccacggggtatatttgtattaaagaaggggaaacactgtacaatagccaaaaaggctaggagattacaagaaaaaagaaagtgagaaaaacgagggtgggtggggtgtagctactagaagagacgtatgattttgattagtcgattacgtggcgtcgtctgcacttccatggttgctcggtagtaggcattggaggctttttgccctgcctgcgtgccaaagccagatctcgttagtcgctcggtcaatgattccctgcagcggagtctctatgcttctgaataccctactatttctttctttccaaatttcccaggatagtagggtaaggattgatttgacgcccttccttttctcctttgtcattgcgcgaacggtctgagtccaccagtcctcaagggatgtcgtcttggtccaatttactggccgtagttgggggacaaccagccttgtcgctatagcatctcatattgctcttgtgatcgggcattcatagaagaggtggtgtgccgtctctaggttcctaaagcatagttggcagaagtagttgtttggccactccctctgctgcagcctatcagccgtccatattctattttgaaggagcagccaggcaaaaaaattgcatttggacggtgcccaacacttccaaactgcagttgccgataatgataggatgctgcccaggaactgcatttgataggttgacttttgctgtataggatccggttggtgtccatttccattgtatgctgtcttggacaccttgggatagggtagtgtttgattcccaaagtatctcgaaaaccttgaagaactccgtgacgagcattgatgtcaagttgtgtctgatgtcattgatccacttattgtcctgtagggcatttgcaacagtccttttcttccttctagcatgacggtagaggtttggtgccattgtctttagtggggagctggatacccaaggggattcccagaagagcgccttcctgctgtccccgatggtcaccgttgtggatgctgcaaagagctcggcgtcctgttcgtcacatggggttggcataccaatccacggtttgtctgggaaggtccattcgtaccacagccatcgtaaatggagggcccgtcccatcttggtgaggttcgagacccccaggccaccatacttgatcggtctgcaaactcgctgccaattcaccttgcacttgccaccgtggaactcatcgccaccgtcccaaagaaattttcttcttgctttatcaatttcttggattatttgctttggaatcttgagcgctgtcatgacgtagattggcatggagcttagtactgagagtactagctctcttctgcccccggctgagaggagtttctttttccaactggcaagtcgtgccttgattcggtcaattaagtattgtaggtggaccttgcgcagtctgcttacagtgaggggcattcctaggtactgcattggaaagactccacgtgggcggtgaaattgtgtagaacctcgtcgaggtcaaccgcgtcgcagcttattggaagcactgagcttttttgtaggttgacttggaggctggttgctcccccgaaaccgtttaggatcaagattaggctatccacatcttggcgagatggcttgatgaagattgccgcgtcatcagcatctagggagcacctgaagcgcgcgctgcgatccgctagctcgcttaggtggccttcgtcagttgctatcttgaggagtctgtgcagagggtccattgcaaggatgaacaggtacggagatagggggtccccctgtcttaacccccttcgatggtcgatcctttccccctcaataccatttagagagactctggaggaggaggctgagaggatcaacgccacccagtcgcgccatttggcgctgaagcccattctctctaggagtattagcaggtattcctatgagaccgagtcgaaggccttggcaatgtccaacttgaaaaagagggtgggtttcttggatctgtgcattttccttgccaaattggagacgtaaaggaagttgttttggatgcaacgcgttttgataaaacgcactctgggcttacgagattagaccgttgatctgtctggacagacggattgccaggatctttcccaacaactttgccagggatcttaattaatttcttcctcacggctcactcagaacagaggtatttcctccgtttcaaaatgtaagacattttagcattttccacattcatattgatgttaatgaatctagatagatatatatgtctagattcattaacatcaatataaatatgagaaatactagaatgacttacattgtgaaacggagggagtagctaactgcaagtctgcaactcgatggcctcgtttcttcgcctccttccacctgcggcttatataaagctcgcacttggctacgacgacgacgatgaccggattgttcggagaatgtcaccggccgccggcctggcccgccgtggtcggccactgatgacaataatggcacgggcaagagtggatttctgcaggtagcttcttctttctccctgggggccagatgctgaatgtgttgcgacgtactgttaacgcgcgtgaaacacgtgatggtacggagatgtataccgtgtgcgtagtacatgtgttagcgtcgaagagacgaagactgtactagcagctacagatcaggtgtgaaatgtgacatgatcatcaacatgcgtatgcatgatccaatagctagctacgaggtgtggagctgccacatgaaaaatgagcttcatgagtatactcattttccgagttccgaccagctaatcgatcagatagatctcacagattaatgaacgacgatggctgacagctcggggattatggcgaccagcttcttcgcgcatcatctaccatgcatgatgacaacacaagacacatgcatgtatatatattcttaaagttcatcagcgcaaaagctcgcaagaaacaaaaaaaaaaaagcttcacatgatctctctctctctgttcagatttcatatctcccatgcaggaatcaactaataacattgctagtcaactgggcctttaattaatcgatctaccaatgtgttcatatggatcatgcaggattattatacaacctatgttctgaacaagcagttaaagggaaactatttttatccctcgaggagacatcccctcattatttgcatgtcattcaaatggttataaaaaaatgtaaaaaaatttgaaaagatgtattatcatgtgatatatcactccacaaacatgcaagttcaaattcaacttccatatctcacaacaaaaaaaacaaatttgactgtgaatatacgttaactagttgtagtttaatttttttttcgttgcgagatgtagaagttgaatttcaacttgcatgtttgtggagtgatatatcacatgttaatacatcttcttaatttttttcatattttttcataaccatttgagtgacatgcatacaacgataggatatcccctcgagagataaaaatccactcccgcagttaaatcttgttaactcgtttatcatgttttcgcatggggttgacccgatgtacgatagatttattcagttcacttaattaaagagctcattattctcgcttcgttgaacacgtactaacactgatggatcatttagatcctgtttgatataacttcgaattcaagatgttttgaaaccgggcattcctaatactataaatttatagctctgcaatcacgctgataacatttagatgaatcattttatttttatttaaaatagaatatacatttttaatcactataatttaacatataaactttaaatctaatgtgaatctgggatttgatgccagagaaattccccgtggcgaagaaaccgccgaactgaacgttgacgagggcgaagtggagacagcagagcatggtggcgagttttgattttgttgcatgtgcttccaaaattcaaaacgattttgttgcatacagcatatctctactacttaaaaaatttaaaacgttccgacgtccgtgacaagaaaaaaaaagggcgaaaaataatagattcgattgcgatgcgaaaaaaacagtccgtaatacaaaagtcatctgttaaacaaacgaaaatgccttaaaaaacggttcgtaccacaccacgcaaaaaaaagttcgactccgtaatagaaaaggctgaaaaaaaaaccgagaaaaaaaggcatccaccacgcggaaaaaaacacgtttctgcaaaaaaaaatattattatgtttttttattttctttctcgatttccgatttttccggcgcaccgtttccttcccgatttctaatttttccatgcaccgtccatgaaaagcagagttgtttctggttgtgtttatatacagatttgatgggccataaactacttcatgagctcggctaggttacgagctagcccaaacacaagattcggcccgattaaatttgagtcagataaatttcaatatatagagaagtccttgccattttaggatattatgaaacacaccataatctcaacatatgattcttcatgaagatttaaacgagagtataaaaaggcttatataatttctacgatctatagagtagaagtattcaaacggtaacatgctataaatgttgatgcgtcatcaagcaccatgtaaatttggaaatcatgcttacttcaaaactattcttttaaattagtttatcatgagctatcatattttccttcgtaatttgagatttattttagcgagcaaaagcactgggtgaaaatagcttcgattaaaaaaaataatttaagttttactttaattattctaattttattatatccgtagcggagcacggacattttgctagtatatatatacgtaaccaagttttagttcctccattaatttagttatctatggcaatataaaaaaaagcaaatctgaccaaattgtatgaagacagaacaacactacaattacaagtagatctaacactaataccacttgcataattattgcaggtagaccagaatatattgcactctccggtctccagcaatggcagggcactcttctctagctacctagctacatgagcctagaagcggtagctggccggagacgatcgatcgaggccgccgtcgtcgaagttccgggaatagctctgaaggtcgtacccgaacctcgccgccgcgccgccgccgccgtgccgcttcgacgacgacgaccgcaacctcgacctcagcttccagtacagctgcctcaccggccgcggcgccgccaccgccgccgacgaccgccgcctccctgcgccggcgcccttcgctgtcgtcgccatcctcctccggccgccgccgccgccgtacagtccgtccagaaacgccatctcgatccgcctttctccggctgcaggccggtcacaactcacaacaacaaagatcactccgagatcagtactcaaagcttgtccagagatcgagttaatctgcaaactcttcttgctctgcggtgcgagagcgtctccctcacctgcggcttatataaagctcgcaggatggctgtgggtatcaccgccggcggcggggccagcgagccactcaccggccggcaggaatggtccgggctaaagtggatttcaggtatcttttattctctctctaccccattgccgctgtggtcaaggaaagagacgatggagatagccacgacgaaagaggagggggagagcatcgtccttttgctttagaggcggtagcgtgagcagtgaggtggcaatggcgaacgcggccgtcaccctcgcccaaagctaggaacaaaataaatgaaaggattggaagagatagagttggtcgatcggcctggcctcgaatcctcgatcgactatggattctctgtcataatatcacgatcattatattaattgatctatgctattttttattattttatatgttaatgtttataataatagtattactataatagagaatgtgaaacccgtatgagtctctgatgctccaagctcgctcggtgtatgtctttctgctcgatcggagtggacggcgaaagcggcgcgaccagatgccgatcgatgcgtgcgtgtgcgcgaaactcatgcagagctaattaagagctagatcgatcgatcgatcaatgtggtcatttctatgggcatgtgtgccatactgagatgttcgtatacgtcacatgaacaatgagcttaatttgtgtaggtaacgtacaaccacaattaacgtactacttaaaaaaagtgatttttctgtatgaggccccctcatttttccatgcggaccataactagtggcgtctgtaaaaatcgagagtcatttttccatacggttgcttaagtggcccgtatgaaaaaatcgattttcccatacggacctattaagagggccgcatgtaaaaatgagctcatttttgcatacggctcacataagcgccccgcatggaaaaatcgatttttccatacggaccacttaagaagccgtatgcgaaaataaaatttgaaactagtgtatctcactcatatgaactccaaattgaataatttttttctaaatgtttctaaaatcatgatagaatatcgtgttcttactggtattattttggctgttttttcttatgactttgttttatcaattaaaattttgaatttcaaaagttcaaataatattttgaagcagtaaatgatttcatcggaaaaagtcatcaataacaaagttatataactcatcaagatctataacttctatttttgtcatttcttcatccgacaaagtgattttctttttcagatgaaatcattttcccaccactttaaatttttttctacctcatctcctctctccccttttaattaatttattacactcccctctctctctctctcctctctctccctctccctctctcagagcagccgggcggcggatggcgacagcgtcgatggcgtcggcgggtggcggatctggcggcgctgccctcaggagggccggatccaccgccatagggagcggctacagcggcggcgggcggcgcgtctacggcgatggctcggcatagcagctacagcccctgctccgtacgtcgatggcatcggcgggcggcgtggctacggcggcgactcggcggcccgccaccccctcctcaccgccgccgacaacgacgacgatgaggcgaccctccccccctcctcaatgccgcggcggcgggggcggcttggccgcctcgggtggcgccgccgcaccgcgcggatccggcgggggcgacgacggcgggcggcgggggagacggatccgccgccagcgacaacgctgggcggctggggcgacggatccggtgccaccgccgacggatccggcgggggagacggatccatcgccggcgacgacgccgggcggctggggcaacggatccggtgcagccgacgacggatccagtggggacgacgacggcgggtggcaggggcgacggatccgccgccggcgacggcgtgcggcatggatgcgtcgctccggtggcgggctagggtttgggatttttttgatatttatttttttggggggttttttggattttattttttttgtttgctgaatttattttcgcatgcggccgatataagcgaccgtatgcgaaaatcccatcttcacatgcggatgcgccggccacatgcaaaaagagtggtttttgcagacgatttcgtccatgcggttggggcaaccgtatgcaaagatgcttcccaaccgcatggaaagagcctttgtgtagtagtgacgagctccactctaagcgcgtgttatgatctaattaacaacatgtggtcgagttagggcgtgtttaagtggaagtgaaaagagaagagatgtaagctattagcgtatatatttaattatgtattaattattttaaaatttaaaaaaggattaatatgattttaagtaaatttttgttgacgaaaaaatcgaatacaccggtctaggagatctgcttagctcctgtgcaggtccaaagattaatgagatgcaggtgtgccagtcagtttgatcctgcaactgacaagatttgcaaataatagatcaaacactcaatcggctgacaagccgatggagtagttccagccgatagccgataatagccgatgccgataccagccgatagcggtagggtttaagcaatcggctatatgtccaatgtagataatgatataaaggcaatcggctgatgataatataatatagcaatataatccagtagaaaccaatcggctaacaatatgaaacagtaaaacaaatattgatccgatggttaaagcacatatcggctggaggtccgatgtcacaagatccacaagattagattaaacagtgaaacctttgttgtcatcggctaaatcgaacttatatgtattgcaatccttatgagccgatgcaacgtccacataactcaccggctgaaaccccgatgaaacccttattggcaatcaagaagcaggctagagattatggttctaagcacgacttagtagatcaaactcaactgatgcataactaagtatgaaaagaaacataatatttagacaatcaaaccgttgactgagttttcagggtggtagatgtctaagctaatctaatctagcaacgcgatttagccgataccggcagaaaccctaaaacaagaagcagccgatagagctaaattgatatgctaggactatattaacagagacatatgataaataggtagacaaatatatcatccaaaccagagcaatccaagtggtcgaatgtactgatgcagccttgaacgacgccgacgtagacgatacaattgcctggaccgacggaacattagacttaccccttcgccggagatcgaacaccgatgcagccccgcgtcaggtgccaagtcccgccagatgataaaataaagtagaaaaggtaaaaggtggcgatgcgccgaattgtattgatcgtagcgattgatagattacaatgaccccgggtgtacatatttatacccatagggagatactagttcttgtcggacaagaaagaaactaaaaaggaaaagataaagtccttaccggacactaaacacactttcctcaagataaaaggaaactaacaaactatacctaattaatagataactgtcatgtcgcatccttcttgaactcgaactcttctagataagcttcctttgattgatccgactccaccaagaacacgacatcgtggcgacttgactcccatcgactgattctagaactttgaagccgatactgactctaagccgatggtaactttgggcttaccaaatttcactgttaacaattttatattattttttaagaaaaatacattgtttagcaatttgagaagtatgtgaaaaactagagaaattttttctctttcaacctcactagaacatagccttaggggagatatatctgaatctgatgcatgttctgtgtgaatcagaatactctaccttcgaagtcacgtgattttatccttgacatatgaatctaatactgaactatgggggttgacaagaaaaggagtaaactgatactggttgaagcttctgccatttgctgggctttatggttgagtagaactgatttggtttttaacaaatcaccatctattttatttatgcaggtaattttcagggcaacgcactggctccggttttgggcacagctgcaaaggtgtgaggatgatgcggagttcctaaaggttgcatgccgcaagttggagtcgatggttatgcaactatttgccaattatgaatggaggttcataaatagacttcaataaatgtgttctctttattttggcttagtttcctctgtttttgtttggtgtgttctatttatctgaactacactcttggatgctactgtataataattggttgtagctcttttttagcaaaggctgggacgttaaattccattatataaaaaaatatatgaatctaataaaccttggataatccacatctgagtgataaaatgtacggtgactttaaagatagaatatctcaatccattttaagagggttttatgtctaagtgcctgatctcacgaccatccatcaccatgtaattcagcctgacatgcatggtgacgataacacacgatccacgatccttgctgcaaatgtacggcgaagaccctgaccgtccacgtacgacgatgttgcgagagaaaggttgaggtcggtgatataatgtaattaattaactaaattaaagcataagcacttgagcaatatatagatcaagattataggaagcagctacgaaatgatcgtagatggataggatgagaggaaagtgcagggagatgactgcatcgagacgctttacgcgcatgatgaccgatgggtttgtgtgccatatccattccatggatcaacctgacgtgtaacgtgtaagccgcgagttctaaatcaatttctgacgaacgcactggcgctgattagcgccgcgtggaacaaccgaatcctttgcacaaaagagaccgagaccgactggctaattactttttgcttaactgaacatctgctgatcgatctgtggctacgacggtctaccatataccaactttcagcatgatcattacgatatcaaaagaagaacaaaactagtactgtcctgtactaagctgttaggagatggagggaaggaaacacacctttttttaaaaaaaaatggaaaagcatactagtgtcattgaagacatgacccaatccatttccgctaaatgacagtccttccatttttagtatatttaaacatgacgtttgaatatttgtcttatctttaataggaagattaatataagttatacttaaattatctttaatgctaaaacaattcacaataaaataaataatactgaatgagatgaatgataacatcgtgtcagaagtgataagctggcaatatcatactccttccgttcaaaaattttaacttatagagtttaaattttgtcccacaaaaactaacttctaccatcatacatatccttaacacgtaaaacgagaatctttatctcttcaatactctttatctacttatcacttttattacttttttttaatgattaaggatattttagtcattctcactctccactatttcaaacgagaagctttatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacagatctcacaaaaggacggccatggtgtggcatcttttaattatgattgggaaattcaaacagaaaacaacggttgtcaaattatccgagagtcaccggcgtccatggcgaaccagcttcgagcaagagatcttaatttcatcagagattcagagagacacacataccaccttaattaacacagctgcagctaagctctgttcagatttcagatatccctacatgaacccaacaacaaaattcgcctaattaagaaaacatgtgctatcaggtctcaagaaaaaaaattaatcactgaatacaataatttcttcagtagtttcatgcttttggcaaccagatatatatgtacgctcaattgttcatgtcactccaaattgacatatacatgtataatacacaaacatcttcagcttcaggcttattatggcaaccgaatatattcatgtgtcacgtacgtatatatacatcccataccatactgtccatacagtatatgtacacaatacatgaacaagagcgtgttaggatcgtagtttctccattaattttgccatcccagatgagcactatgaaaaaaaaacagtagtacaatctaacactaataccacttgcagagttgcaggtagaccagaacaataatctccggtctccagcaatggcagggcgcgcgatctcgggatcgaaccgaatgagctacctagctagagagcctagaagcggtggccggagacgacgaggccgacgccgtcgtcgaagttgcgggagtagctctgcaggtcgtacccgaacctcgccgccgccgcgccgccggcgtgcctcttcgacgacgaccgcaacctcgacctcagcttccagtacagctgcctcaccggccgcggcgccgccaccgccgacgacgaccgccgcctccctgctacgccggcgcccttcgctgtcgccatcctcctccggctgccgtacagtccgtccagaaacgccatctcttctcactgacaaaattaagatcactctctcgatcgacttgctgtactcgagatcaaacacaagcctaggagtttttgcaaatcttgtttcgccgcgctgctgtgagctaagctagcgtccctcacctgcggcttatataaagctcgcaggatggctgggcatcatcgccggtggcggggcccgccggccactcaccggccggccggaatggtccgggctaaagtggatttcaggtatctttttttctctctctctctcccattgccgctgtggtcaaggacagaaacaatggatggagatagccaagaaagaggaggagagcatcgtagatataggctaagccttttgctttagaggtattcctccgtttttaatgttacaagacattttaactttgattaaaattaaactgctttaagtttgactaaatttatagaaaataataataatattttcaactcaacataaatttattatgagaatatattcaattgttgatttaatgaaactaatttgttattataaatattactatatttgtgtatagacttagttaaatttaaaggagtttaacattgatcaaagttaaaacattttataatttaaaacagagggagtagctaattaacctaggtagcgtgagcagtgaggtgggaaatggcgatcgaacgcggccgtctccatcgcagcataaattaaaggagagcaaaagctatgttgatcgatcggaataatcgatcgtttggagatagatcagtcggcgtgtcgaggcgcgatcgatcgatgctcgctgccgtcctgaaatgttgtagtggacggcgaaagcggaagcagccagatgcatgcgtggatacgtggccgagatcgcgatcgaactgctgccgaattgaaatgttgtgcgtgaaacttagggtttgaaagtccggccggaatgaaatttcggaccccatacattattatttcggccgatttttttaatttttttaatttgataatattttgttcaaatttgaccaacatttgttcaaaatttcagaaatttcggatcaaaattttagaaatttggtatatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataagagtacatataagaacccaatagtagattaactaaaattcagaataaaaaataaaatataatctgaaattaggcaaattaaaaagagagttaaagtagaaatacaattttaaaacaactgatattcaaaataaaaataaaaaaatctaaagaacacaatacgaaaaataaaataaattctgaaattagaaaaagaaaaataagatatcagctagaaatacaatttataaataactaaaattggtgataaaaaaataaagattactaaaagaaaagaccatctgaaacacatgacgagattaattaagtaacatgcctatataggagaagagtggtggcggttgatgggacatctaaaaactattaataaaataccaaataaaatcctaatgactactaaaaagaagtacaacgggcaggtcgtgaagcaatcggtcaaggcgtttggcgggacttctagaaagtaaaaaaaaataaacccaatgataatcatatttgatttttacgttcactgtgggggctagaaatttccacattaatcggagaaaagaaaagaagagtccaagtagaaatacaatctaaaaatagctgaaattcggaattaaaagtaagcaatattgaaagaagagtccatataggaacgcaatacaagattaatcaaaattcagaataaaaataaaataaaatccgaaattagcaaaagaaaaaagagagtctaagtaggaatataatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatgatgactaaaaagaagtacaacgggcaggtcgtgaagcaatcggtcaaggtaggtggcaggacttctagaaagtaaaaaaataaacccaatgataatcatattagatttttaaaatctcaataataataaaatgagaggcagcggccgggtcgtataggagtacaatggcaaagtcgccgatggttggtgggtcttctataaagtaaaaaaaatgaattccaatgatagttatgtttgacttttacaatcctaataaagagtatgcggcggacgggtcatagaggagtatagtggtaacgtttgatgggatttctaaaaattataaaataaaaatgaaacccaacaagataataaactccaatttttaaaggttcgggcttctaaaaagtaaaaaaaataaaccccaatgataatcctgtttgattttaaaatctcaatgacaataaagaagggcggcagcgggtgagccgtagagtagtatagtgacaaagtcgctgacgttttggagaaacttctagaaagtaaaaaaataaacctaaaggataattatgttcgatttttaaaatagcaatgacaataaagagaagatgcaatggacgaacatagatgagtataatgatagtgtttgacgggacttctagaaattataaaaaagatgcccaataggacaataaactctaaaacatataaagattctaaggagaatgaatagaaaacggtggtagatcgagcaagcaaataaagaataatatgacagaagtaaggggtagcagttgttgtgactttagaaactaaggaaattagaaacacgaggataataaggtttagtctttaaaaatcttaagacaacgagataactatttaataaatttgaagtaaaatcatattaaaaatatataattttatatgggtgctagccgcgcaattgcgcgagccacccagctagtttatttttaaacaaagaaattcagaaattattggtggccaaagttttaaaattaagtttgattaaatcctattttaaacgttaaatatttataacttttagagggagtacgtcctagcgtcctactaagctcaagctgctagctatgacgtaaaaacacttctgtttaattatagtgctatagagtgataacataaccacacatcaacggtcggatttcagacttctggcaaaggaattatacgcagctagtacaactaaacagttccaatttcaggccaattgctgctggatactgtttgaggcctagtgcctagcttttatgttttgttattcgaaacctatattgcgagcttaaatactcagactatgtatctttggggctgcgtatatcctgctgcaggatgtataggtcgggttttaatccattattaaaaaaaattagttatattcattcgtcagcaagaacaacacattcagccgttgcagagtgtacatatctgcttagtgacatgatgacatttatctagcctttccttacgatcttatctactcataattaacaaatttctaggtcgtagtagtgagcatctcaggaaagcgaaaaaaggaaaaccactaagccctaaagctaaatctagctacgagatcaaagtgacattagatgatgagctgatgactcaccgacctgatcggctgattcacagatctcacaaaaggacgacggatggccggcagctttaggattaggaaagtatagttaaaaagcacaagtcaaattatccgagtcacttggcgatcagcttcgagcatggcgatcagattcgagcatgacatctttcttaagctcatcagattcacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaaaccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaaatggtggcgcagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaaggtacgcggaagctgcacccaatttcgcccatgccgatctgtgaaatcgtgatgctctctagtgtcttgatgattagtgttgcattatgacgtgttatgagctgcgttaagtttggtttctaagtattttagtgtgatcttttagtccacctgcataaattagtgtcaatttcattatgggttacacgatttaccatattgagaatgctgatcagttgtggctgctacgattggagcaatgctctatttttttatgcttacgtcattacgtgattaagttacacattcttatgagctacagtgagcttgttttgggggctaggctttaggttgattttacttgaactatcatcaaatctaccagaaaacaccaaatatgttagcaggttttttttagtttggtgaattatttttaagcaaaaatttatgtgtttgcttattgtgagtttgtaacatggcataaaagagggtacaaatattcttctatattttactgtcttcactaggaagatgttttagatggggccttttggttgggaacatgatctttattgcctgacatggtgctggtcctacttttaataactatggtgttctcaaaatatttttcaactggaagatggctggcattacttatctgattgcgctgtataggccaattgctgaattttgttcgttggagcttgttctgttattttatttgcactgccgtaggaaatacacagtgacgggaggactgcaaggttcttcagctttttctggagcaaacttatatacatgtttgcatattcctaagtaaacgtcacaaacaaagcattgttggatgtagaggttttcttataaagattttatcttcataagagttcctccatctggaagcggtcacatattccattgccctaggtagtggcatcgccgctatgaaactttgggactggccatgtgacatatatttttgtcttctgatgccataaatataatacattagcttttattcattctacatgttttgtgtgcttttattctttggtctcttttacattttgagcagcatttcatttgtacactattcccttggctattttgtcattggttttatcatttggagctgccatgtggtctatcgaattaataccggttatgaaatttgatgtgcagacaatgctggggtgattgtgaatcccaagggtgagatgaaaggtatggcgagaacactactatactcccatatgttatgtgttattgtattttctctcgaagcctaccaggcaataatttactcactgtgtattcttttccaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaatcagttcacagtcagcaaccagatcgtattctggagaaactagctgaatgaacatcaatctcacctttctgccacctgaagctgcctgaagatttaggctttgttctatgcttccctacctaatctctactcgctcattttcaatgtgccgctgcacaacctctgcgatcagcgacggcccatttgactcctttctatgtacgttctgacgttatgtgatgttctaggatgatttcctctggggttaattggattcatgccactacaaatatgctaaattagaaaaatagcactactatttgtgatatcggttgggtgccactagaatttggagaaattagaaccgtgttactccgttggttttccatccactcctcgttaatttcccaacttcagtgcttggcctcgatgcggcagcgaaggaacttcggtgcttggcctcgatgcggtagcgaaggagctcggtggcagggaaagcgatgacagccttcaagcatgacagtgacaatgacgtttcccaactctggcggcgagcggagcttcggcgacgagcgactagagcggcggtaacttgggtacgcggggaaggcggcgctcggccttgatgtggcgaaggagctcggcggcaggaaaagcagcgacggccttctccgctctcaaggggcacgatggcgaagcacgccgagagggcgaagcggcggcgacgggccatggctgtgcgcggcaagagggcgaggtgatggcgaagggtctctaggggcacaatggcaaagcacgccaagagggcgaggcagcggcaacgggccatggctgtacgcgggcggcgagaggtcaaggtgacggcggcgggtctcaagggggatgatggcgaagcatgccgagagggcgaagcggcggcgacgggccatggttgtgcgcgggcggcgagagggtgaggtgatggcggcgggttgtgactctgtgtcggaggggagaaggagaggcggcggcggactgtggctgtgagtgggtggcgagagggcgaggtgatggcagcgggccgaggctatgtgtaggcggggagagcgtaaggctgcgccggttagtggggcgagggcaaggcggctcggttgtgcagggaaggcggtgctcggcctcgatgcgcgatggtgatggtggggagtttcgacgatggtggaggagatggcagcactcggcacaaacgaaagatggtggcgccaatggggagtagataacgcgacggagtggcatggatccaatttccccaaattttagcggtactagtcgatatcacgaatagtagcgatatttttctaatttggcatatttgtaatggtgaatagtagcgatatttttctaatttggcatatttgtaatggtatggatacaattaacccttttcctgtagcatagtaagagcatcactaacagtccttatattgttcccaaaactgatttttatgtttttaaaactgatttttatgtttttaggtgaaaaatcggatccaacataaccccacacacgttttagagttccttcaccatactgattgtaagggttttaaagtgaaaaatcggatccaacacacgtttcagagttcccttcaccgtactgattgtaagggttttaaagtgaaaaatcggatccaacagatcatctacacacggatataacagaaccctgtttcttccaaaactgattttaatggttttaggtgaaaaatcggatccaacatatccccacacacgttttagagttcctttaacttactgattttaatggtttttaagtgaaaaaatggattcagcagatcccctacacacggatctaacatatctcagtttcttcgtgatctattcttataaaatttaggttttctatgagagagatcagtttttttttctattttcagtttagaaaaccaaaaacaaaattttctattttcaatttagaaaaaaaaattgggagaagattattcgtaatgtcttgatgatgctctaagttcctcttgcgtaattttccaatattctcaatggatgtgcattgttacgacgataaatggtaataactgttaaaatttctgccaacaggattttcaaaagattcagcctttggtaaggaatttcttttttttatctgattctttttttagatagtcgtgtttttagatgccacagatttcattggtccctcacttgtatttcctaatgaagtaatgatatatctggagaacttttgggtcatttttttattttttatttgtgatctttttgggaccttaattagttgattgtttgaatcaggcattctgtgtaaacaaggtttgcataacagttttattcggtgtgcttctacttagcttaattttattcagccgcttatattttgactgaatagattaggtttcttgttcccaattacacgacatgtagaaattactttgacacgcaaaaggtttgcgcgttcgcgaaaaaagacatatagaaattacttcatccgtattcaaatatatgatgttgttaactttatttagtttgttttcagaaaagaaaaagaactttattcagtcaaacttttgaaagcttgatcattaatagctctcataatatttagtttgaaaaataccgtatgtgtagatttttctttactggagcatttacaataatacagttttgttagatagttttgttgtattctaatttaaaaaaaagtactgctcagacttgaacactagagaaggaataaagtcaatagtataatatattcatatagaggtattataccgtcaaacatttgcaaatatatccttttcctttacaccctcagattgctaaaggcctaaatctatattgattttccctgctccaattttctcaaccgtttccaggaccacctcaaaacatactaggcatttcaaaatgccttctaacatcgttaagtacacacgacatttgtatctatacaaattatgcaaattaactctatctatttcattcacctgcaagaatgacaaacaagtgaaaagcagattgatatgacaacagaccgaccctacagcaactccagctgatcaacatacatcaaatttctacaaaattattcagaggtttgaagtaaaggaccggttaaatctgcacaaaatagggtggaaaaaaaaagaaaaagcaattcgagagagtttctcagtgctgtgtcgtatgagtttatatccaggattccactgtgtgattgtacatgtatgagctcatcccgctgatatgcgctagagcgtcagaatcaagcatgtcttctcccttcacgccgccctgcaaattcaagacaaaaaaaaaaggacaaaaagtcctcaaatcattgccaaatttcacttcgtaaatataatcccaagtttcaaaccgataatatcactttgttttaaagatttttttgagggcgttcttggcatttgaatgcttacaatttgttcatactcttcgtgattctgcgagccgatcgacctggatgcctcgcagtagtcgtcgttcttggcgaacctaccacggacgcgaggccggctatccgcgagggtttttctgcaagcgtactgcagattttttttttaaaaaaaaaatctgagatgtcagtaacgtggtcggcggtgaggtgaaattcgtttgaaatatgggttgggggggggggtgatattttgaatttgaatttgaataatttggaagttcttgcctcaccttgatcttcttgctgaaattcctctcgttcctcttcttgatgtacctgtggatcttttccttcctctcctcgttggagaggcggacggtcttgaagctcgtgtcctccaagctcgtcgtctccgtcgtccccgtcgccggcagccgcgctgggctactcccgcctccgcccatctgtggcaccacgaccaccatggtgaaacggtcatggcgtcatgctgcgcgtgcgcgagaggttcttgcatggcggcaatgtcctacctgcaactctgcggcggcggcgttgccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctcgccggcggcggcggcggcggcggggagcatcgcgccggaatgctgctgctgcgggcagagcgggtcgtccaggcccatgtaccctcccgccccagctccggctccagcggccaacgccgccgcgaagacctcgtcggtgaacccggcgtactgcatcagctcggtggcggtgctgctcagctgcgcctgcagcgccgggtgctccgccgccgcgccgcccatcaccgggagaggcatctgggtgaattgctgctgctgctgatgctccggtggtggtggtggctgcgtctcgtcgacggcggagaacgcgtagtcgtcgatggggaggaggagctcgccgtcggcgccgggcggctcgtcttgctcgaggagagccgagagcgtggagtccagcgacggcagcggcggcgacagggtgtcgccgccgccggcgatgggcgcggtggccgtcgacgacgacgaggcggacgcgtcctccgaggaggccgtgaacatgtccgaccctgccgccgccgccgcgttcaccgccgcgaagaggtcgccgccgttgccgtcgtcgcagaagtcatagatgtgctgcgctatcgggctcgagatgccatcctgcaaaaacaaaaacaaaattcagacaaaaaccatcaaaccaccaactcgtaaccatttctttcttcagaaaaaaaaactgtattcttctacaggcctgtgcaatgcaaacattcatcgccaaaatcctgaattgacaaaacggtgatttacagatttgtattaggctatttaaacccatttctatgattcttttataatctctttttttgcaaggaatcaaatgccatactgttgtatttgcaaattatactgttctatctgaaatctgaaatctctgaagatgtcaagaacagtagaggtataggtccgtatgccgtatgctggggggaatgttactgttaggatcaggcaactaatcaaaaattccaatgcgcaatgtcataaagctcgtggagattaggaagcagaaactatcaagtcgaggcatcgattcccatctgtactgcaagaggtccaaaaagcagaaagattttcgcaggatctggtgcccctttccgctttagtatgatagccacctaacaattattgctctagcaaaatctgatcagagcattagcatttgccaattgccattgctatggaatcctaatatgcatgggcaagcagaatgcaaaataaattatcagaccatatgcatgcagaataacaacagcagaaactgctgaaaacaaccatgctgaaactgactgaagcttgcaaataactgcagaattgagcctaatttgctttcaggagatttacggcgaaaggctcgtcgtcgacgtcgtcgagcatgatggatcttgcaccaaggaatgctctaaattgatactgagaaggtagaggctcatcaacggaatgggaatttgaagaggagaaaagctcacgacccatgctaatggcagtgtgttctatttataagcccatgaacaagaagaccaagcaataatccaggctaattatagagccataagagccggagacctaacaagaactagatgcgaagtaaccgtagcacttaattaggacaaaggacaaatatatttacatgtcacatggtgaaaatgtaagtacatatgcccaaagctaaagaagaaaaaaaaaggggaaaacacctatttttgtgcatgttctatgccgtaattcggctcctaacgaacaattaaaccgccctttgtctctccaagattagtttccccttactcctagatcagtttttgaccgagacgtcgtaattttcttttgcgagaaaaaagggatattgctatctagttgattcaacacatgaacacatgatcattaagagataacagtatgtgatatatataggttttcatttttttaaaaaaaaagaatgaaagagttcatggtcgcacaagatataggattccagttcctattgtctttctttgtaattctgttcgtttgcgatgtactcaaacacctcattacgtcttaatgatgcgtattcgccaaaaaaaagaatgtaagagttttgcctgatatattgtttttttatctctgcaatactgactcgatctcagaaattgtactccctccgtcccataatataagggattttgagtttttacttgtaatgtttgaccacttgtcttattcaattttttttgaaattattatttattttatttgtgacttactttattatccacagtattttaagcacaacttttcattttttatatttgcaaaaaaaattgaataagatgagcggtcaaacgttgcaaacaaaaactcaaaatcccttatattggtacggagggagtagttgattcttgtaggtacaatgagaattgctttgaatatgttattgatgtgcttatctctaatttgatatgctgattcaatggttcaaacggtgtctatcccgggtgaaattttgacccccttttttaaaattttcttgtcaaatatgatacatattaacttatcattgcttcatgaatccggaactaaaaggcggaaagcgaaaagacacactattactttagagacctctgcatacatgcaaggttggtcacatatctaactaagctttggatgtgcgtttatagatatttcaggagaactggatgccaaacgtcatggaaaaaagcagccaagtacatgcatgcctgccagagatgtatatgctcttatgtggcaaattggggctgtaaaatgatgattgatcaataactgtttgcatgcatgaagttgttctctatctaaaagaacaacctggtcattccgtacaaaaagaacacttcatgtaactgaaaaaaaaaatggataagaatagcaagaaactcaggtctcacttgcaggaatagcacacaactcttgcatgcagacatgcagtcatccatgctgtgaagcaaagtcgccgcggcgacgccaagcagatggatgcctgacgaaagaattgaaactattctgattccagactgatcgaatgcatgtctgtcagactgtcaggcgaagatgcacctctatctaatcccacagtgcatatgcatatcgatctccatttgatcatgttcaacgtagtgatcatcggttcgtcgttatatataattgaagtagaaatactagtatccaagttaacaaacacactctgattatttatgcatgtatgcagattttattttttgtgtgtgtgtgtatgtaaaactggcatgcaaaggagttaaaagagagaagttagaagagttacaatggcagaaggcagcatgccgatgaaatcctgatcttgaaacatcatcatcatctctactgatcactgcagaaatgatcactactgtctagctgaaaattttatgtatctatagtctatgagaaatatgtatatgactgaattgggtgaaagggctgagaagaaatggtgtatggaattcaggtgtgtaggagtagtactctgagtgaagtctctgaagtctgcaagccattcagaaggaaccatttgagtatatatagatcatatgagaataaccaaagttgtgtgtgtgtgttgtgggcgtacatggctatagagatttagccctagacgccccccaggctaggtaccatctttggcatctctgaatctatctctaagctagctgcacagcttgtgaaaaaaaatgttctgtccctgacggtgaacagtacgtacacgaaaactcaactgggtttttttcacactgctgctaatggggaatagtgatagtggagatctaggaatctgtttctgctaatgaaaggatggtgtggtatgatatgaggaagcaaatgcttatctgattctgattcaggccaaccctgcacacactgagatgtgtagttgcagtactggtttttctttcttttggtgacagtttgcaactttgcatgacctgctctgtctattgtcggatccctggctgaattttggtgacagaagttaggaaggatcgagtgcggagagttgactatgtcctctagaataatatacaggaaatggattttaagccgagatcacacgctcctttttcttttggcacgcacaacacaacaaatatagtttcggaagaaattcataaaccatggtttattgtgttataatctttccacaaacatgcgtgatcaaatctgatctaaataagcaaaaacagaaatggtaaatacaagtgccaatgcaaaatgcactttttatagtcaatgttgctatttttcttcatatgcagatcgaatttgaccttgattgtacgtcgaaggatttgcaacacaatataaagtatatatttttcaatttaaaaattttaataattatttgcttcacatacaataaacttagagcatgtgcctttgagagcttaaagccaccaacgtacaacacctcggagatatgctcctgtctctgagacaccatgtaccattaagctcgaagctctttctctaagaataagttctcatatacttttttgcttgttggcttatcagccgcaactaaaatttatattttagaacttaattttagaggtaattttaggttatttttcatctattctatttttagctttaattttaaaccactaataacatagatataagttttacgcgtaactttttttccttcgttcgtttttctatggcttttaaaccaacaacttgacacaaatgtgattcttccttacttagtgatagatcactagtgtcgtcttgagcttgatgtgagaaattgttgcattccgctctacccaaactaaaatggacatggagtcaaacacaacacttcaataggttgtgagtgacatgtggggtagtctctaatctaaagaaaaagcactaatgaacccttttagtgggagatatgtctagtaccttgtaagtaacataaaaatgtcatggtcattcctattttgtagagtagaggcacatgtacactgtaaacacatctcttttttgtagtaagaacaataaaaggcgtgtttaggtgtatgcactcctattctagcgcgtatgtcttatccatgctaggcttgacctgattagatgaacgcaaccatgcaagagaggttgcttagttggttagatcaattgggctaggattaaacgagattcaatttggttggttgcatgttggatgaagccgatttcgatcgtctcggtggttgcatctactgatcatgcacgggttacctcttccaagttccaacaggtgatgaggtatcactccaataaaaaaattggtcaactaggaaaattcatcaattctaaaccccttttctcaagttcccatggaacagtgtcgatgctaaaaaaaatgaggtcttctgttaagaatatgtcaatatacaaaagtaaatttcactttaagcaatgtctattgaattattgaccaaaatagcataatagataagggctagacccatcttttcaattgacgctaggaatttcgccattcgttgggaggggactccaccgccaatgctctttgctcaattcgcatgccagtggctctctatctagagtaggagagcaagcgatcaatctaacgctcctctctctagctatgcattgatattgaatgagtagtagttgcccatggctaacaacgaccggagctataccaaggaagctcaccagtcgataacggtggtggtgctaagcccaggaagaagaattgcatgattatacagcggaaagaaaatcgtatcttcaacgtccacagcgtgcatccacattatcatagtaaaatacaactcttttatatgacaatgattatcatcaaacccttatcagagccaaggaaaataagctaagttttagctgaacaagtggagacaggagatagaaacttcgaaaaattgaaataagaaggtcctaaaatatattgtaacacattggcatggattgaaataaacattgccctaatttgttaggcatgtgccatcacccatcttgcacttatcagccatgtcgtttggcatatgttgattataagccgtaatggcttatgagtgataaaaataattcgttatatatatatatatatatatatatatatatatatatatatatatatatatatatatatatatatatatatgacactaaaagctaatgctgaaaaataaactacaattaaaaaaatcttccaaaatcaacttcaagattaaaatttaaaatttaaatttgataatggcttgtaagcggaaggacaaatgatagggcttttagtttttgtaccttactgtaatttgagaaagtcactctatccaattgctcatactatggggctgtttggatgggactaaaaattttagtccatgtcacatcggatgtttagacactaattaggagtattaaacgtagactattgacaaaacctatttcataaccctgaactaattcacgagacgaatctattgagcataattaatccatgattagcctatgtgatgctatagtaaacatgtgctaattatggattatttaggcttaaaaaattgtcacgcgaattagttctcatttatgtaattagttttgtaagtagtatatgtttaatactctaaattagtgtccaaatatccgatgtgacagggactaaagttttagtccctaaatccaaacaccacctatagttgctagcttagaggcttgtgcgttacaatggaaaacaaaatcagtttctacctcattagatcaattaattagcatttatttaccaagtaatatgatgatttttcttattaacaagtaggtgattttgaaatttgaggagatccaatagtaaaataggagatgactcataaagatggtgtaatagtacagattaggggacccacatatcaatggtagtgatgatgtgggaaaggacacccactattataacattttaagtagtaaagagtatagatatttgaaagtattttttcaaaaaattgtggaaagttgtatactacctaataccattacatatagccagttttattatagagtactagtatcataaatatcagagtactatgcattagtgttcgacacctaaggcggtgcaaaatctgccaaagaactagatcaacgtgctgattaggcaggtgtcaatccatcgagaattcgatcgatcgagagagagagagagagatcgatgcataatctaatcaccaaatggtatgtaccgagcggagccccccgattcaccaccgttttcaccatcaccggctcacgtacatatagcagagtctaaccgtgcgtgccgatcgatgagcgcgagcgatatgatccagcgcccacgacgatcgatcgacatgccgctgctccagtgggggaatccggtcggccgcccgcgtctcgtcacgtcgatcacctacgcgaatactcctacgcgataccagtagtgtagtactaggcataagccgccgcacgcgctccctactcgtacgtcgtctctcggatcggtagctaattaagctagctaagctaggtagccgcggccgggcagagtagacgatcgagtagctgagatgcgaatgcatcgttgcggcatccggccgggcgggcgtttcgtgcggtcaccgccgtgagattactggcgatctcggggagatatatttgttgggatcctgggtagaaaagcctcggcccttttgtctacctagccaagcatctccagctaaatttagccatgagtaggagagtaccatgctatatggtgtaggagacctgcactgcataatatacatgagttcaacacactaatgagttatattttcaagcaataatgagttatattacaagcatatgtgtgttagagatcataacccggatcgaaggaagcgtgaatcaactgtacgatctcaaattaagctaatccatttcttcacactaggaacaaattaaaccattaattgcaggtgtactgtacacacctgcaagtgaggaaaggattaaggatcaaaggaaccacgtacgcgcgagatggatgcgatggcggcgtgtaatgtccaagattaaaaatcaatcctgtcagcaacacaacaacaattagcacccaaaggatattacattagtccatgagatcgaacagataaagctataccttagcctaccagacagaactaatgcccatcagtcccccaaaagcagcttcctccccctcttgtcacccccatgagggcttatcttccagcttagcttagcttagctttgccatagctagccatgcattgcacggcccgtgcacaacacacatccatcaatcgtgattcttcacaacgttcttcacaacgccatgcacgctagctagtacccttttgcaagtagctaggtagatacatatatacctctgataggaatcttgtatccgttcgtcaataggccaaatcgccgtgggccagctgccgactacactagctttttaccattgcgtatagtagcatgtttaatgcagtaaggcatacgtcgaacctgtgtttgctgtcgcctgccgaaacgtatagaaggcgatcgaaagtatggtgtctgagatcgaaagtgcaggagtagtgttagctttaccactagctatggaatgtgcataggccaaaccgggggatctgactgtcgccgctttgccgcaacaccggcacacaccgctacgtcgatcatcctcgcgcgcgattcccggatttcttccacgtagagaggccgggtagctaaggataatttggtggagaccggatgcaagccccgtcttctacagcccagctctggattattgacgcgtggatgatgtattgatcggacggggcgctccgctcggctccaggctcacccgagcccgatctatgcgcatgcggctgatggcgcttgatccgtcccggctcgatctgagcgtgagcggctcatgagcaggaggacgccgcctgcccgttcgccgtcaatcctcgttcaacctccatattgagggagtcgttgtcgctttctgcctccaccccgggttgccaccgcctaccaggctaccaccgctgctctaccaagtagcgttagatgtgcagcttgtcaccgtcggcggcgtcgaggagaagcatgcgccggactatggcaagaatgggtcaatggacacaagaagccatgacggccgcgaaggtggacatgggaaggaggttgtctcgtattactggccaagggaaagatggagaattacagatgttttggacattttcgaagctgctgctgtcgttgattgcaggaggtgaacatcgatcgaggagcagccgctgctccggctgttcttgaattcttgatggggattggggaagatgaagatgagcctgcgcgactgctgccggccctactggggagtggggatacgtcgagctcgtcaccacattcgaagataattgatgtaaaccaaattgtggctcaaaatcataaattgattggtgtcagtgtcagatgtgcatgccgatgctatgatgtagtctgacatcgttgttttgaattttgattttcagaacaacacgacgacacaccgcacacagcacaggctagcggcgagtacggtggtacggccaccgcgtgcacatccatctacaagctcgagctcccctcgccggcccgttgtcacgatgatgccgacgccgctgtcgccgccatcgagccgcgggaggccatgaacgtggattcgaaggcgtcctacctcatccagatcaagaaccccgagcagccgccatcctccgatggtcgtggcggtgacaagatcaagccgcgcgggcccagatcaagccgggatgggacggatcgagcctcgagctccatcagccgcacgcgcatagatcgggctcgggtgagcctggagccgagcggagcgccccgtccgatagtccgatcgatacatcatccacgcgtcaataatccagagcagggctgcagaagaaggggcttgcatccggtctccaccaaaattttttccggagccgtgtgtgcgcgcgagctgttgatgcggtgtgtttttctcgcgcaaaacatggtggaatcgcgcgcgcgcacacgcgcacggccggatgggggccggggccatatatatggcacggcccgatcgtgtactcatgtcggctcaaggccgtgcgccggcccgcgcgagcgtgcgtaggcgggagcggaaaagggagtacctatgcatctttcgaaatatttttataatcgtatcacacagatttttaatctttagattaaaatctgatagatataataaaaagcaaaaagcaattaagaaacaccataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgagcggaaaatatgtggacctgtttggtacagcttcaactcttaaatttagctctaggagttgggtctggagtggagttgtggagctgcctaaacccagctcaacaactctagttcattttgtgagagagctccacctagggaagctgaaactgtttggctgagctccagctccacccctgctaaacaggcccatacggagcactacgggtctatttgataaagtttcaactctaaaatttagcttaaatggttgggtacagagtaaattcatagagcagcttaaatccagtttcacatctcgttttgttttattgagaatgttccatctagctccgctttatatagagctgaaactgtttggttggactttagctccaaaaggcactacatctcgtgaagcctagatatcaggatggcgatgcggttcaggtttcagctgtgagagaggggccgtgtacatgtcaacatggatgcacaggatcagttgcgactttgtgcctttaggggtgggtcatgctgtgaggtgtcgatgcacatcgacagggcgagatgcagggaggcgagatgcatggtgtcccgtttattaccatcactaggtgaaactccgtgcatttctgcgagaatttagtatgataacaataaaaaaaataacgtgtaaaatagctatataacatcagattaagtgaattaatgtggtttatgataatttaaatttaaatagtatgtagaatggtgattcaaacgtaaaaagtaaggtggtatgactttatggaagaagaaaaatatggagatagtttggacagtagattaattatctaaaggctaaaaacaattgatgtgatatgacttaattagaggaaaaaaggagaagataatttggaccatagattaatcatttaagcactaagtgaggatgaactatatacctatatcataaaacataataaatatatacattgaaacattatgtgaattatgttggatgataatttaacatttttgtatttgaaaagctcttaaattataaaaactataaagatatagcatatttgcatgatgtttaaatgtgatgattgttagtggatgatgatgtggcatcttgttaattagtagatgatgatgtggcatctttgcatgttaaggttatggagttagtgggggataactttatagtaagataggattcccttcaagcctgtacgatgatactccttgaagatttttggctgtgttcggtagtttgggatgaaaactaatccctctcatatataaaacgatgtgactcattagtacataattaactaagtattagtattttaataatttttccatagatttttttttgaaaaaacacaatctatactctctataaagttacaacccactaactctaatgcttaatatgcaaccatgccacattatcacccactagcaataattacatactcaatctcattcaagcatgcaacatcatctacaatctatttaattctacaaatcattatgtatagtataaatccaatcatcacccctcacatcatttccacaatatttttacaaacctatcaatcattcttatgatatttaacataaacttatcaattaaagtgtgagttttatttgtttgtttcatgataaaaactgataagccttggtatttcatttattttttttacccctagcttgattgtagtgaaaatatatatattaaaaattaattttcacatcaaagcgctgaaaatcaactgtctttagcaaattgagaaccgtgcgtggggtagaggaggggagaagctgagaaacggtatcgtaggtaccgcctacgtagccgtgttcggccagatatttcacaagcctacaacatctatagcccacgaagtatttttcaggacccaaaatgcggcccaccaaacttagccggcccacgcagttaaagcccaatcacccaatggaaacggttcaacttgcgcgaccgatttcaggcaccgcgagtggaccacggcggaaggaggagccgcacaagcgacgagattttcgcccccgcttcggattaaaaccctagccggctaaacctgctccgctcccccccgccgccgccggcgccgccgccaccaccactgccggagagagagagagctgcctgggaggagcagcctcggtgcgcgcgcgcgcgctaatcccctcctccactctccgtcgccgccgccgccgcagccatgatctgcgcaagtaagcttctctcactgtctctccgaaaccctagctgttctctccgtgcgtgcgctgatttgtggcctccgcctgttgtgaagtctccggcgaggtgccggatgagccggtggtgtcgaagaagtccgggcttctcttcgagcggcggctcgtcgagcgctacatcgaggtcggttagggttattatagcttccgtgggtttagatctcgcgtcgcatttgtgtgtcgtgctttgagctgatgtttcttgtggtggtcatggtcgtggccatggcgcaggaccatgggaagtgcccagtcaccaaggaggagctcaccatggacgacatcgtggcggtgaagaccaacaaggtaaggcttcgctggaatgctgagaaaattattgtggagtggcaggcttcagcagcgtgtggcgtggatttacctatgttttgtacaagtaactgatggtgctataccttttagctgaaaaacttgcataatcctcaaggcctcaatcatgttatactatttgcaggttgtgaagcccagacaattgcaggctgcaagcattcccggactcctggggatgttccaaaatgtaagtggttccactaacttcatagttatctgtgttatagacagtgaagatctgattctttttctttgataatagttctcacattgttttgtttattaaatgtatagtttgttaatttaaaactgtacctgaaagtactttttatctgatgtttgaattaaagataaacacgttgcataataattgggaatgattcagtgttaagtgtctttctccattgcacaccagccagtttgacagaacttaatgcgctgtttccaagcatagtcaggttactagagggagtaaactaatcttcataattggagcttggcaaactgcctgctcattggttatgtttaaagcagattcagagattctgtggtagagttaaatttctggtctttgtttcctaaaatttgcatcgccctcagtttaaatgatctcatgtaactattaggaagagtaatatagtacagtgccttgattttgccacaaataatcatggaactaaaaatgtcttgtgagaacccatcatgattcaccctagctctcactagaacaataccatggcttttacaggagtgggatgctatcatgctttctagttttgctttggagcagcagcttcatacagcaagacaagaacttagtcatgcgctatatcaggtatgtcttttacctatgcagaatttctattacatattgtatcatgttaagtacaaaatcttcccttttcttttgacaaactatgaatgttattatagttctacatatgctagcagctttagctgatgaaggatctgctcagaggattttgagcttttccataggtctattgttggggcatgttagattgctatggaacagtgctctcttttaggaactctggtggccattttgtatttgtgtatggttagagcagatgcagtaggatgttgaacgtccttacataataaaaattcgaatttttatttagaaatgctacttgactcttgattctagatgaatttatccctgtaatcagcactgttgattcccaatcttgagtcactcttttgactcttgataaactaccccctccatccaaaatatagcaacttcacctattccttcatctcaaccaatcacacaaccatctctcatttaatatctccacatacttcctcatatccactaattacagccatacctcattaaattccacctactttcttaatctccctcaaaagctctagaaaaccttatattttgggacggagggagtatcgtctttcttcttcttctttttttgtatttgacatttgtcttttttttatcctgctggtgcttgtgccttttcacttatagtaccgaagatggctaatgatgatttacagattatttttccttctatgcttcttgttgtgcatatgtacaaggtatagttgttggcttatttcctggcactaatcctgtggtgaagtgggcaacaatgttagccctgatctgtttacccatctaactaaagttcgctaatctgcaaatgaccactagttttgtacgggcattgttaagttgactgttaaatatctatccttgttcctgctcctgttcgagttgtactgcaatttatattttcataagctgaagaaaaaatgcttataaaatcaatcattcactgaccagtctagaaatgtgtgatgctgttctgggttcttgtgcataccatataactggtgatatttaggttgtttttttgctctaggcagtctggtttgagcttgaaaacaatagccctgtttggagaactagccaaaagttattttgagagctattttttagcacaaggaaatagccctccaataaaatagccctaagttgtttggatcaaagggttattttgagagctatttggcctttaatgtagcttcccatggagagagatagagagaagacactttttcagtgggcccccacccgaaatagccccaattagcaccccttgggtgggatagttttttttgggtgggttatttccaaatagccctcaaatagctcacccttttggatctttttgggctatttgggctattggagggagggctaaaaaatatcccttggatccaaacagggccaatgaagtattattactgcaagttgatatgttaaaaaactacttgtaagttattgaggaaaaggtctgaagtaccaagctttgttaaggcattgcttgtctttacagctacatttttttttcagcgcttgattaaacagctctattatgggttaaatgctgaataccgttttaatgaaatgctcttttagttaacacttttgcttttaagaacattcattatcctgtaatctgatctgtttagttgttttatgtcccttttccagcatgatgctgcctgccgtgttatagctagattaaagaaagaacgagatgaagccagagcacttttggctcaagctgagagacagattcctgcatcgatggcaggagctgcacctacagctgttgtctccaacgggaaaagaggtacctactttctgactgtttgaagttgttgaagtaaatttctacatataatttcagccttctcatagttctgcattgttggattcagcatttgaagatgaagttggaccagacgggaagaagattcgtcctggtatcaaccctgtgatgattgatgaactaacagagtgtaataccatgctctctgcgcatcgtaagaaacgacaggtacatatctgtattcatagttatgctacaaacaaggtctaaaacatgcattaatgtttttatccaatagttaagattatctcaagaatgctagctcatctcgccaggacattatttctcagtgtttgttgccatctttacaccttacttttgaaatgagataacagttctctacattttctcacaggttcctccaactttggcatcaattgatgcaattgagagatatacccagatctccagtcatccacttcacaagacaaacaaaccaggcatcttatctatggatattcatccttcaaaggtctgtcttttatgtttttagtgtaccttgctttgaatatcatatactctgtggtcttatccttttcagttcaattaggtgtaagatttcacattaattgaataattatatcactaatacttctatttgtacctgcaacatgatgctctcctgaaaagcttggttcacatgtagtttgttttattttgtaatctgtttgattcgtcttggatttaatgttgataatttgatggcaaacggtgatttaaacacttattattttactttgttcttattctggattaacaggacattattgcaactggtggcattgatacaaacgcagtgctttttgacaggccatccggtcaaatcttgtgcacacttactggtcactcaaagaaggttttccctcattttattttgatgatttagatgcactcaattgatttttaatctatctctaaaatttatgttaacattggaaccttcatatatatagataaccagtttgaaatttgttcctcgggatgagctctttgtaactggatcagcagataaggtatgccattctctgatagattaattagtcacataaatttgatgcaataatcaagttttgattttgctagtaaaattgattgcatcatttcctgcagtacttgattaggttgagcatgtttgcagtcactggtccgactatctgatgattaggttgtgctgtttattcttctctgagttgtttgcaaattatgcagactgttaaaatttggcaaggaagcgaggagggaaattacaattgcatccatacattgaaagatcacactgccgaggttagcaattgcgtggatattcttctgcaaaataacttcacattctttgccattttatgtttttggatattggaattacagattgctggatagctggtattcttcttgcatgcatacagtcatatttcctttctgtggcttctaaatttctgttacagtaaaattgaaaatatttatgaaatttctatctatcaaggatttgtcacaaatatgattataacacattttggcatgttgagctatgatactcaaaactcaagtcatactgcaaatgcagttctttcatcaaattttctttatcatttgtaccgtaagctactctggtccattcatgtttcacagttacaaaacatgtgaaaatgccccaccattgtccttaaaggccctcttcacagttacaaaacatgtgaacatgccccatcattgcccttaaggcccttgttctttacagattattctctgcactggattattgaaatggattatttgctatatactttggaaaatacatcttctcaaaaaaatttcttttgctgcatttcttagataacttattttaagctatttattgagtttatttttaaaaatatttaatttatatagataatccatggtaataactcagtaatataaatcaaacagggcaacttttaccatattttatattgtaatatttcaattggtaatataaaatgtttcaattcaaattctattgtttcaaacttatttgttttacaaaaatctgtcaggttgaagctgttacagtccatgcgactcagaagtactttgtgactgcttccaaggataatacttggtgcttctacgatattccatcaggatcttgcctcacacaggtttactccattatctttctcatgtaacctgctcccattcatccatgtacttatacatgctttgtctgttagctcccaagatgtttatgagttaatgaataccttttctttactcaggttggcgagtcttcaggacaagagggatatacatctgcatctttccacccagatggtcttatcctggggacagggaccactgaagctgttgtcaaaatttgggatgtgaagacgcaggtgtgatacttcggcaactcattcaagttcttttttcaggtgttcatgcatgtctgctcttgaaataccttgctaacaatcatcttttttctctagtcaaatgttgcaaagtttgaggggcatgttggaccagtgactgctatgtccttctctgaaaatggttacttccttgcggtatgaatctctccatagtgcaatctgcaaaatgttgactttcttttttattgtgatatatgtatcatcactgtacagactgctgctctcgatggagtcaagctttgggatcttcgaaaattaagaaactttaggacgatatcaccttatgactcagacacgccaacaaattctggtaaggaactttgcgcatgctccacactcacagtaaattgtgaatggtgcatgtgcttcgatgtgtgtatagatatagccaacaagcgagattatgttgatcattcaccctagatatatcttgctttctaggattttgattgtagctggaaggacatctcattccatttttgttatttgtactggagttccattaatcatatgatgcatgaatgtttttttgtttatcttacagtggaatttgactttagcggaagttatctagctgttggtggttcagatacaaggtattttctcaaaacctgcaagtctgaccttttggtgcaaatgttataccgtaaacttttatatttgatacctcctctgtttggccttcagggtttaccaagtagcaaatgttaagcttgaatggaatcttgtcaagaccttaccagatttgtcaggcacaggttcgtccctttcttatggcccacattctcggttcgtgattggcatctgtgcttgcacttaactaatttggtttctgtggcgtacacttttctcagggaaagtgacaaacgtcaagtttggcaccgatgcgaagtacattgccgtaggttctatggatcgtaacctacggatatttgggcatccgggagaagatgatcaaatggacgacgcaaagccatcggaagagtgatgaaaccaattgtacttcatttggcctgcgtaaattgctccctgtttgtgtgttttgacggtggatgagctggctgagattggaggcacataacaacgggagacgagaagttccttgcaggagcaatttggtgggctttggtcgatgtaaacaaatttgacattgttattgtatttgtaggccttactacctaatgaggatacggtttgttttggagatgaatacaatgctgaagtgctcgacttgcggacatgccaatgaaatctagaatgtgtttaaatttgtggttacgtaatgtccatgcactaacgctcgtttattcatttctcaaagttgctggcgcgatattaaggaatggtttgatggttaactaattagtcgtctaatctgagaaatctggcagcatccgaattaccttgaacagtacatcaaggcagactaagtatattgaggacctttccgtgccaccgacaagcgtggtcacataagctcactgaaatgtgggcaaggagggtaaatcctcaatttcaaacaaaagaataatgaggactctcccgtgccactaacatgtggggtcataacaagctcaatgaaatgtgggccaggaaggtaaatccttatatgtgatcaaattttaattcaaagatcaaactatggccgttggatataaatcggatggtggatgaaatatgttctggcatgggctgaaattgtcgagtggatcagtaatgggcctcgtgtgggcctcaactaaaaccctaacaaagagagaggcgcagccatcccactcacagacacacaacaagtcgattcgatccatcccggaggatcctccgccgccgccgtgccggagcgccgccgccgccgccgtcgtaccggaggtaccactccctcccctctcacatagcagccccccttcccgtcttcacctaggtcggattagctcgtggtgctctccctctctcctcgttggttctagttactctggtggtttagggcgtagagggtgtggaggggatcgggttggttgattgcgcttttttttctgtgatgtttttccttctgtgctccgtatcaaatagattgaagtgataatatgtgattcttgtggaaatgggtatggttgaaaccgctatgtccttaagagagagattggtaaggaactctgaaaccgctgtgccttaagagaattgatatgaatatataattgaagtgctaaaataaggatagtttgtagctttctttctttcaaacagctcatcattttcagggtttcggtgctgatttacctttctatagtgaagtcccttgtataatgcagcatagaggtgacaggagacgatgaaagtactcctttctgaagttttaactcctgagaggcattagaagctgtgtaaattaatgacaagttttttcattcaataatagagaagttctctaggagaatgccaacaataaactcccttgtataatagaagtctgatgttgcgttcgagttatcaacaaatatttctctgacttctctttcatgttatttcctgctggtttttgttgaacattaatggttttgatggagggtcttgtttcggttcagatcttcataagcctacggcatggcaaccactctgaaagatgcagttgcacggaagcctgtgttggcaacaatccgccttatcgttccagctggtgccgcccgccctgcgccaccagttggtccagcgctaggtttctacaggctgaacctgatggcgttctgcaaggatttcaatgccaggactcagaagtataaggcagaaactcctatgcaggttaccttaactgcctacaaggacagcacattcgagtttgtagtcaagtcaccatctgtctcatggttcctcaagaaggccgccgggattgagacagccagcggccgtccagggcacactgtagtgtcatccctttcacttcgccatgtctacgagatcgcgaaattgaagcaatctgatccctactgcaagcacatgtcactcgaggcgctgtgcaagtcaatcattggcacagccaactccatgggcattgagattgttaaagatctatgagctgcttggccccatctttgtcatgaggggagttggtgagttgcttaatgattttgtgtattactaatttttagttggggaagtaaattgtgtcctggtttattgagcagagatcttgagagttccatgcctctgaaattgccttcagcacagccttttttctctctgcaattctgatctgaaacatgtagttcccacaaatcgttctcaccgatgtcaatttgttcaatgtggtgatggtacaatgaaaataatagatttctctgatgatggactcatcaagtctgggtgaacctttgagtgaacaacctgtaatgcagcatttgctcatataagcaggatagttttccagttaatctgtgattcttccggaaatctggtcataagattcatctagcttgccttccactgcccattatgatgtgcttgcagtttcaactttaatccaaatcttcacgctgttttactacaaagaactcaatgagtaggttgtcgggtttttccaggtttttctttcttttttttttttaaaaaaaatcctccattctacaacctacattcattgttcatcttgctgtccaagtgagtttaagagaaaccgagcaaatttattttttgttcatgtgagttgaagagaaaccgagcaaaaattactttttgttcttctttgaaaagtcatcttgctgtccaagtgagttcaagagaaaccaagcaaatttaatttttgttcatatgagttgaagagaaaccgtgcaaaaattactttttgttcttttttgaaaaggaaatcgaacaaatttactttttgttcacctagtgagttgaagaccgaacaaaattactttctgttattttctaaaaaaaggaaatcgagcaaaaattacttggtagaaaacattcactgggagatcaaacgaatgtattccccagaagttcaaattcgtatacattaatctgactgccctttatctgagataaaaatgaactagaagaacagaatctattcacccagtagcggcttgttttcgggttggctctaattcataaatagacatacattcaattaaggatgcagttctcgtttacaatgaacacatttgtgccagttgaaattgatactcttcgtgcataccaaactagctggaacagtctttttttctgcttctccaaggttatgattgtacatgtttgggtactgggaccaaacagtagaaaatatgatctatccattgctgatatgttcaagcacaagatattgcagtgctattgagtacttggctgctcttccttccctggacccacaatctgaactgctaatgctcttgagtatgtaggatccatgcccatcacctaaggaagccaaattaaatcgtgcaaacataacgggaagaaacaaaaagatttagattgatagccatgaactatcatagactagaaactgacatagcacaaagaaatgaaacaaataaagtgaatcagtcatttacagttttggacaatttagttggtattcatagcagtctcatcaaacaaaactttctaagacggatacaaactaaaatgagaagtatcttgactgtcatgccatctatgtaagtgcagtgaatgaaaccaagagggtatctcatctatatattttgttactacagtgaatgaaccaagagggtacctcatcaaataagatttcaaagatggatataaaatgcaacgagtaaatgtccaaactaaaaagaattatatgcaagcacaagatgttctctgttaatgtgaaacaaagagccgatgaatagcaatagaaacaaaaggtttacttaacaaaatatgggtgaacaataaaatgacaaccggcactgtacatcagatatcttgtaagatttaccttggattgtatatattgaacttatccacctcttgtaaatgaacatggatcttggggtgtcaccttgatgaacatcagagagcaagagattacaagacccagggactccgagctttgtgctaggatagagattgagatgtttattctcaggaacataggaacatgcagaagtttaaagatctggcattgaatttatcactcactttgcatgcgcaacagcattttgacacagagctaatatgcgaaccactgctagatcccgagccctagcatttgcatatctttgctgacagctcctatagtttcagtattgtcagaactagtcataccaaaaattgggaatgcacaccatacataattcaagtcaattactatagtgtataaagttctcgctttgatgatgtagatcaaacctagttttctcagaaagatcagaaaatccctaaaataaatttgtgcagcaggtggtctaatgcatcattcagtagaacaactaatagccatatcataatggagcatacagacctaacagaagtctacaccaaacattctgcacgtaaggacttggatcatcattatcacaactacaggtgcccagaattctcagctgagattattgagaccaaaaaaaaaaaaatctagaatgatcaagcaggacgacaagacaaaattaaaaacacacctttctgagaagaaatctgcaaaatcatcaataattactgcagcagggaagctgccaagcagatgaaatgccgcgaagtactttctgatgccctcatcatcttcaatgtatctacaagcacggagtacataaattagagcataaatccccatctttttgtcatgaagtaacacaaataggcatttcaatacgatcacagaccatatgcttagctgacaatagcatgcaaatctcacaaatcatcaatagtaaataaaatgtaactagagagatctcatacttgatatggattctctgaagcacgctgtgtgatagatcaataccctgaaagaaagaaataagagtaagatttagcttcacaaatgaggagcaggtgagattttgtaacccaagattccagagcacgagtagagaacaatcgctcacctgggacaagaacggggggctattctccagtctccccttcctgcagatgaacaccacgcctcgtccactctccgtcgcgcggtttatcgcgaactggaagagaagcgacgtcttcccgctgttctagcaccaggagaggcggcgaaatcggagcaagagcggagtgagccaagccgcagcatcggggatgggacacggaacgcacgggattcgacaaacagcttcggtttgattcatggtggaaaaggagctgtgagacgagagtacgagacgcgtaccagcacgaagggcccgagacgagggtgatgtcagcgttctcgggcgccggcggccgggtggcgcccgtgcaggagaagaacctgtgcacca

SEQ ID NO: 58426 - DNA, 11884 bp, Oryza sativa
tattaacaaaaactataagtttttacaaatgagaacttttacggtgtttgcatttcaaaaagggtaaagatccaacgctcctcaatcacaggtaccatgttaaaggtatttaagtattaatataggtatttaggtactaatggtaaaaatataattttgctagtagagtgaaaagggtagaattgtcctccaaattataataggtaccgcataggtacgctctacacggtatcagcgtatcttttacgtggtttcttgaagatttacgttgtattcgagttaagtcaccgtagtgttctttgatgttctcttttgcgtagatttctctagatttacattgtattgttataatacgtttgtagcctaattatgtgaattttttctacatttacattttgttccaacgaacacatgacaactcataccttaattctgttaaaaattatagtttgtttctagcaagatatttatattgtgtttcagaaacatgaccagttaaaatatcacccaaggttagcatcaatttaaattatacatttcatcaatttatgatacttgcctccaattgaacatgctatgtcaagttaaccaacaacatatcaacacaagtagtctgactcatggtgagcatgctcacaaacaccaatatcatacccgctagataaatatgtcagacaaacttcatcaacaacagcctttttacaacaaaaggtcataggttcttttccgtttgacctcttttgcggcatttcttctttcagcatatgattttcttatgctaaagcctttatcccaagcgtacttgttgtagaagtgaattccttcatcctcactattgaatgtcttgctgacaatttgttggtactccaacaattcctcaaccgatatccctgtatcctccatcagagcttaaaacctacaagaaacaacatttaatttttagaacaccctttaccatcttgagttaatttataattttaactcaaattgtacatagcaaattgctttgtataaacaaatctacaaaagctaatttagtgtacaactaatttgcatgcggtacatacgaaagaatagtgcactgcattaacaagaactaaactatgtaaataagaaaattcaatatgtgtcaattcaggccctacccaagtaaacttagggatccatgaactcggtaaaaactataacaattgcgtaaataagcataggagatcttacctatgcacttgttacgtacgtgtcaatcagattatgtctcatattcaaacacaagacagtgccaatgcttctccctcaattatgtcaccaagcaagttcacctattcaaaccctaatatgaagaacatattaggatatctctttttgatcccttgtacgaagaaatttgtgagctacataaataactaatcaactacgtaaataagcataggatatcttacttatacacacacctgtacatgtcaattagatcttgcctcctgttcaaacgctcaaccataccagagcttcttcctcaaccgtgtctcctcgtgggtacacccgttaaaacactagaagaacaccattggagaagatctcgtttaatataccacaaattgacaaaaattctaaatcccttatataaggaacttatgaactatacataaataattaatcaactctgtaaataagcataggataatttaccgatgcgttaggttgacgttgaccaggcgatctagtctcctcttcaaccctcaaccatgccaaaacttttctctctgtctccttttggcgaacctgtctccttccagtgaaacatccaaaccctagaacaagaacgaacccaagggaaagaagaatggagatgcgatctgttacggatcaatcggattgatatccgtgatttactcttttctctgatggcttaccgatctggatactgacttaccgatctgaatactgacagatggatgttagtattcaattaacgtataatgcccatgttttacaagttaattactccactgccatcatgttacaatatttttgttccgtaccttgcccctctcttatcaatggttcacgttgttccacctccaagtacctcgcaaacactgtaaaagatctctttacaaatagcaacaacacaggggaaaaaatgaaaaaagctcaatgagcaaactgttatcaggctaatggcgctatctcatccctcttctagacaacgtgtcggagcacggagctcctctagtgggaatgcaagataccttcccttcagagttcggccaaggtgcaggttctaagcttgtggccaggatgcaagagaaagaaggtgggacaggtggtttatataggttcgggctgagaagcgtaataccctactcttatgttcttactctatgtgatgatgaacaagatttacaacaggtgtagggggaatgtgctaagtgggagtgtatgaacttagtctactccagggagtcgaacttttttttttctcagagacatggatcctccccatgcatgcatgcggaagtgggacccagtacataggggttgttatgcttagtcttgtcactgtccctccaagtaggctggtcagatgggacgggcttaccaaacggctgacatgtggagcagggctgcaaaagtcttcatcttagttgtccatcagcctacctattagccaccaaagctaacaaagggggagggggtagtggggtgatagttgagggcgtgccacgtcgcacacctttttctccaggaagacgtgggcgtgtgagaggtagcatgcatggccacgtttctcacattgtatgtggtctgctatcaatattcatatcaccccgcaattaatgtgaaatggtggggtaaagtaatgcgcatgacctagtcaaatccccttaatggggcagattcctttgagacagatttctatattcattgaaccgccgaatatagtccctcaaacattcacctgggttgagttaaattgtgaaggtcttcctcgatcgcgtggcacttgtatgtaccctgaaagttggcgacgaactgagatcgagcagggtaggagatgaactagccatgatcgagcagatcctttcaacacagacgacaagtagtttgcgagcgcattgtcatctgctccagcagcgtaaagaaccgtggaataaacatggaggaattcctcagggacggtgcttccatcgctcctggttagaatttttcgatccaccgtatttctcgcaatgttggagtgaacgctcggttgtcgtcattattgcgtcgaggtgaacggcgctgatgtcggtgagcgttgtcttgttctcgtcgttcccgtcggcgcccgttcaagtggtcacgtaaatcgcgattatcttgaggggtggggtcccctgacgaggtcctcgaggtgaggtattgggaggttacgaccaggatctcagctcgaatgttcgttggggtcttcttcgacactgccgtcgacgtgcacctcttctcctcgagctgggagttgaggaggatcttgagccggaggtccagtcgccgccgcaaaagcactattgagattcaccattgtggatcgtagtcgttcgacccgccatcagggaacatgaccggatcaaaagggctctatcttaatattgagttgattgtgttcaaatgcttggcgggagtacagatgggatctgtggtcgcccgagcagttggattttgattactcggactactccctcgattacgttcacctttcgtagagtattaggtgccgaggactctagatcctccaagctatgtaaaaccgaggcctcgtgggggtccataccaatgaatcccgaaacggtcaggagctccctgggctctgttcctatgcaacgcttcgagtttgaactcgtcgttcttggatctgagggcgtggaggtttggtggcgtcaaggaagactttgcagcctaagagctcatgtcctcttgagtcttgacttatggatcagacaccaggtggtcttggttggtgaagcacgctgaataccccgttccttgcaggcttcgagttcagctctcacgtgttgcaccaccttgcagtccgtaaaagagtgattggtcgtcttgtggatgacgcaccaagtggtagatcttcgaggagttgtccttgccggcgcctgattcccagcaaatagatgatttctggccgctcgaggctacttctcggatgtcgtcatagtcgatgctctcctttctcggatgttcgtcatagtcgacctagttgcatccatgaggaaagcgagtgtggcggcggactattgctgcttgtacttgtcgccaacgaagatctcctacgaacgcaccatctcctttctccctaagattttcgccgcgaggtcctcgaactacctcatggttgaaaggtgcttgaagttaacgcgcatggcgtccaagcccgaatcgacgacgacgcatgccgacgggcatgccttgggcatccttgtgctcacgaggaagatgagtgtgtccatcaagctagcatagaggatttggggacgattcaatgaaaatccatgggttgaacccattttggacccaaaggtatatgaccgaaaaccagatcgatccaatccactttcagcaaagtccaaactgccccaacccaacagcttcgttagaccatttctacccaaaatgaaaaccaatccattataccaattcccacccaacctattagcaggcctatccacaatgcccatgcatgcatatgaaagagggacccaatacacaagggttggtttgcttggtcttgtcgctgtccctccaagtaggccggtcggatggaatgggctcacctactagctaacatctggagcaaggccgcaaagtcttcatcttatttgtccctaggcccacctatcaaccaccgaagctgacagggagggcttggggtgatagttgagggcgtggcacatcgcaaacctttttctccaaggtgacgtgggcgcgtgagaggcagcatgcacaaccacatctcctatgtcgcctatgataagctcacaagatttgtatcaccccgtaattaatgcaaaatgataggataaaataacgcacaagacctagtcaaatcctcttaatgggccagattccttcggggagacctcgagtcctgctgctatcctcgggggctcggggccctaatccacccaggttagacgtttcagccccggggtctgaaggacttgtccacgggctgttgtcttcctcaggtcatcttcgtgagcttggggcaaaggttgatgccgtgcgccatcttccccttgagacaaagtggggctcatagtgacccaagcatatgataaagtgaaaacccttgttcccacttctccgacaaacaacatcaatagcaacaaccgtggtggagcttgacataaacttaagaggggaaacattatataagcatgtaaagagtgttcaaaatatcaaaagttaaaacaaagtttctcttactataggacaggtatttaaaaatgtaaacgttttagtaaaaagtgtaaaatatagtataatgtcgacaagaaaatattagtagcgtgaaaataaaataaataatctatgtacgtcctaaaaggaaaaaaaaagaataagtagaatcaaacccctaattctcagggatgagacatccgccagctaacctacctatcaaatctaggatgttgcagtgttgcacatattactatctacatcaacttgaaaacactggaggggccactgcgcagtttgacctccattatgctctgccactggcaacaacacaggaaaaaaaaagaaaataagctagatgagcaaactgttatcaggctaatggcggtcatcccatctcacttctagacaactaatgtgtttgaggagtaggagattggggagatacgcaaaacgaggtgagccattagcgcatgattaattaagtattaactattttaaatttcaaaaatggatcaatatgattttttaaagcaactttcctatagaaaatttttgtaaaaaacgcaccgtttagtagtttgggaagcgtgcgcacggaaaacgaggtgctttctcaccctatctaatacaaacgaacgcagcctaacaacatcatcaaagttctggctaccaaagaaaaatgataacagcagtgaacagtattttttttggtttcccctagtaggccaagatcaactgcattatacaacaacatatattgtgacaaaattatcagattttaatttgttgcataggaaactgcataagtaaaatgtagatctagattattaaccaaccaacaacagaaaaagggtgcatttgttgttgataaccaaatggcaataagaaaattgaattactattacacacagagtacaacagccaacttttgtttatagttgttcaaggcagcaccagtcatttaacacacacaatcataacaattaagaacaatccaatcttggcatttgaagcaggtgtacagttctgtagcatttctctaatatatataacatcaatatacttttgcaactaagtcctttcaattcaaaatttcaaactttcaactccaacttagaacattcaactcattttcaaaattccaaattaataatttatttatcgttttactataaaagttaaattaaaacgctaagcactaggctgcgcgggggctgagcggcttacggttgcggcgcatactccctcgttccataaaaaaccaatctagtgtcggatatgacaaattatagtattactatgaatttggacatccaatattatgttggtttttcaaggacggaaaaagtaatgtgttactaggttggttttttatgggagagagtttgcgcgggtcagaccgatggatccgcatgtgaacattgatgcacgacagagtatgaggaatgcatatgaacctggaggcatgtcggcggtaggagattcagtaggattggcaatcccttctcctctgtgactgtgccgccaatccatttcctcgtcccgtcgccgcgagaacccatccctgcatatacaaacaaagaggtggccaacgttaagacgaagaaacaaagctgcatccttgacgtcccggacgagtgagtacgtgcatgcttcaagattcaagagcaagattgcactcaaagatggaagaggctgtaccatgtccttgttgttgtctgtccttccggtttgcttctccaatctcctcctcctgatactcctggccttcggaagtaggtgctcccccctctttccggtggatgcaatcctggttctggttgtggttggtgcccgtagtcgccgccgccgcgtgctcctggcggccggtatttgcctcctcctcctcccgatgagtgccagtcgccgccgagtgctcctggcggccggcgttcacctcttcctcctcccgagaagatgtgcccttgggcggcgcgcgctcctggcggccggtatttctcttctcctcctcccgagctgtgagattgagcggcgcgtgctcctggcggccggtatttttctcctcctcccggtcccggagctcgattcgtgtccatagtacgtcctggatgcatcatttcttggttagtacaagactacacagaaagaaacgtggagaaagagacgtacgcgcgcgccgccgcggcgtggtctccacggcgacgaaagatggagcctcctcgccgggcgacgcacgtgccggccggcgaggcgagaccaacacgcagtacgcacgcacgcacgcgcaaccgcaaccgcaaccgcaacggctcaggatcgatcatcgaacgcgcgcgacgggcgccggcggtcgaggagacgacgacgcgcgagagctaggtgggggtgggaaggaggatcgatcggggccgcacaccctttcctttcgatattgcttctcctcctcctccttgccttgattcttagcttccatcgctactccctcccccatccctatcattttcttgctcctcctgtcctgccaccctaggtagacgacgactactccaactggtttgcaaatctgggatggggagaggccgagagaggaggaggaagaggaggaggaggagagaacccaaaaccccaaacaccgaccacaccaccctccaccaccccaaggcttgcaggagacttctctctctctctcttcttcttggtaacgagacacatggcgcggatgaagcgaacagcctttttcttgcttgtttttttgctaacaagggaaagtgggaaacccaagtacagaccagcataccgcgcttggcccccgttgccactctgctcccctcgcagtcacaaggactcgattttgaaattgtatccattttgtcatgttgtttttttaatagttttaaaaatgatggtgaagatgttgtacggattttgtccagtttggtttaaaatatacttaaaattttcaaattttaaatttatggtcaaataattatgcccccctttgttttttcctcacataaatcattttttcacgttgagggatatagtcacttttttaaaaaaaatctaacaatcgacttgtggtcaattaacagaatgagtatagaaaaaaatcaaaatgaaaactcgatggcatgtagagaataaagcaaaaaaaaattaaggcatagaaagaaataaatgaaaattctttttttcttattaatatatatttctgtgccacttttttctttttttctcttttggcttaggccgtccttgtatataccctttttcttattaatatataccatggaggcctccctcactgtgttttgataaaaaaaataaacaaaaatgcaagtacataaggaatttgctcaacaataaggttggattcgaatgtgtagatttagtggcgcggaaaatacaacatatgtttcgctcatggtaaattgagtatgaaatattataaattaaaaaaatgaatttgtttgattttataaataaacttctattagaaaatatatgaaaaaaatattgtttagcagttcagaaatgagagagtagttaaccggataagctctttagaacgcaccctcacatatgtttgatctctaaacaattccatttagtcttaccaagttttggagaaaattgaaaaaaaaaaaagctccacgagtaacattttttgaactgaaaatttcaagtccaaacatgtgtccagttaaaaccggtcttaccaggtacagtacttgtgttttaaaaccttgattagcactgataccatttctttattaaacataaaaaaaattcatgcatttgtcctataaaaaactggtaattcgttggtgtacacacggtacattgcgtctgcatgcaagttatttcaaacgaagcttagattcatagcctgtgtttagttacacgctaaaattgaaagtttgaaaaaattgaaacgatgtaatagaaaaaatttatatgtatagaaaaattcgatgtgatggaaaaatttaaagttcgaagaaaaaaaaagttagaataaacagggccatagacaaaatagtaacctgagccacacgcccacacctacacacatccacaccggcgatgaggatccgcatcctatgcctttgctcccaagtcccaacggcaaaatttgccttaccttcaatctgaaccatccattaatggatcaatgatgtttccattgcccatgggacccacctccactaacactaaacaagagaagatacattgaaggaaaagctactttcctgcttaattaaaagaaaagacttcagaaaattaaaaggaggtggagattggaaaaaaaatcactgtaaaaaaaagggtttatgaacatatatacatttttctacgccatttgtttgacgtctcctctacaagcatccttgcaagtaatgaactgtttttttttcactgtattacttcgtaggagtatttcactatttacttcttgtggacaattttcctacttcctctgtttcacaatataagtcattctagcattttccatattcatattgatgttaatgaatccagatagatatatatgtcatagattcattaacatcaatattaacattaatatgaatgtagaaaatgctagaatgacttacattgtgaaacggagggagtagtcactatctttcattgtttactttttgtggacaattttcctagtcactatctgctttagtttcttttatttttcaagttaatattaatatatagagttcaatatcgtgtcttgttttaattaattgagcaggaaacaacaagttctttccgcgtactccccctcagaatggtagtcgaggcaaatagtagtcaattaaaacatgcatcatcctttgatctattggtctctcacccctcttcccgggggcagttgggatggcagagttgcagctttttcctagctagcgcagtcgcgtcgtgtggagagttcgatcgtgtgaaaagtttgatcggtgcggtgcagcgcggaagggcgcgtgcatgccaatgtgccatgccatgcgcggctcggatttagggtgtttagtcctataaaaaaccaacccaacacattttacgaatttggagattcgtagtcctaaaatatatcacatatagttttagattcgttttttaggatggagggagtagatccgtggatgaatgcgcatgttttctaagccccataaacagtgttattttcataaaaaaacattactctctctatataaaaataaatttattaggaaactttgttaaatttatttcaaactttataatatttaaataattcagttgtaccctcgaatagctatttattcacaacaaatcatacagtagttttctatagttggatgggcattcctcgaggttccacaaaatgaagaacacttctcaaggcaaaatatccagtgaagttttagcagagattaagttaagaggttaaggttacggtgagactacctttatacatttgagatttgacagctcattagttttcttgaccataattaaaatgaagcaacaaatacatgaaataatacaggtacaacctagtatatcaacttgtagcatttcaaatgttgtcttaaatatatacacttctctacatacctgtcataacaaatatctcattttatttcttcacctacttactgatcatcttaactactacttatacaatacagtagcaaatatttttttaccttacctttaatactaacaatgggtaaaagtagctataaaacggggcagatgtaggagttggattggaaaattggtactatagaaaacttatatttaatttatgaacagactagtcgtttatatttcggagaatgggactagtataagcatttctaacttttgactcagcagtaccatccatttctactcccacaatgaccgagagaaagctgcaaagcttttgcattaactgcaggggttgaagttcatggatccctgcaataaaaagaggaggagagattcacggacgggagtagtatggtcagggatccagggatgttccatcagtagttccatcagaccctgtttgatcagaagaaaaacaaagtgactttaaatcaaaggatttatatagtattcaaatcatatagaaaaaatttctatttggccatttgattcaaaggattgagggtccctttaaatcgcaggaatggaaaaacggaggaataggaaaaacgtaggattctgacaggaatatatgtgtaaaacagaggattggaaaacacagttaaaacatagaaatgaccgtttgattggaccacaggaaaaacacaggaatcgaatgagagagatagacttaaaggaatttttccaagaggttggacctcttgctaactttcctccaaaatctctataggattagccattctataggaattttaaaggatagtataggattcaatccttt

SEQ ID NO: 58427 - DNA, 765 bp, Oryza sativa
cgttaacaacaatgaggttgatcgagtcttctacagtggaagcaatacggatcaagatctcttgtcaatgagtagcatagatcgagacctgtggcggcatggattgaggcctttctagtggctatggcacggatcgccaatggttgagaggcggattgaggactttccgtggtagtatggatccatgcttttctaactgtggcaatagcgattgaggctggctagacgtgatggtggaggcgagtggagcaggaaggagacacaggtggtgagatatcgagcggatgcgcgcaagacccacttcttccattttttcagtatgtccccaataggagttatgtttttccgatcataatgggtctttctgacaattattagtcgaaaaactggccactgaagctcccattttcggtctagctgacggtactttacactggttttggcaatccctaggctataagcgaacaaagcagaggtccaaataataataagaatagttttacaataaaaatattttcgtagccacttcagcgcaattgtattcttggctctgttttctaatcaaacgatgttactccttttctttagctatatatatatttcttatggaagcttgtgtttggcccctcaatttgttactagtacataatggcgccaaaaatatggtctctatgtagatttgcccttactttcctataacctttatgccttttatttgctttgacatcaagcataggacataattttaccctatttgggttttca

SEQ ID NO: 58428 - DNA, 10777 bp, Oryza sativa
  unsure (1)..(10777): unsure at all n locations
tcattttcatttgggctcatgttatacaaatcataccggccctcttctctattttagggcttctttggactgaactattttcaagtaaaatctaaatgattctaatctttagaaatgcttccctattagctcctttggaaaaaaaagaatatatttgagaaaaaacctatggacttgctctctactacccaattagaccatccccaagccagaaactatacagtagtttccatacttgtcatgtaatatagatactatgtatagaaactatctatccaatggatggtgtcttcaaattaaattctcatccaatcatctctattctctctcttttcatccacctatccatttcttgcatgagaaatggtttcttcatttttttacatctctcatcattaactctcttgccacatcatagttttgtttacgtggcaatgtattaaatgctatggacaatagatgatatggagggttggggatggccttacagagaaaaataaacgtggggtctcatgttatattttcctttgagaaatctcatccccccatttctacagaatgacattaaggggtgtcatgaatttaatcctttattagcaaatgtttactgtagcaccacattattaaattatggagcaattaggcttataagattcgtctcataaattagtcgcaatatgtgcaattagttattttttagcctatatttaatacttcatgcagatgttcaaatgtttgataatttataacagacattatcttctcagctaatcacaactcttcactattcagtttttccacatatctccacttcttatctaatcacagctctctttatttaattatacctattttttaatattttctctatctcataatataagcgatttttggtggacagacggtctgttcagattcattgtattaggatgtgtcatatctacagaaatctcttatgttatgggacggagggagtaacagtatacaagtttaaaagtgattatattctgggtgggaggaagtatggtttcatgtgacttactggggtgcttaaataaatataccagtgcgtaccgattagattacgaaatcatcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctggtgagcacccatccgttatacacgctctttccgatctctctctctacccacgcacttctactcgaatttgcgttaaaccctagcctctgttctgtaaatttgccctaaccttaatactaataacaatttgcctttactgtttttcttccttcatcttagctctggggggatcgatttcgtgtttgcctctctttagatagaatttttcccccaatgttcgagtgcatatattggtctggtcgggcaatcccttttatcttccttcattcatttacctgaaaacaacggcgtatcgtaccttttgcttttccctgtgctgttgtgaatacaagtgtggaggtcactgcaatgctgtgctgttcgtgaaaattgatgatgccactctagttttcaactgtcgatgtgtcttgatgcttcagtctctgatcattgctattcttaccgcttacagtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtaagtttctgattcacataacttgtctataacatgaaatttatttgcgccattagtattcgtatctgatgttatttttatcaggtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggttagctttcgttctcactgtgttccgttttccgtctttctgtattattattattcccattcaataattttgcatattcaggtatacccaatttgctggttcattttactcacctaacttaggagaatgccgacaattgtgtaaggtcttggaaagctggcgtggttttcaccaaagaatacaagctactcagatgggacttcaactgaatatcggtcagatcccaactattcatcgtggttttgtatttcagacctgagaatgagaatttctatgtcgccccttctgaaattgatcttgctttgattgagttgaacttcttataagtaataaggtacaagtggtaatgaagaaaaccgtaagattgttcatattgaaaccgtttcatatgttgtgtattaggaacacatgtcctcaataattaccgttcagtataaaatatggttacatgtttgtaccatttccgtaaatgcttgaagctgcaatatgaagtatgatacattgcagaaatcttaaggtttcctaatttatttctacttttttttgggaataatattttatttctactttaataagctcactagcattttatgcatgctaagggccaagaatgcatgttcactgtattcctatatacatcatatagtgggataagtacgtcttgaacttgcctctggtctttttccatgtcttgaggaagtttagtactctattgcagacgtgtcatcatcagtgttcatcaagcctgtacctgtggttgactatgttgcacagcttcttaacgaggacatcttattagacagaccattatgtagcactgagttcttgaaggtcaggtcgttttgtcatcctatttaatcacaaactgatcattgctattctgttacttagtacttgatttaaattcctgtgttcactccattacaagattcactttttttcccctctttgttagattaaggaggctctagaaggtctgaaggttcagattaatggcattttgttcaacacatatcatgtacaagaccttgtccatcaagcagcaaggtatttactgtatgcacttgctttcacacataaaaatattctcttgtgtctatagttctgctctaaataggccatctatgatgataataggttaatgctattttggtttttcctgcaacagttttccagttaactttagtattcagtacccatctttgccttgcttgaaagtggctcattttggggagacaatatttctgccattggaggttagtatcctgagcgaacatttattctacaatatccaacaatattaagaatggacacacactatcgtcttataaaaactgcttcttatcaccttctgtattctaggtctgtaaaattgctgagggacaatgtcaccagaaacagctcaatgcaaaacatatggctgctcttcttcaggtagctcgacagccccctaatgagcgtgactacaacattctgcaggtaacctgatacaaaaatttctacattcagtttatgtttgtttaggatttcttttaaatattttagccatgtcaataacattaagtggatcagttcaatctgcaaacttccacaagttagttataaatatcatatcatgtcatatcatggatttttttcgatgataatcaaaagacctacatgaggatgtgcttaaggtgatcatgctgtcatccttatgcacaagatttatgttatgctattaacatgtcatgagcagtgagcactagaagatcatacatatttaggagtataaactggcataatctgatctaaatgtggcacctaagccctttcgcaaacaacctaactcctagagccaccatagcagatgcttgaatacgtgcatgtatacgtgttgggaagaggagagtggtccttcactgattttttttaaaaatatttttggaggcaaccctaccactccgcctcagagtgagtatgggtcttatgggtggagaccttttatattagatggaacataaaaattatactaacatgaatgaaggcaaaaggtattggtttgactcaaaagtatttggggctaaaccggttgcctcaaatttgcataccccccggcttggcttaaagaatgatattgaggtaaacgaacatttacctcaaagtactgttcagaggctaacacattacctcagaatttaatttgaactttgaagggaaccaacttgtatgagccttaggatgcacctctgttgtgttctttgttgtagtgacatttttcattattgttagatttttgagattgtgcacacagatatttcttgtccatatgaaaataagctgtttgtcgcaccacttgtaatttgttttgtgatcttgaagttttattatctactatcatcaggcttcagttttctttatcatggccattgactattttcatgcatttgacatggcatatcaacaacccaaatttgcttaacaggtgcgattctaatatgaaaacagattatttaaagtaggccaccatatgcggattaaagtttccagttttacatgtaattagttatcatgttcttttggaaaagaacatattatgctctagattttcttatcatgttatgtctttggttaccagactgtgcatcagaacaaataccaggaggacccacatgctaaagagtttggcattaaaattgaggaaaaacttgtatcaattaaatctcgcatcctacctgctccttgggtatgtcttaacagtcatttacatatgctgattgcgatgtctgttgcatgtgttatgctgtaggtctgacttttctttttctatcagcttaaattccatgacagtggcgagacgacagaattcttgccacaacttggcatatggaatatgatgcataaggtactgaggtgacatatattgtgcatttctccttccaaattatttgtttttcagaactgttgtgattatattttacagaagtttctatctttggcaatattgcatacagctgcaaattaattttatggtaatgctttgttgtagaaaatgatcaatggtgggagagtgaaaagctgggcatgtgttaacttttgctggagtgtacgggagtatgctgctaggaatttctgttatgaccttggctttatgtgccgagaatctgggatggtaggttctctatgacccaaaaggtgattccattttttttacctcacagttattcacaattttgacctttcatattccctatgtctcaatgtaggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtataccttttactttgtaacacatgtgggcagtttctttatgtaatacatgtgagcattgactgatcaattaatggtttttatttaatgtacttgtcatccacaggtgatgtcaaaagaatatgtgagacagatattggactgatctctcaatgttgtcttgcaaaacatgttcttaagatgaacaagtggtatcttgcagcgttgcccttaaaatcaatgctaaggtttgttgtgctgtactatttgcttgactggtcattcatcaggtccttatttattcctttggttgtgtacgtagatgggcggaagaaatactgtactggttgatgctttagaaatgagactcccccatgttagggatacaccaactattgtatttggtgctcatgtcacccatccacatccaggaaaagctaatagttcttccattgctgctgtaagtgcacatctcactatttaagacgccgttgcctggaggcaggagtcctgcttatctataacttttaagtgtatatgtgtgctatatgtagcaattgcatgttttatgcaggttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaagtacgaatgattgtgttaccttttagcatgtgaatactatacttgaaaggtctttgtagtctatgtacataagttttgtcttatatgcagagagcatctcatgtctttctatcgagccactaaacggaagcccggaaggattatattttacaggtattaatctatgtctggcgaattgcctcatcttttcattcttttcattttttagataagggagctttattgatcacaaacgattacaccgaggtgatagaatcatacagagaacactcctggccggactcatctcttctatgtctacatatttgacattattccacgactgctctcttcagggatggtgtgagcaaaggacagctccctcaggctttgatgcacgaacttggtgccatcaaaatggtgaagtttttatcccacattttctttctgaacatttttgtgatgagcactgcattctatttctttgaaatgataaatttgtgccataaaaacaggcgtgtgcatctatgggacccgattataatccattagttacatacgtggtgctccagaagtgtcgccatacacgtctgtttgctgactactataatgcgaatactcatgattcaactgcaaacatacgggctggttagttgccaatttttgtttgctgtactgcctatcttgtcaaacctaaaaccttcttcctaacccctgtgaatttgtccaacttcaggtactgtggttgattcaaatatttgccaaccaaatcagtttgatttctacttgtgtagccaccgcagcacgcaggttgagcttagttcttctttacccaaataattctttttctttttttttcatttgtaacacgctcctagctgattcaaaattttcccattagggaactaagcggcccaggtattatcatgttctgtgggacgagaacgacttcttggctggttctttccaagagctcacaaactacctctgctacacgtaagaatgccacttgttatgtgtttttacatttttgaaatcccttgaccggtttaacggacgagttgtcacctattattgcagctccgcaacttgcacccaatccatatcagttggtaagcacgagcccccacattctcctactatcatttactgtaggaaatgtgcttttcctctagcaaaagcatatatggttacgatatatattcacacctttttcttcttttgcactctgcagtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagcatgagtatgttacagattagtggtttcacatttaacattttgtgagtctattgatttgttatcttttttatgtagatgcgtcctgttgattagttttccttttcatggactcaaacaagcaaaaataaaaaatgggtttgccaaagaaacacaaaagttttcctttttaatataatgatgatgtgcagtacgcaggatgcccgttcgagaaaaaaaaaagtttccctttttatttgagggagaatgctgattagttttcctctttcccttcttaatattaatatataatgatgtgcagttctcatacgagaaaaaaaaagttatcccttttatttgagagaatgctccttctccttgtactaacattggggaataagttcactttgtgaccctcaaaagcgatcgaaatctaatccgtgaccctaaactacaaaaccggttatctcgacccaaactcttaaaactggtgcaatttgactctctcggtggttttggagagtggtttcgttgacgtgacgcctacgtggtgatgttgactcagtcttgggtacacgtggagttgacgtggcgcttatgtatactaaattgaaaaaatatatgcgggacccatttgtcattcacaccaaaataataatgtataactattgacatgtggggcccatatgtagtcctctttctttcttcctcttcctcctcccttcctatcccttctctctctctttctctctcctatttctcttcttcttcgtctgcaggcggcggcgggcgctcgagggtccgagtggccgcggcggcgagcgggaggggaggggaggcggcggtaggaggagacgccgatcaccgggtgatgcgccatcccggagtacgacgcccttgatctcctagtcctcggtcaccacgacgcgctccacctgcgctcgtcgggcggattcataccgccgccgcacgccaggtcgccgccgcttatcctcaaaagaatcctaccgtcattaatggcattcccagccttcttctttttgctttgacccagcaagcaagaaactcctccagcgtctagtcacctctaagttgcatgcaccagtcagtcagtcagttgcacctaaaagcctgcctaagctgatagggaaaggtggacaattcactttatacacttcaacactccccctcacgcgagaccccctcaagtctcaagtgtggaatattggagtgggctgcaattattttatttnnnnnnnnnnnnnnnnnnnnnnnnnnnnnnnnnnnnnnnnnntgataccatattaagttgcatgcaccagccagttgcacctaaaagcctaagctgatagggaaaggtgggcaattcactttatacactccaacaacctcaaccacgaacttgaatccgctgctctgctgctgctgcaactgttgcgcttttaagtgtgactacagtgtctgctactactactctgctttgccactacttggttcgcaggagggtggtgagagggagagtgtgaggagctgagagagggagagggattgggatggagttcttggtggctcaagcgctcctccttctcgtcgccgtctccaactccctcctactcccttccttgggtcttgttggtaaaggtggcacgtccgattcataccgccgccacacgctgcctcctaccgccgcacgccgctgctgccgccgagccgccgccgggtcgcctcctcccctcccgctagccgccgcggccgctcgggcccaccaccgcctgcatacgaagacgaagagaaatgagagagagagaaaaagagagagaagggtggaggaagaggaagaaggcaagagggcccatggccccacatgtcagtgggtcccacattttgtgtgaatgacaaatggtcccacacatatttttttaattctagtacacataggcaccacgttaactccatgtggaccgaagactgagtcaacatcgccacgtaggtgccacgtcagcaccaaaaccgctaagggagtcaaattgcaccggttttaagagttgaggggtcgagatatccggttttgtagtttagggtcacagattagatttcgatcacatttgagggtcacaaagtgaacttattcctaacattggagctcctagctagtcccttcttttttaatgtcaagaaatcttggcccatcttgtacagagcgacccagccaagtccagtggcacagcatcagatcaggaaatcttggcccatcttgtacattgcagctcagctcaagtagaggaacaaaagttaagaggaaggaataagttcaccggagatccctcaacttaacaacaagattttttaaggtcccttaaccacaaaactagaaatatgtacccctaaacttgtaccccttaacagtatatatgggtggtttcgctgacgtgacatcctagtcaacaaaaaataaataaataagtatgtggggcccacatgtcagctgcgcatatttcttttcttttcttttcttctcctcttctcttctcttttctctgttctctcttctcttctttagtgaggaggccggcaggtaattgtctgagtcagccaagtcgtgcagcaacttgtggacgagctactcgaaaggagggatgtagtctcgagctgctcaaaaggaatgatgtagtgtcatggtagcgggtcgagaggtcagttagtgttccaagaggttgaggccctagtg

SEQ ID NO: 58429 - DNA, 29864 bp, Oryza sativa
ctacctcttgtgatgatcttgtggatatgcctagctctagctctagctcttgtgtttctatttgtgatgtctcacttgttgttgagaacaatgagcttaaggagcaagtggccaagctcaacaagagtttggagaggtgtttcaagggtaagaacactcttgacaagattttgagtgagcaacggtgcatccttaacaaggagggacttggattcattccaaagaagggtaagaaaccttctcaccgtgcactcattttgtcaagagcaatggtaagtattgcttcaagtgtcgtgaggttgggcatttggtgaatgattgccccggtggtaagccttctaagacatgcatgtttgattctcattatatgcttaggaaggctcatgattgtagtattgttgctagatatgtgggttccactatacttagtggtaaaaagaatgccatttgggtgcctaaagctttggtctctaacctccaaggacgcaaacaagtttgggtacctaaaagagcttgatcttcttttgtaggtgaactaccacaccgatgggagccattgggtgcttgatagtggatgcactcaacacatgaccggtaatagggctatgttcaccacatttgaagtaggagggaaagaacaagagaaagtgacatttggaggcaatagcaaaggaaaggtaattgggttaggtaaaattgctatctccaatgatttgtcaatcgacaatgtctctcttgttaaatctctaaatttcaatttgctttcagttgctcaaatttgtgatcttggcttgtcatgtgctttcttcccgtaagaggttattgtttctagccttcttcacaagtcttgtgtgttcaaaggttttagatatgggaatctttatttggttgatttcaattctagtgaagcaaatttgaaaacttgtttagttgcaaaaacttcattgggttggctttggcatatgaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatatggatttgtttggcccaacaacctataagagcattggtggtaatagtcattgtcttgtgattattgatgattattctcgccatacttgggtgttctttttgcatgataagtctattgttggcgagcttttcaaaaaatttgcaaaaagggcctaaaatgaatttagttgcactcttgtgaaaattagaagtgacaatggttccgagtttaagaataccaatatcgaggactattgtgatgatcttggtattaagcacgagctttccgctacctacttacctcaacaaaatggtgtagtggagaggaaaaatcgtacattgattgagatggcaatgactatgcttgatgaatatggtgtttccgattccttttgggcggaagccataaacaccgcttgctatgcaactaataggctttatttgcatcgtctcttgaaaaagacttcctatgtgctaattgttgggaggaagccaaatgttgcctattttcgagtttttggttgcaagtgttatatttaccgaaagggtgttagactaaccaaatttgaaagtcggtgttgtgatgaagggtttcttctaggttatgcctcaaatagcaaggcataccaggtctacaacaagaacaaaggtattgtggaagaaaccgccgatgttcaatttgatgagactaatggctcccaagaggggcacgagaatttggatgatgtagatgatgaaggcttgatgagagatatgaagaacatgtctattggggatgtcaagcctattgaagtggaagacaagccatccacctctactcaagatgagccatctacttccgcttcgccaagtcaagcttaaattgaagtggaggaggagaaggcacaagatccacctatgccaccaaggatacacaccgctctttccaaggatcacccaattgaccaagtgttgggtgatattagtaagggtgttcaaactcgatctcgtgtcgcttcgatttgtgaacactactcgtttgtttcttgtcttgagccaaaacatgtagatgaagctctttgtgatccggattggatgaatgctatgcatgaatagctcaacaactttgcaagaaacaaggtgtggactttgattgaaagacctagagaccacaatgccatagggacaaagtgggtctttaggaacaatcaagatgagaacagattggtggtgagaaacaaggcaagattggtgacgcaaggtttcacacaagttgaaggtttggactttggtgaaacttttgcccccgtggcaagactagaggctattcgcatccttcttggatttgcatcatgctttgatataaaactatttcaaatggatgtgaaaagtgcttttctaaatggtgaaattgccgaacttgtctttgttgaacaacctcccggttttgaagatcctaaaaattctaaccatgtttgtaaactctcaaaaggtctttatggtttaaaacaagctcctagggcttggtatgaaagattgagagattttcttttgtcaaaggatttcaaaattggaaaagttgacaccaccctttttacaaagatcattggtgatgatttctttgtgtgtcaaatttatgttgatgatatcatattcggttctactaatgaggtattttgcaaggaatttggtgatatgatgtctagggaatttgagatgtccatgattggagagttgagcttcttccttagacttcaaatcaagcaactcaaggatgggacgttcttgagccaaacaaagtacatcaaggatctactcaagaggtttggcttggaggatgcaaagcccatcaagacacctatggtaaccaatgggcatctcgaccttgatgagggaggtaaaccggtagatttaaagctttatcattctatgattggtagcttgctttaccttaccgcatctaggccggatatcatgtttagtgtttgcatgtgtgcacggtttcaagtcgctcctaaggagtgtcacttagtggccgtgaaaaggattctaagatatttaaagcattcctcaattattggcttgtggtacccaaaaggtgctaagtttaagctagttggctattccgattcggattatgccggttgcaaagtggatagaaagagcacatccggtagttgccaaatgcttggtagatcccttgtatcatggtcatccaagaaacaaaactccgtagccctctctactgccgaagcggaatatgtttcagcgggtagttgttgtgcccaattgctttggatgaaacaaatcttgttggactatggcatatccttcaccaaaaccccactcctatgtgacaatgatagtgccataaagatagccaataacccggtccaacattctagaaccaagcatattgacattcgccatcacttcctaagagaccatgttgtcaagagtgacatagtcattagccacataagaaccgaggatcaactagccgatatctttaccaagcctcttgatgaaacccgcttttgcaaattgaggaatgagttaaatgtcatagatttctctaatgtggcttgagacggtgcaccatggttgcttcttttgcatattgtatatttactctcatttgcttttatgctttggacttattgccatttggttcttcattgagaaaatggagcatgtcacattaagggggagttttgcactcttgcatgtgctctacccctctttgtctgtgagcaaatcaactagtggtgctagtagtattttcaaaacgcccaagtcaacataagtcaaaacttttgcaaaatcaatgtaatttgaaaatgtttcaaaaggtttcctatatgttttccaagccttacgttgcaagaaaaatgatttttgaatgaaaatgccattttggccctcttttgaagaaactagattcttagttttggccaaaatgagatttatccccaaaataagattgagaaggaatttgagaaaagtttcaaaacaaagttggtagagaagaatatttgaaatgtttttggtattcaaacctatttcaaaaaccaaatatttcaaaagttgtttgaaaatcaaattcgcccaaaaacccctatagaccataaaaggtcacctcctagcactcaagtgagttttgttgcaaatcttcataattttcaaatgttatgaatggttggcaatatttcaactcacacatttcaaaattgctccaaaaattgctccaaaaatctcgtctgaccggcctggtggaggcggtctgaccggcctctagggcccggtctgaccggccgcatatagccggtctgaccggcctgggatggtgggcccaggactttgtcctttcttcctctttcttctcctacccgacccctcctcatctgtcgggtcccaaaactaatgattcagaaaccaacatgtttagactgtatcaagccctggatcagtagattgatacaggttcaacaatctggatcttcattgcatacatttgatcaaggttttaaaggagattcctttacataaaataatagggtatttacaaacttttggctaactattacagcagaagctatacgatgacacaactctagtgttttgctatagacttaaaccatctatctaatctatacttgagaattaagttaggatgagactaacttatatgattgaactcccggcttcggcaagactccaaattaactctgaaaaaggtggggttgaagtaagggtgagtacaacatactcagcaagctattatattcaataataaatgtatgaaatggtaatatttgagtagagctaggtttaattgcagaaagctgagaataaagaagtagaaatcctgaaatatttgatatgcaacagtatttaataaagtttgaaattatgtttctaaccaagatgccattgtgagtcccaatgcttgataaccgtgagcacggctatttgaatagttttaataatattcatactgcagtagatgtacgctttacccgcaatccatgacatgccaaacacattagctttgtcatggcaaagcttttcggttactaacatcagtggtacctgttccatgaactctagtccccatgcgctctgaacgtaatgttatcagcagcgtaaggagttttggcgttcccgaggtttttagagagaactagttgagagaccccgtcatctcaatcaggttttcataattcacacacacagctcacgagataatcaagatatttacctgcgcctcggtacatatcacaatcgccctgcttggcgtaagtttgcctcctgcgcgaggacttaagaagaaccactatacagaggtaccacctttgctagataacttaatcagctaggtctatgcccatacgagaattgtggtcgtactcgtatgttcttcacatgtacttggcaatcttatgtcggttggaacagtagtagccacccggaaatcaaccatttctaccgtactgtcccaatctaagttcattatgttttatgcagtctaactaggcagggctaagcaaaagctagcatatctagtttgctatgttcaggttatgcatttgaaatcatgtgtgactaatgcatagaatagagatatagaatatagggtatttatgctcaaaggagaggaataataacttgccttgctccaacgcagataaaaatccgatataggcaacctgattatctgatccttgaaacaccacaggttgccatccaaaatataatagactctactatagaagaggaagatccaaattcaataaaagccatagaataacaagaaaacgacaaacggttaagaggctagggtttagggtagggtataaggattattaggctaatattttatatgcaggttctaaagagttggtggctggggtggaaagggaattaagaggctaaggtcacctatgttttatgtgcagactctgattggttggtggatagggagtacagtggataattgaattggttgagcagatatgtgactggtattggctgataataggtttgggtaggattatacttagggtttggttatatttaggccgattgaggagtagggaaatatatcggccaggctctatattttatgtataggttctgggtagatggagagtaggtggctaagatatggcggataagtaatattgtagtggatgtgggatttggatggtaggctgattaaggtttcagttgtctaagccgatatcgaggtacgataaatatcggctagggtttgggtgttcgcaagtcgtcgctaaagcatgacgactaggtttggtgtcttctctagccggtgtcaatagacaatataacagccagagggatgggaggtttgtacaggtttagcgaggcagaagtgttactttgacaaccgtgagtggcggcggagcggctaggatcacacagggcccgagagctaactgtgcggcgtgctatggaggtcaaggaaatagtgaagctccgaccactgtacgcatcgaggcgtggggtgccaggagcagcacttcgaccttgggtttggttttgccgggctttacaaccaatggttcgacgtcggggccaatagaccgcaaacgtccccatggaaggtgtaaagttccaaccgacggctttttagtggctaaagggtattttgggataaaagaaaatatttaaaaaggcaaatataaattcaaataaaatagcaaattgggaaatgaagcatttgaatttatatgaatttaggtccaggtttcactgagatcggatctacggtttaagagatatgagcttctaaagaataggatttgaattaaatctagaaaatatgaaaggttactattcatgggcctacctgtcagtgtctattcccttttctcttctttctcttcttcttctcgtcttgttcttcctcctgcttcacagagagccgagagaagggagaagagagggagaaaggggcgctggtgctccggtggtcgagaggctgcgacgtcggcggcaaaacatgttcctgagcgacgcgcatccagggagggtggtagctagctaaggtggagagtgagatggccggaacggcgacggcaggagctcaaccatggccggcatggatggtggcggtgatggcttgtggtggtggctaaaggagaagggaaaggagaaaaacggattcatctcgccgaggcaaagccgatggcgcgagggtttgggttgtgaaactatggtgaaggagatcggccgacggtaggcggcggccggacatggcaggagagagaggaagagctcgaggctctgatgatgtgtgggggagaaagggacggctcgcaggtatttataggcggcagaggtcggttgctcaagtcggttcgcagaggaggagaaggaggacatggcgacggcggcgtggaaaagacgatcacggcgtcggccttgtctgttgattggtcgatgatggcggttcgctccaggagctaacgtcggcggtgtgaggtggcggatgacgtcggcaacggttgcttggtgtcgaaggcaagctggcgccggcggtggaggagggcaaggcacggcagcggcggaggaggagagagcgacgacaccgatttcttagcggcgacggaaggtgttggcggcggcgtgcgcacctggaagaggaggagagaggcggttgcctcctgggctagctgggccactagagagaggagggccgaaagagagaaaagaagatctcggcccataaagaattatttgtgaatttctaatggaataggatttgtatttggagggaatttgaatagggaattttgaaaggaaattatatttggatataatttccaaaagggatattttctagtttgagtgcaatatttttggaagtggaatatgggcaaatttatattgatgcactcaattgtggggagagggatatatgaataaaagttgaatatataattgggaatgtggaaagaaaaataggtggaggaaaaagaatagaatttgaaccctaatatatatggcatgggtttcaaggaattgcttgaggctaaaaggaaatttaggtgacaaggatataatttattttcttagcacaagagcaattattcacaatatttgtaataatattattcttgtgccgagaaggaaatcaagccacaagaattaaattagcggctagatcaaaaggaagaattttgaaaaaggggactaaggataggtttggaatcaaaggatagatttaagatcaaaggatgggtcgacaattaattccaataaaattggaattgtttggtttaggttctaggacaatggtggagaatttcttggaccataattcataaaaatagaaaggggttttcaaactaaatttgaatgaaagaattttagtcaaaagaaggttttaaaccaaatcaagaaatacctcaatttaaccaaatatatatttttaaatgaaaaacacaaaagagattaaatactgcataaggattctgtgcaagttagttttaggaggtccctctaattatattgtcctaagtttaagaagttattaaaaacataagaatcggcatgatgcaggattggaaaatggcacattttcaggatgttacatcatcccatctcatctcttcacttctccaactcaaaatttcttctcctctctcctctcccaaaccctaaccacctccctacaccaaatccatccggttcaaccgtcaaaatcactccggttacaccgtaagtgattctcctccgcttcctctctctattccatggattgatttgtgttttgattgagtttttgatccatggcatggaaccctaggtgaaggaagaggtgttcttcgatttacaccaatagagggtagtttcttggtgtgattcaactccttcaaccggtaaatcactctccctcttgtgcattgttctcaaatcggtctatttcaatctctagggttaagggtagttttccccctttgttccaatcttaatgaaatagacctacaccttgatatccatgctcaaatcatgtacaatcttgttgtagcaaatatttttagagtcatttgtatgtgatggtgaaagggatttacttttgcacttgtcagaggtggtctgaccgggtaccagccgccggtttgaccgcgctcggccgtcggtctgaccgacatatggacggcggtctgaccggttgttggccctcggtctgaccggccgttttccaccggtctgaccggccgctggacttcggtctaaccgtccctgacatgcagtgtgcagtttccttttcgcctaacatagtgtcttctaaaaattgttgcttatttatctttttttatccttgtttctcagctatgcctccccgcactcgccgtggtcgtcgtgagcccacgcttgatcccgtcagtgagaatgaggaatcaaacggagatgagtatgttcaaagtgatgatgaagttatggaaaatattgagggggatgaggtggaagtaagtggttatgacaatggtagtgatggtggtgatgataatggcagtggcgatggtgaggatgatgaggcaagtgatgatgggagtcctctcgatcccaccatccaatttgtgctcaatttgaggaatgcctagcaatacactatcctccgtcatcacgatcaattccggaggcctaatgattgcaatgatctgagattccatacacggtatcaaaagtccgtgtatgagcaagtatatgcaaacaaagccttcgccgaacacaagtggatttcttggaggcacattggtgagacaccggagtttttaggtttgcaagagatgttcaagcccgttggcattgataagattgtcaccatgaagcaacgttttgatgaagacctcatccggcaattctatgccaccgtgtaggtgtccggcgattgtgatgccatgaagtggatgtcggggacccttcgatgctctatcaactgccgtgcattcaaggagctcttgcacattcacttcaacaacagggatgacctccatgatgagcaaaaccacaaccccttccccattgatcacttttctcagttttatgaagaagggaggaggcacacctatggaaaggtggtgagtttgagggctatcccaagtctgatcaaccgcatagtgagggccaccattctcccaagatgtggcaacaatgatgacatttgcggcgttgcatggcatgtcattgaagccatcatggatggtcgtcggtttggtgtcatcaaccttatgatgaaggagatagccatttccaaggggactattggacaaggagtttactatgccccctacataatgagattgattcaaagcaagttgagacaaattggtaacaacttaaaagaacacaaagactacaagcctcatctccaactctccactcctagagctcctcgtgtgcgccaaccaacatttgatcaaggtgcaagctcaagtgcagcccccctcctcctcatgggtatgatccaagtgccttcttccatccacaatatgcatactttggaatgcaacccaacgaatacttcaatccggtgcttggggctattaataccctaagtgaaagcattcaacgcttatccaccgggcattaagcattgcatgaggatgttcatggcttacgcaccgatgttggagatttgaatgcttccgtgggaagattgcacactagggtgggtgtattggattcttgagtccaaatgttggagagcacccaagcttttgtatatcatcgccgccgtgatgctcctcatccttcatctttggcacgtcctccttctcctccacaagaatgaagacctttttggtactttatgccaaaagggggagaaaaatatccttaggtgtgctttatgtcttgtgggttgggactagtggtagtgaggttagttacatcatatctaataggttaaggtggtttgggctatattatgtatgggtatgggctattactctatattgtgtgttctttatcattttgttgaactctatgtcatttggacccttcgtggttttgtaatagcctatgtttatttgtgagcccttttaggatgatttgtgacttatgtgttttgaatggttaagtgatgtgaacttgtgcgatgatggatggtgtatgtgatattgatatatatgtgaccatcttatgctcatggatgaatatttcttgaagttcacattgagatattgctcttgtgtttgtgatttgttgaaatgtgcattggctccatatttgctatttgtgattgttatgcacatgtttagggggagcttttgcttttcattgcaatatatccatgtgatttaaatttgattatatatatttgtggtgtttgtcatcaattaccaaaaagggggagattgaagcatctaggcccccggtgttaattttggtaattaatgacaagcactaattgtggactaaccgttcttttgagctatatttttaagttaggttcacattatgtgtgcgtatgggtgtctacctatggattaaaattgacggcacaaagctaaaggaagagaagacggtaaactaatgttttcattttaaattgatcgaggcgttgggcgatcaaattgtgctagtttatttatagctttgccgtactattaagaggggtaatgacctagcaaagagatgattttaaattgccacattaggtgatttgcatttagacttgtgctcacatttcatcacacacagacaaacactttgcctctcactgtcgggcctgactaggggcggtcagaccggccacatagtggcggtctgaccggcggccctcgcccgtctgaccggccagagagcagcggtctgaccggccaggcagtggcggtctgaccggcgggtgtcggccggtttaatcggccggccatatggccgggatgttgtctcggtgtgccgatcccgaggcgccggagccgtattcggtcagaccaagctggtggcggtctgaccgagctgaggccggtctaaccggtcaccccatgtcggtttgaccggccggggcagtggggcccaatgacagccctacaacggctagaaaactagctgttatagagtagcacggtctgaccggccacatacctccggtcagaccggcagagcacagagttaggggatttcgcccccaaaggctatttttggttggtgggagtataaatactccccctccagcagcaagaggactctcttggcacccaattcaattgcatacaccccttgcacctctctcacacacctttgagcttagtgttcgtctattgtagtgattgaggttgtttgtcacatcctgatttttgtttcaggatttataaattatttaataaattaataatagaatttatattaaatgttctttaatttacaagtgaagttaaatgtgggaaataaaatttcctaaatctaaggcatggatggatttaatttttattaaattctccatgattaagtatactctctgaaattttctcggatttttctaagctcaattcctaaatgatacaaagaacagttcagtaattatttgatcaataatgatctaattatatttgttaagagcttttcttgtttaaaaaatccttaaattataaattgttgttaaaaggaattattagaaatgattttaaaagtctaaaagagaagatctaatttttaatttgttaaatctcaatataaaattgggctagataaaatttcattaaatactttgcttaattctataattcctagatttttctgggatttatttgagctaaggaaatatttttaataaatagaattgcatttcatgaataatttaaatagaaaaatgtctttaaatcctccttttggctttgggccgaaagtcggcccaaaacctctctttctctctcccttcccggcccagtcggccaagtcggcccagtccgccgagccgccgctctcctctctctctcagccgctgacaggtgggtcccacttgtcggggtcgtcgtcctcctcgcgccgccgccgtccgaaaccctagcgcaagccgccgccgtctccttccaaattcggccgcgtctttccttctccggtgaaatctttagaggggaaatgatcttctcgatctcctcttccttttctcttttggaatcatcgcctaattaggtttggaaactcgtggattcgagttcgattcggatcggcctctttcctccgaaccccgacctttccttctcgccgccggcagccatgggccttcgccgccgcctccttgcccctttaaaaggacccccgagctctcctctactcgtcacctccctcgcctttgcccaccgccgtctgtagcgccctagccccgtgagcttttgcgccgccgtcgccgccgttcgtccagccgtgcgccgccgtcgctacggtcgtcgtcgtcactcgggaaggccatcgtcgggatcgccaagtcatcgccgtcctcgtccgccccttcgccgccgccgaagaccgccggagcaccgtcgccgtcgtcgacccgatctccgccgccgcttcttcctcatcgccggcgctgtccgttgttcctccgccgcttctttggtcaccggtgagttcgccgcgtcgccctctacccgttggtgtcctccgtttgcgtcctcgtgccgtcgttcgccggcgagcttgcgctcccgagccgccgccggtgctgacgtcatagctgccgtcatcgctgacgtcatcgtcgtcgttctccgtgagccgcggtggatccgtttgatcccggccgtccgttttggataggttcgatctcggccgtccgttcccgtgaaccgttgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaaggtggttcaagttgcaaaagttgtataaaataaagatctacatattaaaattttccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataatttgactagttgagctttatatattggttcagctagatattagatatgattgcttagccatgcttagaaacattagcacattattgggataacttatgactcattattattttatgatggtttaatgatagttcacgatggtcaatcgtgattggttaattaattacttgtcaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgcatagcatgattcattgcggagcaccagactgagaagtggcggagataagcccacgggggtcgctgtggagtccatgccttgtttataagggggtgattatgatccagggaaggtgcgctgcagtggattgtgttatgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattattgatgttataactggtaataatttgcttagctcctggtttggagattagatctgtacagccgggtatggttgtttaggatggtcgggcctgtgcagcatgggtgtgctgttcagtgttgattaaaatttctgattaactactctactgttttatttctcttaaatattttgctaaacgctgcttttgcaaatgagcctatattatgccatccttttgcaaatgagcctatattatgccatcctttggtatccttgtgcacttgcatatttgctatgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcgactgattcctggacgaggattttatgcacaaataagttcggaaattactagtgaatttccgggcgtgacattgttctagccaagagtcaagtgcattgcttccatttgtagagctagtgtggcacttgatcatctccacgccgggtcatcgcttgttactcttggaggttgccgcctcctagacggcttgtgaaggagttgcccggtgacctcttgtcgcacccggaaaaatacattttccagaacgctagtgtattaatccccgtcccaggaaaagccggggtacaccacacaaacaggatacaaaaggcacatctttattatatcgataatatttacattattacaaagtcacttcagccctgacaaacaaaaataaacagcagcgaactagcgggcctacggctccatcttcacaggcgctaaactggggtataagtcaggactccacctaggacttcttctccaaagcttcttttactgaaggggggaaagattgagcaagaatgagtacaaccacagtactcagcaagtcacaccgggagatgcatgattaatgtaaaggggtacaaggagtaataataatagagttaggttttgcagtaaagagcattaaaaaaacacttagttgctcaaagctattttgtaaacacgatcctagagctacacaatattattaatcaaggctgtgaaccctcacaaaacctaccttaacccaaggcctacgatgattcggagcgaactggcaacctgacttgggtcccagctcgtcccaagccaacccaggccaacaattccatattttagttgttaagcaaattttaagaattaaaccactaacttgggtacattactaggcttgcccatatccgagggcacggttattcgaatagattatactctgattagagatgtacatctttacccacaagacacgcctttactctgcattccattgcaattgaaacccatcataaaaaacgtgacataaccctttacccatcctagccgtgaacaaaagtaccgacccaaccctgcctacggccagtatcccggacaggcaggccaggattgagcccctagcaacatgatctagaccgggtgcgccacacatgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagtgaagctccggctccactcccacaggcagctcaactggggtataagccaaacgtcttctccttctggatcctttttcttcaactgaggatgattgattattgcaaggtgagcatatgacatactcagcaagccacacagcaaatatgcaagtgcacaaggataccaaaggatggcataatataggctcatttgtaaaagcagcatttagcaaaacatttaagagaagtaaaacagtggagtaattaattagaaattttaatcaacactgaacagcacacccatgctgcataggcccaaccatcctgaacaaccatacccggctgtacagatctaactccaaaccaggagctaagcaaattattaccaggtataacatctataattattgtgagaggcgtgagactaatcacgaaaaacattgctcaacccgcccataaccgcgggcacggctatttgaatagttttactctggccagaggtgtaccactgtacccacaagacacagcctcaacatcatgtctaccatgcgttgcgatactggaaagtacccgaatagaggctgtgacaataccctctacacaacacaactcaccacagtgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccgatccttaattgtcatgagcacgactctcaaaaccatgtgctcacaacccaccattatcaagttttagttggcaagtaattaattaactaatcacgattgaccatcgtgaactatctttaaaccatcattaagtaataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacacttctgacgcacttgcgaaccttcgaaacgatgggaacgacaagctaacacgcaaaacgaggaaaaaggctaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatcgataattttaatatgtagatctttattttataaaacttttgcaacttgaaccacattaaactgagttacaaagaattagttatgaattttcaaagattaaatcggattaaagcatttatatggattttaattgaattatgacgcaataatgaattatttttgaaaaggaaaaggagggattattgcgtcagcgggtcgggttcacggtggaccgggtgcacaggaacggtctacggaacggacggtctagatcaaccctatccacaacgaacggccacgatcgatccagaccacggcggtccaagagacacagcgacgatgacgtcggcgatgacgtcatcaccggcggcggctcgggcggcgcatgctcgccggcgaacgacggcgcgactacgcaaacggaggacaccaatgggtagagggcgacgcggcgaactcaccgagctcttggacgacgacaaacgacgatggatgacgacggcggcgaggttgaagcggcggcggtcttcgggtcgacggtgacggcggtgctccggcgtgctacagcggcggcgaaacggtggatggggacggcgacgacctcgcgatcccgatggtggcgacggcgaccgacgacggaggctgcaacggcggcgcggcgcggctgaaccgacggcaacgacggcgacggctagggctacgcggaggcggcgctagacgcgacggcgggctaaggcaaaggtggcggcggatagaggagagctcggggatgcttttataggggctagcgagcggcgacggaggcccacggcgaccggccgcgagatgaaaagctagggttggaggagagagaagtcgatccgaatcgagctcaaattcgtcgatttccaaacgaaattgaccgaagtttctataagagaaaaggaagaggagatcgaggagattatttcccctcgaacgatttcactggaaacggaaaggatcgaccggattggaaagcggcggcggctagggtttcggccggcagcggcgcggggaggaagacgggcctgacaggtgggtcccgcctgtcagcggctgagagagaggagggaggggcgcggcggactgggccgactgggccggggagggagagagaaagagagaggttttgggccggctttcggcccaaagccaaaagagacttttaaaaacctttttcaatttaaattattcatgaaatgcaattccatttattaaaaatactttcttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttaaggatttttaaacaagaaaagctcttaacaattataattagatcattaattgattaactaattactgaactgttctttgtatcatttaggaattgagctccgaaaaatccgagaaaatttcagagagtgtaattaatcatggagaatttaataaaaattaaatccatccatgctttaaatttaggaaattttatttcccacatttaacttcacttgaaaattaaagaacatttaatataaattctaataataatttattaaataatttataaatcctgaaacaaaaatcaggatgtgacaacacacataggggtgagaccacccacgtactagtcccgtgccatgacatctcgactaacggacaccggcccgtgtagccttaatttgcctagacatctcgattaccgagccgcagctcgcgtagccttcatttgcctcagagatatccatcatcgcaacgacttcatccatctctatctgtatccttttgttcaggactagactgagcaccgagttaagccttacccattagacatgtggttagtacggtagtgctttgcaacagaggcctgagcttaatccttttattggccggggtgttacttcccacaactggcatgcacccaaaccccaccggaaaacaggttttaggggttttgaaagaggaagagaggggtatgtccaattccaccataagccaaccattccatagtgtccaagtgatatgagaattcccaaagtctaaaattataaaaccacctaatattgcctaattaatcaacgaagcatctacctaaattcatactagtggaaccatgaatggagtgcccactagttagggttttgttttcctagggtaagcaaggtgataataacaattgcaatgataaggctataacaaggattaataggtagtgcaaaataaaacagtgataacgcgggaatttaaataaagcagtaatgcaataattcaaatcaaaataattttataaattgggattcaatatgctcaaggatgatgcgacttgccttgctcagagaacagccttccgaaccttcggcgacgaccacgaaccacgcttcgggaacctccgcaacgacgaaagctacgcgaagcacacaagcaaagctacaaacctataaagaagcaataacaatacataaaaaacaaagcacatggttctttaggttataacaaacattaggagacttgaacggatcgattgggagttcgtatgaccaagatatgatcatccgaagattaatgttgttacatggagatttacggattattgtaattaggttttgcaactataaaacatttgtaagcgctagcctggaaaagacaggaaggttgcgctgttgacatgcggaccccacatgtcaacctaaagggccacggtagaccgagtacacagagacggtccacgggtcgacaaaagcggaccccgtgtgtcaactgaggcaagtggccgacaaacggactccactagacaccacgcgggctgcacacatggaaaccacacggcaaccgagcaggcacactaacacggtcaccacacgcacacacgaacaactaccgacacctgtacataggtaccggggtcgacaaccgcacaacgggcacggacaacaccgaaaggacgaggacaggggcagcgaaaggacggacccttaccaccactcaacgaggcgtgggaacgacgacggcgaacgggcgcggcggagacggctcggggacgacggaggcgaacggcgagggaacgacttcggcggcgatccttggacggaggcgagacacggccggcgcagggcttgacgacgcggagccgaggacgaagacgacaacggggctgcagcagctcacttgacggacgcggacgagaacgacttgacggaggacggacgccacgacgagcgcaaccaggaacgacgagaggacgacgacgaccgcggcgaacgccggtggggaggcgaggacgacgtggaacacgccgctgtgatgccgacgacagaggcggcgccgcgagacgacgagctgacgaggaggaacggccgaccggaggagacgtcgacgaggacaaacgatgacgacgacgaagatcggcggggttcgggaggaggggaggcgaggccgaggatgaccttgccgctgcgatgccgaaggtgatggtgacgacgtcggccggcgcaccgacgaggaacagaagccgaccagaggatgggaggtactacccgccggcgtggacacaactccagcgagcttcgggcgaggagatggtgaggccggggaggaggacgatgctgcggagctgagggaggcgacgacacagccgaccgatgcttaggcgcggcagcagaggcggctggaggcggtgcagtggcagcaacgccactggacgtcgacgaggacgcactatcggcggtcaccgcgcgaaacggagggcaggccgggggagaggaggcggccgcgacgctgaggatggcgacggcacggcctaccggtgcacgggcgaggagggggaggcggctggatctggccagcggcacgggagagagaggagggcggcggagagaggcggtgcggctacggggagacgcgagaggaggctaaaacgagagaacggaggaaggggattccattttataggcgcggggagggagccggccacgggaggagcgggcaacggcggcggaaaactcggccggcggccatggaaagcggccggggaaggcgcggccgttccgggaggttgagagcacgaatcaaggggaaaaataagggggaaataaagaggaaggaaaggggattaaaagcccccaatcaattttggaatcccatgcttgaatcgtgcggatttgagggaggaagaagctagggttttcacgggagagagaagagccgagcgggaggaaggagacgcgcctggtaggcgggtcccactcgggaggcgcgcagtcaacgcttgtgcggcgcgcgtgagggcgtgggcgagcgtggctcggcttgggccaggaggcgccccgggtggaagggggcggggaggcttgggccaaggcaggccgggaggaaggaggaggagggagttggccggctgggaaggagggaagaaagaaaaagatagggagggaagagagacttcggccgcaggccgagggagagagagagaggaagactttggcttagactcagcccaaagaaggaagggggatttatttttagtttttctttttagtaaactttgttaattgttgttgttgcttaataaataattccgttgctctgaaaattcaagtaaaatttgagagctccttttagaccaaagagaatttaacaaaaattctccaggccacattcgaatttttctagtacgtattttagtgtttgccaatttcttttcaaattttaattaattctattattccttttagagaatgatttttattttgggatgaatttatcaggacgtgacacctctccgagaagattgtggaggaggcccattgccggttttgtgagtggtttggagttcaccaccttcggagtgaaggaagaactactctagtgatcgaggcttgggtagtcctctccgtgggccggctcccgccttgcccaccccttgacgaagggggcatgcggtggtttcgtggttgagcggtggagttgggctcgcctcaacgggagtaggaaactggcgagtttccgaacctcggtgaaaaatctcttgtctccttgtctcatttacttgttgtatttatatttgtgcaatttacatttctagagacatactagagatcatttcaccctaggattgctaaactagacttaggaagtgtgatttactttcctagtgatatacttgagccactttcaccctaggattgcaaaacataaattagttgcttagttagtcttgtccctcaccgagcctagcaacttaggttagttttgattaggtgtcatttaattttaaatcacatattcacccccctctagtcgacttctcgatcctacagtgagcatcagggagactaaatcggggatccctacctggcgcgtgcgcgcccctggtgctagtttttggtagttagactaattctatttatcttagtctcttagataattacagtttgagataatgatggtagtagttagtattttttcgtgagatttttattaactaacaaattaaaaagaaatctatatctgaagtcaaaatttcaaaaatttgaaaactttcaacttgaaatttgaatttttcaagtcaaaatttgaaaactttcaacttttcatcttaaacttgaaaaactttcaacctagatttgaaaactttcaactcaaatttgaaaacttttcaactcgagatctgaaaacattcaactcaagatttgaaaactttcaacccacttttgaaaactttcaactcgagatttaaaaactttcaactcagatttgataaattttcaactcgagatttgaaaactttcaagtcgagatttgaaaactttcaaatcagatttaaaaaattttaactcgagttttaaaatatttcaactcaaaacattttgaaaaaaatatgtgggctaaagattagaaaacgtaataaaaaaaactggaaaaaaagcaaaaaaaaaacgccaaaaaaacgaaaaaggaaggcgtggcgtggggaggggccgcacgcgcacgcgcgaactagctctggtggattaaatccagtcctatgtagatggaggtgaccatattttgcaaggatcaataatgggggcggtggtgcgagggagcaggggtggaggcctagcgtgggggccttcaacataggggactggcttgacacatgcaccctcgcctctcgagtctcgtacctcatcatgccttgtctcgagagatgggaggggtatgtggaaaaggaggtggataaatataaagagaggcaatagtaaggaagagaaatgagaagggtgtaaaataaaatagagattggataggtcggtggctgacatgtagggtttgcactatagttgtgatttgttaaatgattcaattcttgggctcaaatagaaaaaccaatgaccgaccccaagactcactgtaagcacctaaggccggtcacagtataatggtgtggcgtgtggactcgtgcgacacatcggagccttgccgtgtcgttatggcccatctccttattttgttgcttggctcttcagtaggaaacggcttccccacctgatctacaggcaacacaacgagggacatacctccgcgcccgcgttggtgaggtcatcttctcgctgcgtcgtcccctcgtgtgtttagctcactaattaaggctgaacctggcccatttgagttcatttgagaggtcacatgcactgtgggagctgtggacaaacgcttccctaagcctgtttggcatatatatagatgcatggcctgcaccgtgattggcatatataatagaatgaaacatctcgaccttcgctcaaggagttacaaccaattattacagaattcacataaaagaaaactcacacataaagttcacaatggcagaaacaaaactaaaagcaagcacaaactaatagacaccaacacaagataaatatcccataactactaaattctactagagaacctccacccgaaattggcaaatagttgcgtaatcgtcatctcaagtttatgacatgcatcatttattagcttgatatcttcattatgcctttgtaattgagcctatccccgaagccaatatgttcccctgaaaagcatctgcaaataggattttgatggtgatttatgaaaaaccatatcatttctactaagataaagagctcaacatacaggggaagctccgacaagaataagttttttgatttatttttattaacacctaaaagccaattctcaaacatatgagatatcctatacggataataaagtccaaaagagaattgtatagatctccaaagaaatttagaaaaatggtactcaaggaatagatggtaaattgattcattcttcatacaaaagcaacatctcaaactaccattccaattcctcctagcaagattatcttttgttaaaacaacccttttaaggagataccacataagtatcttaatcttaagaggcattttaagtttccaaatgatcttattcctctctatgtatccattattaattaaagttaaatacatagatcaaacagaaaattggtcattttgatgaaaattccatctaaaaatgtcatccttgtctgttaagttaacatgtacaatggaagcacacaaattatgccatataactagattctgaacagctactctactaaaagaaacattaagcggaacaaaacccataacactagcaattgaggcatttttccttctaattatgaaaacaacgacggatatttgtccttcaaagaataattccctaaccacttaattatccttctagaatcttactttgttcaccattattaataattcaggaacccatatttaaaaaggaattcttaaccttcatcagacctgaccaaaaatgggaatccccttgtttcctctcaacctgagttattgatttatcactaagatattttcttttcaataaatcttgctacacaccttgctcatttattaatttaaacaaccatatgcttaaaagacattggttttgaatttctaaactgtgaactccaagtccaccctaatcttttggctggcatataatgtcccatcttgtcaatctatacttttttttcaatgttcatcccctttccaaaagaaacaggatctataataatcgattttttgaagaacccctctaggaatctcaaaaaacgatatcataaacatagctagacttgacaaaacagaattaatcaaaaccaatctcccagcaacagacatgtttatccttccaaatactaagcttttttttcaattctgtgttcaattattatccaatctttattagtaagctttctaaaatgcataagaatgccaagatatctaacaggaaaatcacctaacttacatacaaaaatgtttgaatattgctcatgacactcctttgcctgactaaagcaaattaattcactcttatgaaaatttatctttaggccagataacttttcaaaagcagttaataacaacttcatatttttcgctttctctaaatcatgcttttgaaaaataatagtatcatcagcatattgtaaaatagataaaccatcgtccactaaatgtgggaccaatctagagatgtaaccatcatcttttgctctcttaattaatatagttaacatatcaacaactatatttccccttgctttaaaaccttaaaagtttgaaaatttgatcccacatgatcattcactttaataccaacatgaccacctttgaaaccaattcaatcacaccatttttgggaaaagcccttcattctcaaggtttgttaaacaaaagaccatttaactttatcataagctttctcaaaatcaatcctaaaaattacaccacccttttttttcgaagcaactcacgaatagtttcatgaagaatgacaaccccctccataatattcctcccagatataaaagttgtatgagtgggactaattactttctgagctaccccagagattctatttgtagcaagtttagtaaaaaagaaaaggaaaaagtacacccaagttccctcaaattgtcatcgaattacaaaatcgtcccccgaccgcaaaaccggatacaacatgtcccccaacttacaaaaccagtgcaaactaggtccctcggcgggtttgaccctggttttgttcgacgtggcagctgagtcagcatgggacccacgtgggccccacatgtcaggatgccacgtcagcaggccagcctctcccttcctctctctttcctcctcctcctctatctctctatcttctctctgtactctgggcaggccggcttcattggcggcggcaacgttgtcggcgccgccttgcacgactgcgaccggtgcagtgacgcggcaccggcgccagggacgacaagcgggcgcgacgaacggaggagggcgaggttgagggtcttgaagaacgggagagacttcacgtcggtagcgccggcggcgggacccatggcgggcggcgaggtccttggcgagaggcaagtgatgaggtcgcgcgcgtcggcgtcagcggggccgaacgacctcgccatcaccggctcggccatgcggccgaaggggtggcgcggcgtcgagcggcagcaagaatggtgggcggcggtaattaaatacaaatgataagttgggggacgtgttgtatcaggttttacggttgggggacaattttgtaatttgatgacaagttgagggaccttgggtgtaatttttccaaaagaaaatagaactgacattaagtaaacaaacatgcctatactgttgaattttcatagcctcttcgcacttaggcagtaaaataacagtaccaagttgagagagtaaagatttaaactaccactatgaaaatcttttaataaattaaccaggtcttatttaattacattccagaactcagctggaaatctgatgtgaccatagctataatggatacaaccgttgctcacatcatggatgaataagaagatatcaaaattaagtcctccaagtgctggaatccgattcggccacctgctatactgctgacttcgaacggccaccaaatctgcatacgccctccgttttcggtctgtgagtacttgatggaaagctctcggagtcctcttcccaatggatccagcctcatctccgaattccatcttgtttggccgcaatcacagaaaaaagttactgcatcacctataatgggcctatgggcttgtaacttcgtctgggaccccggcccaagtggggtgcgccctaacctgctagagaatgaccctagggcacccttggtcatcctcccacccctataaatagctaggtaccccttcagtgtttcttaggtttcgttagattaaagtttagtcattgctacttgcttgcagcgcgcgtgccaagaccgctcgtttgttttttcttcagaaccccaacttatcgtttatatttaattcctatttgcaatatcaaattgcttttatcttgttcttgcttgtttcttcgatttgcttgcagggataagattgatctgcaccggcaagatcaataacccacggaaaggtgtatcgatcactaagagcaagtttaatagtatagccaactactagctccaaattatctatagtcaatgtaatagccaattcatacaatagttacttactacactattaatacctagtcctacctgtcatacacacattacgtcttggagtccgtgctgcagctgactacagatctgtagcccactgctcttctctctcttcctttatctctttaaaatatgtttatagctagcttatagcatgctattgtacctgctctaaggcgcaacgcaacgtcttgtacggttatagtcagatcgtcaacatttctctcaaatcatagttatctacaactcaccgaaagatcaggccaatcctagccttgagtgtcgagtggaactcatggcacatcaaaatccatctggacccagagctttattatgttccatctgaaagattgcatctttaatttcattctcagtaaattcatcaactgaagcattacttttctaaagaagacacctagggaatatcacttataagactttcatctagagttaaagaagaaacattaggtggaccaaatagaccttcataatatgtggtaatatgagcaagtactataagcctttacatgttgcccctaaatctggg

SEQ ID NO: 58430 - DNA, 1333 bp, Oryza sativa
atacatattttttgtatcttgcagaaaagacgtgttgtcggagttgtccctcaagccggagtggaagagctagccctagaaggaattcgtgcaggcaagtgatgtaataatataaatgattgttatatttgtaatgcaattaaaaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcatgaaacacttagcatacatgactattttggtcttagcatgtaatattatttgagttttaatataagattattttatttgtaattagacttactatataattattgactacggaattggtgcgattcctagcaattgacaattttagtcttaattagacttagcatatacgacagttacacttagcatacatgactctttcagtcttagcatataatattatttgagttttaatataagattactttatttgtaattagacttagtatgtaattattgactacggaattggtgcgactcctagcaattgactattgtagtcttaattagacttagtatatacgcacgaaacacttagcatatacatgactattttagtcttagcatgtaatattatttgagttttaatagaagattattttatttgtaattagacttagtatataattatttactagctagggttgtataatatacgtcatctagacttagcttatatcacgatttgtaattagacttagcatgtaaggttgtgtagggttctaatgtacgacatttacacttagcatgcataacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatgtcacaccctgaaaattcaaaatatataaattgttgtttaaatggaatttttagaaataattttaaaaagtcttgaagagaagatctaagtttaattaataaattccaatataaaattgggccagataaaatttcattaaatactttgcttaattctataattcctagatttttctgggatttatttgagctaaggaagtatttttaataatggaattgcattcaagaaataatttaaattgaaaaggttttaaaaagtcttcttttggctttgggccgaaa

SEQ ID NO: 58431 - DNA, 8153 bp, Oryza sativa
ctccctttccaattgcatatttgctttccaattgcatcttataaaataaaaacaacataaaaatttgcaaaataaaaaatacccaaaaagaaaggatatgtttgagtcatgctaggtaagacaagctagttctctttgttgaaatgatgaatagttgctctgttttatatttcttatatatgggttcttggtaaatactctctcaaaggttaaatataagtagccaacaattatctgggaacctgaggtaaatgagctgcacttgctgatctgagtctaagttgttgtaagatatgagatggtaaataagagttgctatgatcctgatactagtttgacttgaattctggatgttttgtttttcaaaatgataaaactgagagttcctcatttaatgaaaattcctaccaaagcaaaaaatgtgctatcatgattaaaccatatacattttggttacttgccattccattaaactttgtcaaactcttgtgacttgtgtagatacatttcatgctctatgatcaagatcatacacccacatttatgcacatgctaaactcctacactgggagctaagcaatattccatttcatttccctattaccacaaaaataaattctccatgctttcatgtgctttcttctcctaaaaagaaaagtccttttgaaaaaaaaagagaggagggaaagggcatggttctgaaaaaaaataaagttatgctccttcaagcatgagcatgatgctaaaaaaaatgcaatcatgccctctcctaatcaataaaagaaggatttttgggagaagaaagtaagcacaaaggagaagcatttttctttatttttcctcatataccacttccatcatacaccacacacattgcacgatcttgatcttgagtatgtttagttatttgttttagtctaagtttttgacttagtaataaatgtgaatgcaagtatgccatgtttgatccctaccgagatccacatattaaaaccttagagtgaatcattcgaggaactaggttttctttttcaaaatcatttgaaaacttccggaataagagttaaataaaggttaggtgattggtgctctcattgctgttctgtctttcaactgcctaagtcaaggagaggtagtgtctcgtgggaatcatggggtaagggtaagccaccgtgccaaagattatttaatctgatagagagtacacaaaccttgcacctgtatttttgagatatgcagcatggtagcaactcttgatcaacaaccaagtcttggttcctttacgtccttcactggggacgagcaaaggttcaagattagggggttttgttgatgatcgttatcgattagttttgaccgtcaatcctaccaacataggagaaatctagtgatgcttccaatgcataaaaatgttagagtaataatattccactagtgttaggttaactatccttttgcagagaataccaataaattgaaggagaaccgacgtcaacactttctatatatcaatcgggcgatgtcgacaatcaaacttatgtatgaatgggccaagaactcaaaattgacgcgatgaattgggccgaaattcacaagtctgcggagtggagcaatagagtaggccaccagccaaaattgggctggattggccagccccaggttcggccaaacctggttgtttgtccgatccaatcctggcgccgctggatccaggttttcgtgtgaacgtacaggattgcatcccaatggcggttagagggcacttcggacaattccccttccacaaccatcataactacatctatataagaacttcactttctcacttcactcacacacctcaagcaataactctctcatttctctcaagtttagtttagtagtatctagctggtggaataggaatagagtagaaatcaggagtccggaagccttcggaagagttcgggtatggctctagcagcttttctcttctcttttgtaagcttttgtacttttattagaatactcttctaaatacatttatggtattgaaacactttccaagtatatgagtacctactttacattatgtccatgttatactaaatatacggctagcttatctgggagatgctttggtgcgggtataatgtttgcttatgcaattactctatgtcatgatgatgatattagagtagtatctagtagtttagacatggtgtctagattacgagatatcattatttggggttatatattgcggatgagaggtgggcccctgatggtgacagctcagtacgggtattcctcctcgccggtatataatccaaagttaatttcctgggaagggtattcctccgtatttagccccggttgtatagtcatgacaggctgtcgtaaggaactcggcagtcagaggtggcttctcgaagtaccaggagggcatcggatagagggtattaggtagaatattagttaactaggatgtatgtatactatgtatattataagtataggaatagattatcttcctcttttctttccacttagcttagataatatattatgagaatgagtagtttatgcttgtgtgtcactctatccttggattatcttaacccctatttagaatatgattaccacaagcaatatataaattattagtcacgttctctctacatgatcttcccacgggataaaataaatacgatacccttggaatactctcgggtgaaatgctacaatggtatatgtcacatcctgattttcgtttcaggatttataaattatttaataaattaataatagaatttatattaaatgttctttaattttcaagtgaagtaaaatgtgggaaataaaatttcttaaatctaaagcatggatggatttaatttttgttaaattctccatggttaagtcaactctctgaaattttctcggatttttcagagctcaactcttaataatacaaagaacagttcagtaattatttgatcattaatgatctaattataattgttaagagcttttcttgtttaaaaatccttaaattataaattgttgtttaaaaggaattattagaaatgattttaaaagcttataagagaagatctaattttaatttgttaaatctcaatataaaattgggctagataaaatttcattaaatactttgcttaattctataattcctagatttttctgggatttatttgagctaaggaagtatttttagtaaatggaattgcatttaagaaataatttaaattgaaaaaggttttaaaagtcttcttttggctttgggccgaaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctacctcttcttctttggaagcttcgcctaaatcggtttggaaatcgatggattcgagttcgaatcggatcggttttcctctctccaagccgagctttccttcgccgtctccgccgccgtgggccttcgccgccgcctccttgcacctatttaaggacccccgagctctcctctacccgtcgccaccctcgccttcgcctctcgtcgtcggaagagctctagcgccttgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccacttcctcctcgtcgccgtcgccgtccgttgcttctccgccgcttctttggtcaccggtgagttcaccgcgtcgcgctctacgtcctggtgctctccgttcgcgtcgccgcgccgtcgttcgccggcgagcatgcgagcccgagccgccgagccgccgccgccggtggtgacgtcatcgctgacgtcatcggagtcgtccgccgtgagccgccgtggacccgatcgatctcggccgtccgttttggattggttcgatctcggccgtccgttcccgtgaaccgtcacccgtgcgcccggtccaccgaaaccctagccgctgacgcaataatcttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattcttttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggtcgtgagcacatgattttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtctcacacctctcacaatagttaaggatgttataactggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagtatatccgtgcgcttgcggatgaactctgtaaccacaatataccagaagtatttctgcgccattgctgggaattatatttctagtaatgtcgttaagaaataccaacacctgcctcgccaccgcctcgtctaccttctctaccgcctccgccgccacgctcctccgccgcctccactcctccgccgccacgcagctccgccggcacgctcctccgctgcctccgcctccgtgccgatgtcctgagcgctgccgtccgtgccgttcacgccgccgcgcttgcctcacctcgccgaccgcccacgcccaccgggcccaagggcggaaggaagagtgcgctgccgccgcgctcgcctcacctcgccgaccgcccacgccgactaccctccccacgatcgtcctcaccatgcgtgctgcgcgagagagaaaagagtgagagagagaatagagagagagtaagaagtgtatgacaagcgggtcctacaattttttaattaaaaaagtgttaactggactgccacatgtacgccacgtagaccaaaaccaccgtggattgggttgaggggggtaattcatccggtttgcatagttgggggtgaagaatgtccggttttgtggttcagggtggtaattcagacgaccgcgatagttcggggaggggggtaattcgtactttttccttttttatttcacatcatattttagggtgtcaaatatcggacttgacgaatatacaaccctaatttaaatttacatatgtaaaattcaaaacaacacaatttagttgttttattttacaccattatattagatttatgatttaaaataatacatttctcctatatacggatacatgagaaatataaattattgactagaaaaggtattttgtacgtacatgtgatttaaaaaaaataatgcttacgtatcgtttgaagaaagaatagaaaacgtagttatgataaagccaaaaaatatcgacagtccttaaaatagaattatctacaattcaaagataaaatataataatcttcaaatttacacaaatataattataaaatatccggtcaatgctttttaagcgttctatcttttaaattattttaaaattatatattcaatttgtgatcgtattgtattcctttaaataaataaactattaatgtgtctataggctaaatacatcacaacatatggagccaaaatgtaatactccctccgtttcactatgtaagttattctagcatttcccacatttatatggatgttagtgtatatgactagattcactagcatccatatgaatgtgggaaatgctagaatgacttacattatgaaacggagggagtaattaattttatggtaatcatttcacatcatattttcggtgtaaaaaacactcgacgaatatacaacgctaatgtacatatgtattctccaaattactaaaggtgtctcatgtgaaacagtaggtattgaaaacaagctagacactgaactaacatgcactacactattgatatctgtcaaaatataatatggtactttggagattatcgtggtagtatttaaaaaaatcactttgtcttgttacatataaattcttctattgttttggaataaaatccaatttctttgatttatgtgatggaaggaatataagtaatataatttatctttagttagatgaagtagtatcattagctatatttttaatagaaaatatctttcattaatatataataaaattaaaatgttacttaaagtcatctatagcatacaaaataaaaaaaatgttatataaagtttggaaactccaaaaattttaaagaaagaatcacacataatacaaatagatatgaaccaactccattattgtgacacattttttaaaataaatttgaggatatacagtatcaagtaatatgcccaaaccaattattaacgaacacatgattaaaatagagtcaaaaaatatttcaaaaatatcatccacgcataaaagtttgtaataaaa

SEQ ID NO: 58432 - DNA, 1664 bp, Oryza sativa
tcaaatcgtattttaaatttgctagtatacaatcgtggggccaatacctgttaaaagtgcccttctggtgttgacggtcgttatcgatcagtttcgaccatcaatattactaaaatagaggagaactagtgatgcttgcaatgcataaatatgttagaataataatattccactagcagtaggtatactaacctttttggagagaatgacactaaagtggaggagaatcgacatcaactcaaacgataaatcaatcggacgatgtcgagaatcagatttatgtatgaatgggccaagaactcagaattgacacgatgaattgggccaaaattcacaagtctacaaagtgaagcaattgaggaggtcgccagccgaagatgggctggtttgggccagcccatggttcggccgaactagggggttcggccaaacccccatctccaccgttgaggctatggttcagcatggacatccaataatgcaccctaatgacagttggagggtagttcggacaattccgcttccacaaccgtcataaccatctctatataaaggcttcactctcttcactttaacacacacctcaagcaatagctctctcatttatctcaaccttagtttagtaatatctacctgatggaataggaatagagtagaaatcaggaatccggaagcctttggaagagttcgggtatggctctagtagcttttctcttcttttttgtaagctttgtacttttattagaatacttttctaaatacatttattgtattgaaatactttccaagtatatgagtacctactttacattatgttcatgttatactaaatatacggctagcttatctaggagatgctttggtgcgggtataatgtttgcttatgcaattactctatgtcatgacgatgatattagagtagtatctagtagtttagacgtggtgtcttgattatgagatatcattatttggggttatatattgcggatgagaggtgggccgctgatggtgacagctcagtacaggtattcctccgcgccgatatataatcgtaagttaattccctggggagggtattcctccgtatttagccccggttgtatggtcatgacgggctgtcgtaatgaactcggcagtcaggggtggcttctcaaagtaccaggagggcatcggatagtgggtattagctagtatatcggttaacttgaatgtatgtatagtatgtatattagaagtataggaatagattttctttctcttttctttgcacttagcttagatgatatattatgagaatgagtagttaatgcttgtgtgtcactctaccctggattatcttaacccctgcttagaatatgattatcacaagtaatatataaattattagtcgagttctctctacatgatcttcccacgggataaaataaatactatacccttgtaatactctcgggtgaaatgctacaatggtatatccgtgcgcttgcggatgaactctgtaaccataatatatcagaagtatttctgcgccattgctgggaattatatttctagtaatgtcgttaagaaataccaacacctggtacttccagagatcaccccgggttgtcgagttccttacgaaaacctatcatgaccgtataaccggcgctaaatatggagaa

SEQ ID NO: 58433 - DNA, 104750 bp, Oryza sativa
caaatgtgagttattagctgacttgggtgaactttatgcaaacccccagtcgcattttgacatattctttgtacaaagaaagccacaaagctcccaattctgcagtgtacatccataaacgctgtattgtctgaacaaattacagcgtcatgaaacagtgactctttgttcctaaacactgaactgtggataaagtgtaacaaaggcgtcaagtaaaagcatttgttagaattcctccgtttcaaataaatcatcgtttgttggtttgtcctaaattaaacatgttgaccgttagtttgtaaaaatatgtatatagtttaacatatggatcatatactatgaaaccatttttagtaagaacttgaaaagtttataatgttgacacctataagtgcacacaacgcataggctgcttaaagttcattttcagaaaaaggatgatactaatgtaccgtgaatgcacagaaattgccatcagtaaatgcagatatggtattactcactttcaattcactttaagctcacaacattttacagttagcgaaaagagcgagtcagagaggccgtaagacaggtgctgacatgaatagctcccttcaatgggaagtaatacacacatttttacagcgttatctatgatcaaacggaaaacacgatttccccgattgccacccgccaaaggccatcacaatgtcattgttttcttacatcagagattgcaggaaccttggctgggtagttagacaaatccacatcaagcaagtctgtcaggtcgtaaagccctacattatcaactctgtccttgattggggtgctcattgtttcttcctgatctgcctggtttgacgatacgcttgatgtcaccgcactgttcgcaggcatcacagagatgccagacaattctacatcccgcccggatggcacggtactcactgaaggatacttcctttgagtgctgtctccctcattgtgattgtacagcacatattcgttataggtaggtgcaaactgcatgagaatggagcagattatacaaagacattggcatattatggtgatgtgtgtggaaaaacaaagcccccagatgcaaggggtatatgcaatatcctggttacctgatgaacagtatcatggtagaaatcattgaacttcagagcatgcagaaggcttcccttgaaatcaccagaaggtcgaccattgggaccagcatactcgttgtaaggaaatgcaaataggtggccaatagctgctatgagcatttcaacacacaatacgaagttctggagatcagcagctttttcagcatttttgataaaccgagattttgcagcaaggaaaaccaggacaccctgcaaaggagaactttaaaatatagcatgacccaagacataacaattccttggctaggaaacatctttactgtaaacagtctgataagacatattggaacttgagatagcaatcgtacttggatgtgaaaaaattttgactgttgtatatttacctgccaatatgtgagaaacactactgatttgatcatgatgaattttgggacaggattatatggccgaagcagatctctgcatgccgcatagaacaccgcaagagcatatagtgccattgagtatgagactgtatatatgatagtaatgtatagataggattgcttgacactaaagtttccatctgcgtattttcctttcgcataaagtatgaaggtaataaccaccaaaataggcttaagaatcacaaactgcaaacagccttgtttgcatctccgaataaaacgcctgtccaataacataattttaatcagcacttgcatagatatgacatactctctgaatgttactgtgcaactgcatgttgaagcattagattgttacaataagcacttaatatgtgcaaaagatatgtacgcacccatctagaggaatagctggaaaacagcaagtcatcagaaaccacgatggcttcagggttcgcccattcaaacttaccaccacagcaccaggacctccaacccatgccaagcaaagtgaaaagaaattgtagatgacccaagcatcataactgaaaaacaatcagagagattttaacattagtcggatatgcatttattggttcagatcctaaaacacaagtgcagtaaaaaaaattcaaaacgtggaaaaaaaaagtatcgacgatcgcataaaacattgataggaggctatgtgccttacgcccttaacaagcacagacaagaaaacagcaatagaatcatatccttggtcatggcatcaaattattcatagaatttataaaccagcagttctgtaagaatgaaggccatgtccattacaataacttattagcatttccattacaataacttattagcatactgtgtcagattatgatgattttgtagttatatagaagtggtgatcattcaatgcgctttctcccccttgttttcttcatgtgtgttgttggtcttagtaagacactcaagattaacagtgacaatagtcttcatatatcaagtgtatttaacatctgaaatcatggttcatgggctgatggattaaaacgacatctagaaatatgaatgcatgtgatgtggcgcaaatggcataatagatcttctctacactagtgattgctgaggcttatcaacacagtagctaaacgtaaacacaacacatatgaagacatgggcagtgtaccaatgttgtcatgatgatattgctagtatatacttcctccgtttcgcaatgtaagtcattctaacattttccacattcatattgatgttaatgaatctagatagatatatatgtctcattaacatcaatatgaatgtgggaaatgctagaatgacttacattgtgaaacggagggagtataaatcaggtgatagcaaaagaagtgcatcagagctagaatgtgacatggtgcaccagcaatatcaacaatgctggcacagatgtcaaatcatactaacgtgtggcaacaaaagaaaagttgtgcccattggcaattagagaatgccaaaagaaagtttttatggcagttcttatatttgctgcttgtctagtgtctacaacataactttaagatcattggagatacaagattacatgttcagctcccaacaagtgagcagaaaacaggaaccacaatccaaaagaacagttagttcacattaaggggcaagattataagattgacttacatctctcgaatagaattaaaatatattgaattatctggtaagataagggaaaggaacgacatcacggcatagacctgcaacaaataaacatcatcagagttaatatgctgaagtgctgcaaacaaaatcaattcaatataagggctaaatgtaaatgtacaccagatgaaacatgataatacaaatgattgcaaccattaaaagatcatcaggatcagctagctcgagcaaattcatcaatcagcacagcgattgcagccacggagttgccgtgctatcaaattttcttcaacacaacatctggacaccgatcaaacctaacaggaccaacaaatctactcgtagatccacgcacacaaaaagaaaaagaaaaaaaatcatgtgcaagttaattgcagcctcctgcaggtgcttaggctccatgaatcagaggcgggaactcggaacgacgcgtaatcgaagccatccaaacgggctcgcattccaggccagctcgcgaccgcgaaaccaccccccccccccccccacgaattcaccccccacaaaaaaaaacgctaaaaaccgcgaaggcatcgacagatctggcgcgagggggggagctacggggacgagctgcgttgcattaccgggaccatgaagatgaggcggacgatgaatcgctggtagatgggctccgcgtagtggaggaggtggcggtagatgtgcacgagcgcgatgacggtggccgccgcggcgcacaccagcgccgccgccgtgtaccccgccgccgcccagtccatcgcggacgggacgagccaccagcccgctccctcccagcccccacccacggcagcgagtaggtccggccgccgccgcctccgccgccggagcgctcggattggctccggtttggtgcgcctttggttgcgagtggttggggaaggaggaggaggaggaggaggagaaaggggttaactgtgcgaggaggaggtgtttaatttgcatctgcttctgattacgttggttggatttgattaattttcgtttgatttttcattagtttaatttaatggctcgatttgaattttttttttctatggggatttgaaggggaccggtcttcgagaaggaaagattcagatttctttccttcgtcttctctcgaagcgtgtgcgagtctgctgtctctgaatttgttttcaaaccataatcgaagtttccaacattacggagagctttgatgcatgaaaccgcgtgatctttattaaaaaaaaacgtacgaaattttcagggattttggtttatccatgtaattatttgtgtgagaatcaattatacggggatttatcttgtactccttccggttttattttaattaacgttttgaacaatgacacagtctacaaaatatatcttatatttttgaccttatttttctattataatatataataaatatatatatatctatttttattatagtgcttttaaagaaaaatctgtatatattgttttagttcttttaaacttaatatttttttaaagttattgatggttaaaattataaaagtttgatatcaactttatctaaagcatcaattaatatggaatcagggagagaactgtaatgtacgtttgtccatttacatttgtcgtgacattgttttgacgcggattctgggtaagttgacttgcaattaacagctgagataacgtaggaaatccaccacttgtactaatgtgcaagttaagtatgattagttaattagcttggccaaaatgggcacctgctgcagccgacagttacgtcaacgtctgaatattacagcctgaaatccgatgcagcaactgctattagcatcttgtatatctggctattaataccagcaaaaaaaatggtatcataattataattataattgttgttatattaatcatcatcgtatcttttgtgtcataactaacagtttgggcgactttattaatataagcggtagcttgacataacaaacagtatctctgctggctctgcttgatagtctgatacagctaagcccgagcttgctacccactggcttgattgcctgaacaataatctgcctgatttgaatattattccttttttttaaaaaaaaactacagagacacgatccaaatggtccagaacttcagattatgcaatgacagtcaggtaggtacttgttggttgaatgccagctagtctgcagcgccgattgctgattccgtcttatattattatattatcatgatgcttaaccaatgactgctccagggaccagctttggatttggttttggttaagaagaatgatcccaaatgtaatcaaactagtgcataattcttctgtaacattggaaagattcagaaaatgtaggattagcaagataacaacaaaggcaggaagtggattgaaggggaaatactaaacaatttatcttcagatataaacatctgtgaagttgtgagctggacagtcgccaatgagctgaaaatctgattagctcattgaggatcaattaaatatcgtaggatataaagttaacaaatagtttagacaaagttgaataaaataacggtgaggtgcaaagtttgttgagaaatcgtaaaaagataaattttcacgggtggagcagaagtattgggccattggaggaatcaggcccgctacgtatattggcctttttctgaagcccaatttccttttctgcttgtggagttctaggattccggagttctataccgaatacggtccatttcggtccgtccttatgtgtaggcgggcagcctagtacaaattttaggcccgtacacgtagaatggtctatatttagacctatctgaacaaaaccttagggatgttagcaaactatgacctcccaaccaaaccgattctcttgttttcaaataaccttaatttaatttacagtgaggaaatcagtaaaaatatgttcgcaatcatttaaaatttacaatattctaatgtgtttggtgctagaatatatttaagaattaaaggtagcgatgatggtagagttcttacaagggctcctttggattgaataaatttcataagaattttaaaggattttattacttagaaattttattatcaagtcatttgaaacaaaagaataagatagtacaaaatctaatggattggatacctaaacatcatttcataagaaaatgcttgttcggctatgctacatcatagccaagccaggttgcaatgcagcgacgataaattgcagccaaacaatactaaaattccaatgtacttgaaatcctttgtttggatttcatgcttctccttgaagtccattgcacactgtttttcctctctcaactatttatttcttccacaaataaatttttgtgtgttatttcctgtgagctatccaaaattaccatctctaattcttacatttcaaacctcccgtaaactttttgtagcgtatgacaatgttattcatgtgtgcggttttttatagcatgttcaagaaaaaaaaccttaaatgatcgaactaacacaccaacaattatagatatagctcattttttttatcactaataagatattaaaccactcaaaagcagactgtagacataccatatacttgcagaccatgaataatttgcagacttaatattatccaagaagataggagtatgacactaagcctgagatatttcaaaagagagccctggaccctggtatgatagcagcagaagagtacaaggcagagacagataggctctctgtgctagtggttcttgtgaacgagaggcctcctcgtcgacccgcaaaaacccttctcccccaaacccttccccgtccccctatccaatgctacccccaccccgccatataaaccctcgccttcctaccacctcaagaccagccgctcgtttcatttcttatcacttcccccctctctctctctctcccccctcctcctttctcccacctctcctctccaatggcttccctcctcacgctcccctccctctccctctccaaccctagcgcctccgccgccgccgcgggagccggagcggcgccgtctctgcgcctccgcgccgccttccgctgctgggcgctgcggcgcgcgggcggcggccggtgggcggccgcgggggccatcgcgtcgcccaactcggtgctcagcgagcacgcgttcaagcggctgcagctcagcgacgaggaggaggaggaggaggagggggcctacgggagtgacgaggagggggtcgaggcggtgggtggcggggagggggacgaggacgagctcgccattgccaggctcggcctgcccgagcagctcgtatccacgctcgagaagcgcgggattacccacctgttccccatccaggtgatgccaatttgcgctccgtttcgagttttggatagcttaactgtgcttgatgtcaaattgcaggtttcggtattaggcggagacagcgagggaattggtgttagtgtaggatttgttggggggatgagttcgtggtgaataagcctgtattgagcaattcatgatggggcttgttttgatttaaaaaaaaaacagtggcgggataagtgcggcatgactcgtttagtggggaaagtgagagtagtctacgctaagttgctcctaggatatatcacttgagaattgaactgcgaaactatggagcaagtgatagctggttccataattatttttgcgctccataatatcaagattaaatttcacataactacatagtttgtggttcaagtcgcagaaaaccacaaatattttaacacttggcacttaactgcatatattttggtattgaagtttcataaaactacactatcagagaatgcatccacgccatctcgccgatggattcattcgttagttttgtgaaacttcagtactaaaacatatgtagttaagtgccaggtgtcaaagggtgtgtggtttgttgcaacttggactacaaaacatgtagttttgtggaatttactctaatatcaaactagagtgctgattgctgttccgttgatgcgtagaacttcatagatttgctgcatatcaaattcgtcctattcctacagatactgctaactatcattaaattacatatttgttatttgttgaatcaggacagttgtacgtttatccttgcttctaaaagaataaaacaatatccagttttacgtttatccttgcttctaaaagaataaaacgatatccatgtcataccaaatggcatggtgcatattatgaaatgtcgatacaaatagccaaataagtttatttccctttgaatttcagctttcacatgctcaccttgatggtgcttatttgcttgacccttttctgatttattttcgctgttccagagggctgtattgattccagctcttgacggccgtgacctgattgctagagcaaagacaggaaccgggaagacgctagccttcggcattcccatgatcaagcaattaatggaggaggatgatggacggagtgtgaggtatccattcatcttcctatgcagcttcacattgtattgcatgacaatcagttgatacttaacaagtgcattaacccttttttttcccttttggtaggcgaggtcgtattcctcgtgttttggttctagcacctactagggagttagccaagcaagttgagaaggaaataaaagaatcagcacccaagctcagtacagtctgtgtttatggaggtgtctcatataatgtccagcagaacgcactctcccgtggtgttgatgttgttgtaggaacacctggtcgcattattgatttgataaatggcggaagtcttcagttgggagaagttaagtacttggtccttgatgaggctgaccaaatgcttgcagttgggtttgaggaggatgtggaaacgatattacaacagctaccagctgagaggcaaagcatgctcttctctgccaccatgcctggttgggtgaagaaattatctaggcgatacttgaacaatcctttgacaattgacttggtatgaacttcgtatttccttccatttccatttttattggtgtgaaacatgtcactcttgttatttttatttggttatgccctcaaacaaaaacattccaggaatcagtttcatctagtataagagcattcttacatttaatcacagatatcattttgattttccaagatcagatgtgtcagttgttatgatcatgttatatgctgtaaaaatagtaaatacaaattctgtccagcacacatgtaagaggattaagagatattagcactggtcttgagtatgctaattgcacttacacttgaatacctgttgtttcttgcaagatataattgtgcacatgttctgtgaaggtttacttttattttttttgtctggattagtcatcttttattgtcatgtgtatactcaggtcggcgatcaagatgaaaaacttgctgaaggaatcaaactttatgctatcccgctcacatctacatcgaagcgcactgttcttagtgatctcattacggtatgttattgcagttcatggattttttagctgccttttcccctcctctcttttcggctcagcctcctgagattcagaaactaataagatcatgaaaccagttacagtttatacagctatgttggtgtatcatcatgccagtagatgcccgataagttttttttttttacttcaatccaattaagatttcagaacataattcattcatacatcttccatgtctatcgaactttttactgactttataactagtctgttttgctgagcgttggccactcaattatctaaaaatatcttgttatcaggtgtatgcaaagggtgggaaaaccattgtgttcaccaagacgaaaagggatgcagacgaggtatcattagcactgacaaacagtattgcttcggaggcactgcatggtgatatttcacagcatcagcgtgagaggacactaaatggttttcgtcaagggaaatttactgttctcgtagcaaccgatgttgctgcccgtggtcttgatataccgaatgttgatttggtgggttcacatatcctcttcacttcatttgattcttagatattgtaattctgtaaatcacccttcctcacagatcttaactctttcctttccataaagcgattatcagtgaagcttctgagttttaaactccattattatttacagtgctaaaattagatcatcaaactgtccatttttccccccgaacttaggtttttgtattgaaatatcatctagctttgatgtgttttatagcatctcaatctgatatcttgggttaatcttacgactagttaacaaattaactgcattcgagcattatgctatctgggatgaactgtaggtgtgtatggatcaattaacgagaggatttcattttaatgcagattatccattatgaattgcccaatgatccagagacttttgttcatcgttctggacgcactggccgagctgggaaagcaggaactgcaatcttgatgttcacaaacagccagagaaggacagttagatcacttgagcgtgatgttggatgcagatttgacttcataagtcctccagcaattgaggatgtgctggagtcctctgctgaacatgtcatagctactttaagaggtgtgcacacggagtcgattcagtacttcattccagcagctgaaagactgcaagaagaattaggacctaatgctcttgcttctgcattggcacatctgagtggattttctcagccaccctcttcacgttctcttatcagtcatgagcaggtaagaattaataagtgacccgaggaaattacatgtatccatcattaactgatattttactatttctaccattgtatcgaacacttcctttttccctaccttagttatagctacccatcaacttcatccagctgtcctgatttatgccttctacatttgaggatttatatccacctaatgttatatgaatacaatgggctactagtactgattactgaaattgcatcttttataaatttataatgggcaatcaaataattgtatagaaaagctccacttttttttttgagttgctcaaagttttgttgtgcgtttaccgtttatattttctttttaaagctagaagcactcatatgatttcttaccctctattaaaacacagggatgggtgactttgcaactaactagagatccaggatatggaagggggttcttttctcctagatctgttactggctttctgtctgatgtttcttcagctgctgctgatgaagttggcaaaattttccttacagcagatgagaaggtgagctcttgcttgagcatgtcgatcattaatttctgtgcatgagtgcattgggtctatgagcaattgagcatgcagttttgaagctgttggctgatactagttttgcagcatatatatcttctttaattaatgtgcattacgtgcaatagtatgcattgcagaaatcgatgacacatatcactactttttcatgcatatcttcaaaactcctgcatttatgtgtatgactttcactgtgatgctcatgcattggcgcattgttggttgtgtcaggttcaaggtgcagttttcgatttacctgaggagattgcgagggatttgcttagtatggaactgcccccaggaaacaccataaccaaagtgacaaaggtaacctttgcagcttggtatttttcaattattgctattggaatttatagtgcaattgctatacgtaatctgtgtgatgatacacaagtatttgtctggcgtggtggcatttccatttatttccaaccaaggcatttaaattgactttaaatggcaagtaaaatagggaatattctaccattattcttgcactacacacagtatagaatgcaatagcaatccctggtcttgttttggatgcggaattggttctttgtgagctaatgtgatgactgttttccttttgttctctgcttgcagctacctgcattacaggatgatggtcctgctactgatagttatggccgattctcaaactcggaccggggtttcaggaacagacggtccaggggtggtggctcaagaggcgggcggggtggttgggactctgatggtgaagacagatttcgccgtggtggcaggagcttcagatctgacaatgatagttggtcagatgatgactttggtggcgggagaagatcgaaccgttcgtcatcctttggtggccgcgggtcatcttacggcagtcgtagctcgtcatcctttggtggccgctcatcatcttttgggtctagggacaggtgagtttcacaacatcgcagaaataacataatgtctattcttttttcatccatgctgtatctttcttctaggagatgccaccagagaaaatgaaatacattatgagttagacaaaatttgcttacctggtaactttagaatgtttagtcttttccttagccactcatgtttgttagtactagctactcttatgaagttaagtcttgtcatatgaccaactcatgtgttgtaattaaagctttgctgtgaaattaatgacgggtttcctagctagctcttgctacagcataatcttgcctccctgaatcatggccagtgattacttgtaccttctcagtaccagaacaattacttaaacatgctactagttaactcatgctgctttcttaagctaatgagctgttcctcatttacagcagcaggagcttcagtggtgcttgcttcaactgtggcgaaagcgggcaccgagcatcagactgcccaaacaagtagatggtagaaacaacactcttccctgccgctcgggagttgctccttctgggcttgatcatgttccaacaagcggctggactattcaacacatgccaaggaacaccaaagcccagtcccccttcatctgatccatacatgcccaacactattgcctgacgaagattttgcactggttagtacagctctgtgtcgtcattccgtcgtgaagattttggcacgctgaccaccaaaggagagccttctgttcatttatatgtaatacgggttttacagggacgttaaatttttgttaccacctgggagttctcaataggatgttaagattaaatgaaccgtgtgtacagctcgttcctacacgactggactggctgatgccatcagaaactgttcgcgccaattagaatcactgtccaatgtcaaacaactttacatctggtgcttgtcaaaagtttgcatctggggcatatcaaaggttgccgtttgtcgtgtaaaggtttggtcggttgttccggcaggtggcacgtacctgaagatgacatggtcaatgctgcgtgcaacgggagatagaaaaacgttcatacggatgcaccgtcgttcaacttggtagctaatggttggtcggctagccaaaactactgctacgagttgtgtagattgtcgaagctggacacagtttctcttgcgtacaactcagagtagtttactgttgcttaagtttgatgtgtttcttacatttgagcaaacgcgatctgtgtgtgtcgacgtgtcatgtgtgtgctgcttacgtatacatagacccagtcgcagtttggcaccaaaggcaggggggcgtggtgttcttccggtgtcagaattcagaagtggtaggtcgatttggtggctgacgatatgacgatatcgattaaacggcacagcgaaatgcgtgaaatgggagacatatctatcaggtcaaagttcgaggctgtgcccatgtaaaaggacggagttggtttgttgatcctaacacgataaaaacatgtgcctgacaacgaaagaagaccattaattaactatggatttgcttagtttaggccgtaatctttttgctggagactgtgtagaccgtaatttaatttccccacgggttgtgctcgtgccggtggatgatctctgaaccaaaccattgggctgcccagtactgctgcctagtaggagtagctgcattgcacgcatgtttcccattactgaatctgtacgtacattttgcacacggaggaacaggactcgtcctgtcgccaagcattggccggaatgacggcttcatgccgtggctcgtgagtcgtgaccattgcattgcatgacaaaacaccacacacgctgttcgtgccgtccctgccctgctgtaccttaccaccagtacaacactccccaccccccaacacacacacacacattatttctccgtagaggtagtaagttttgcaccgttcatatccaacgtttgaccgttcgtcttattctattaaaaaaacttatgattactatttttattgttattagatgataaaaatgtatgactttttttttattttttttataaattttttaaataagacggacggtcaaatattggacacggatactcacagttacacttattttaggacagaggtagtacatccggtttataatagccgattaacttttgaatacatgtttaaccatttatcatactgaaaaattatgtaactaccttttattttcatgtgatttggtttagcattgttttaaacatgatttatattttttttgcatatttatataaaaactttgaaataaataaattgtcaaatgtatagcgttatctattaaaaaaacccggaggaagtatcttggtaacagcttaagatagctgatatcatcatgccattacctaattcctttttttttatatcttagagaacttgccaagtggtgaaatgaaatgaagttccactagaaattaaccatctgcctagctatttaacaaactcacgttaccatcactactacctgttttacagtttttattttctgcagtaacgccagaagagagttacacgctaatgtgaaaggtaaactaaagatttaatatatatgatgtggttatctgggtcgatgacgatcatgcacatgccatgagcagattaggcagagggatggcgtgtagagaactgaagtgaacaaattgaataaattatgaggatacagtcttcttggacaagcacgcaccgttttcagaataacaaatccttgagcagtaactgttcttgatggagatgcatgatgtgtttttcaaaccccaacactcactctgttacaggtaagcaaagagtgagaagaaagctattgctaatactatagtagtgattactgctgcccagtatcttattactatcaggttcccacagccatactactactcgagaagagttgcagaactaaaattggttgacttggatctgcagctgcctttgtttgcaagacaagtggaatcagatcgaatttttggggacgagacctacttgacgttacacacgtactcctactgaataccagatcattcatagtaccaataatttactacaaccattagtaccagtagagtgtactggcctgcaaatcggttgctagctgcatggtagtactcgactagattaagagtagctttgcactgctacgtagaagtagtatctttgatggctgtcaagtacatggagcgagtatttacctcaaatctgagctaactatggttattatctcatatcaccatccgtgtcctacagtaattaactagaacatcaaatgctggcagacatgatatcagaaattcagaactctgaatttatctgaagcccagtaggagcactgcaccatccttacatctgcgaaccattagagtgattaatagttctagtatcacgatttgccacttgatacgcgattaattctttcccgttctgagttctgacaagctacatcaggagtactagtactacagtactccgtatcttgttttctttttgtgaggaattacgtgcaagttccaacagatcaggctggacagaaaggattaatcaattaagttgtcatcagtcatgtctttatcatgggcgattagatgctttccctgcggctgcgatgctggctgcggccacaaggatgccatttacgattcgcagcatggtccacgcgtggtgtcatcgctcaacttttccaacggttactactactcgatctcctactttactcctatataactgaccattttactttttactgtatcttactccatttgttccataatataaggcacaactattttttaaagttgttttataattcagtataagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgccctaagacaggcatgcatgcatgttattaagtagtacatttttttcactcaaatattattatttaaatcctccaccatcaagatatctaattttattgggtgcatatattctatttattaggtaatccaaactacgaggtaataataattatttattggtctttgggttaagggtggttgttccttatatttccatagtagtagtaatacattttcattttaattttgaatccatatatatttgagtcatcatgcatggtatcatcactgagtgataatagtacgagattattagtagcaagtaatcattagagcagtccattcaggatgaagtatctttacgtatttgacgaggaattgattgctggtatcatgcagacacgaattagcttggacgccatttgcaagcgatagatcagggcaggctcgccgctagctctctcctcactctagctacagtgtacacgcaagctcatcattagttcagacaactaaaatttgaagcatctgcactgcaaatatgacaagacgccatcatctgtgcatgccaaccctgtacgattgatacacacacgcacgggggttagttaattaatgatagatattctatgagattaactaagcaattgaatacttaattaagtaaagccggcgctcatgcagatgcagtgtacgctgtgaccagccgagattagagattactgtactagtagctagttagcgtgaactaccatcacctactcccttctactccatcgcatagtaatagtaataaactaatgatagtatatgccagccagctccctgatttaataaccaactcgctcttaatttcttctacctcgggtaattaacataagtaatcatctttcttgcttgtgatgtggacgtcacaaaaagatctatccatatgttcatcgtagttaagcagtagtggagtgctaccatggaatgctagctagtaattgattctttaccaacaatcgacttttttatattaccctcaacatacgtctatttactgtgattaatctgctagctaataatccttcactgacttacgtactgtaagccaactggtcaatgtatatatcgtctcttcagaaagttcagagcacgcatcgaattaacggcacacacccatctgttgatggatcgagcttaattaattaatttataaatgaaaatgatgacacagactgctcatcttttaactccaagttgatatttaaatactcatatatcaaattcctgaacccaggaataccatgcagaaacaactgacctgcagtttcattttcagctggttgctgcaacgaccagccagaaatataacgaacttccgaggtgacatgtctgagagaaacgcccacttgtgagtagctttcctcaagaattcatcttgtatccacctgtggcacgcaagaaccttcgtataatcacgatcagatcgacagctactgaaggattcaaggatacactgtttcatgctttggtcttcacttgtgatacagccagattccgtttcacctttttatattgcagttttcagccacatgaaatctctccttattgaaattaaaactagaatatatgttctagaaatcagtacacatttcctaaaaaaatgatggccaagacttggctgcgttcttaatgagcttagagactaggttactcaatcgtttacagagagcacgtttttcgaactaatacacgatatattttgtgtaaaaaatatataaaaaattattaaaatgaaacaaaaatattttttaatatataatagttaatacttacatgattaatggttatactccttccggactgataatacttgtcgttttaaataagtgtgaggtcaatctttaaaatctttaattatggatcatttttaaaatatttatctttcaaatatggtgactacatgtatagattagtcttaaaaagtactttaataaaatcatatatttgttaacacttttatacatattataatgaaaataatggtcaaagttgtttttttgagatcgtgctcttgtccaaaataacaaatattatcaacccagagaaagaactcgttacccatgccagaataagttgagtcagaaacgaacgaagcatttgacagaaccatagtgaagttccgctaacctgaacattagacagtcttggaaaacaaagacatactgaggccctcacataccaatggtgtttcatttgatccatcaaaagttcatgtaagaagcattccatttccatcacaaaccacacaaactattgaattaaatttatgtggacttttcatttgcctttgaggcatgctatggctgtgtttagatccaaagtttagatccaaactttagtccttttccatcatatcaacctgtcatacacacgtaacttttcagtcacatcatctctaatttcaagtaaaatctaaactttgtactgaactaaacacagccctatatccatgatgctgcagtgcgaagaatccaaaaggacattttgggtggagaggagcagaagagtacagaagggacattcatgtcattcaggtcaacgactctctgctcccatccatccaacggaagcccacctccgtacggtttacataaacaaacgcatcaaagacctaattacacactgggttggtcatgtaattctcccccacaatatactaacctagtactccttttgtaacttgcaaaattttgattgtattagagttgcgacaaaaaatgtcaatatttttcctatctaataaaattacccttgattaactaaaaaaagaaaaatacccttaagcgtgcatccttttcattgacagcaccggcatgtatggtttatgatatgcagttacttgtacatcacaaaccggcactattccctccatacgcaacaaggatttccccccccccctagcagtagaaaactcaagctacaaactaccaggtatttcataaagtgcataattgtccatgtaaaccttgcttagctgaacaaatccaatccaaagcaagcaaaaccattaatcaaatcaatcaattaaaaaaatcaattaatcaattaattataattaatccgcccataaatcagaatgcaagcagagagagagagagaggaagtccaatgaagaaagaataaaagccacccacctcttcccctccactccatccatctccccttctctcctcctccctctcctcctccgcacccatcgccgacgacggcgaggcctcgccgccgcaacctcctcctcctcctcctatcaattctccattcctcgccgcagccacaacgtaagctcgctcgctcgctcgctcgcgcgcgcgccttgggaaagaagaagagagcagagcaggccaagaacctgtggctgggccatgtccggcgtgcgggtggcggcgaaggcgcctgcggcggcggcggcgtggccgtacgtggagtacatggcgcggtgggagcggcaggtggagcggaggcagctgttcctgcggagctaccacttctcgcgcgacgtcgagctctcgccgcgggcgcgggcgcggcgcgtcgtctgggtcgggctccgcaggctccgccgcgccgcggccacggggctccggcggctgcgcgcgcgcctccgcctctgcttcgcctgggtctcccgccgccggaacatccaccgccgcggcgcccgcttcggccgctacggccgcctctccggcggcgccgcccacgccccggcgcccgccgcgtcgtcgtccgtgtgcttctggtaggagctcgaagctgcaaagcatcgatcaagcaagaaaggcaaagctaggttgggttaattggcgtctcaaacaagaaggcaatctaagctcattgctgcttggataaaaaagtaaaaattagccggtaaaatgttagtaacttgtagtgtaattccatggagtcagttctttattactgcttcactagagaggataaactgggtgtttattacctaaggggattgtttatgttcagtgttttttcgttcttttctttcttttacttttaatggtgaatctacactctactactctgccggtctgccccaatggatgaacgagctgtgtattttgctcaactttttttttctgcatttctacctgctcctctgttcttcaggtcgcttgatttgacctctatgttcgcttctttctttcttaaaaattgacatgtaaataaaatcagggttgtgtacatatactatgcatgcacgtgcatatgcagtttcagacaaaatcagttttttttttcttcagaaaaatgtgaaatctttgaggccactgtggcaatctagtatcaatcatgcaaacaagatgagaagagaattggagcaggataatggaaagatgcctggccggtgaatcttctgagttgcagggaccaagaaagaaagaaaagaagcccaaagtctgaggtctaattctaaaaaaatattcagagtttgtttggaagtaggtgaggtgagccacggttcgtgtttcagctttatttcaagtgcgtgtcgcggtcaaaaggcagcagtgcaaggagaagaacaactgaagaagaagagataagcaaatggttgctacttgctacatgcaatgcaaggaagacgatgccaaattgaaaatggcatctttgattcctgcctccttttcaatgaattccgtgagagattgggaactcctcttctctctgatgtgcacaagatttgatcttggattggctgaattcactgtcatttacttcaaacaggcagtgaacagccggcatcacttcttaggaatgcagaaaaacactgtaacaaatatgtttttttggaggcaatctttgtgttgcaatctgtcaaatatttttacactcgtccagtcactccatgccggcacatatgccatcacaataaaggattttgttcagtacaaatcctgaaagactttggctggcaccaccgtgtcaatacgccttaactgaaacactgtactggcaggaagtaattcatcactggttaaaactgaccgatcaattgatgcactgtagcatgcactccaccaaaatcaatggagtactagctttaatttagccgtgtatgttactacaccttctccacgagtccaggccggtcagtggactcagtcattatcactaagaaatccatcattattatcctggcccatatgccacgctacaaatctaaatgcctgattaatcaagtcagttagctattatcttaaagcctctgtctcaaaatatatataaggatactatcttaaatttatgaaaagaataataatatttacgaacagaatatattgatagtatcatatgagcattgttttgaaatatattttcatagtttattttttgatgcggtagtttattttttgaatatattttattttcatcctactcttttcgataaaaacttgattagctaaaagattctaacttaggacaaatctgaatccttatatttggggacggattgagagaggaggtagtagtaggactcctccatcttacgacgagtagggtacttgtactatctacatgagatgatggtcccagatgcatgtgctagctagctattgtctgcgtgatcttttcttgactcctctctctgcattctgtttaacgtagttcatgaacaatatgatggtttgattctggaatgtggtgccattgtcttttcaaaagcatgattgagcaattcgacatggacgttttcttctttttctgatcagaaggatcggatggattgtgatgtttcagactttcagtgtgtgagaggaaattcaggtaatcatacattcatactgtacttcagtactggtagcaacagctttggaaacgaacagctacctcgttgccattgcagtcaggtttggggaacctaacagagacaaaatttgaatccaaaagctgggaaataaacagcccagtttgaattcatgatgaggacaatagctcactttgtgagtgcagattgacaaagtccactactgtgtacttttaaggttagctgctatctgctttagaagttgtaaagatgtcagtgctgctaatcttctcagggagctgccatggtaggatgtacacctgaaatatgaaaaaaaggaagagctaacagtggtagtcagggtttataatactacgctattacctcacgattaccgtggtaaccatctcagtttttcgtggtaaccatctcagtttttaaaaccttagggtttttctcggtaaccctacgcttttgctcgactacaaccggggttcccctaccatttttgtagtagacagaaaaaatgtacgagctgtccgttcatctcttcctccctaactttgtttctcatcttttgggtttccaattagtggcggatttaggccatttctgtgggatcggctgaccccacggctttttgaaaaacaccatataaatctcgatttcatgtataaattcaaaaaaattagagaaataacccacttaaatataaatcattagtaattgaccccccaggtataaaattctggctctgccactgcttgcaatggagcaaattttgccaaatcatttctccattctcgtttcatttactaatcctacctaatgaataatgatacatgaatgtaatgcacccgttcgtgcagacacagtaccaccatgacctgtcttaagtactcctatatgtaagttaaattgaagataaacatgtatagtttgggcgcttcacatggctctcatttatgatgcagcagcgacagcagcaataacagagatagagatgaatgcccttcaacatgatatactgctagcgctccttcatccacgggtttcatggaccaggagattgattactattcgcaatttttgcctctttttttttttctaatccaaattctaaatccgctaggcttcgtctggaacgtgcgaaatttttaacgatttttgtgagagataagctgatatgtgccgcaaatcctacgaagttatttcctgccagattttggcattccagaacattccagcatggcagtatgaactagcactagcaggatgcagtcttaaaaaaaatactactatataaaatacagtattagttaataataattgttccatggtaaacaaactgcgctaaaatattagtagacaaatattgcaattgataatgaaggaaattgattgctgcaaggaaaacaaagaggtgcatctgtactatttagcaatttagaatatatatattaaaaaaaagaagggatttcactgtcatatagaagtactctgcgatttgatgatgctcaatggaagtccaaaacagaataatgttaactttaagaaatagaaaactggtatatttttccttgttatctttggtattttctgatacaactgaacatatataatcaagaaaaacaaggatattgaggctcattaaatataacactgatagatccttgcagtatcaacatggttcttgaaagtatcaaaaaagattctgtggaactgcgtatagaggggggaaaaaggagaaataaaccatcccaaatcctcagcaattcaaaataacttttattttctgagacacgtgcaatactagagaccaagaattcttcttgcttccaattcggtatagagtattagaggacataaaaaaacattttgtctgcagatgaatatgtaagcaaatagatataaacctcaatgaaaagtgtgcaaaattatcacaagttgaaggtttctctcttttttttaagaaaaaaaagagatgatcttgaggaatgaagattgcttaacgcaaaaaagataataatcaaatactgcttaatgggatcagatagtcataaaattgctccagctgtgtactagaggatcctcctcaatactcaatgagaaaaacccaaaagttaagtgaaaggaggccattagagaaggagccggcacggcctgtcacgaatagaattgttgcggtccgattctaaatgggccaagtaacgcaggatggctgtgctagtgggcctgaccacatgacgttgcttcgatgacgggcctcaccagtcaccgaattgggcctctcccagccgggcctagcccatcaagaaaccataatttggatggactaatcgattagcatttcgcaacaaacaatcatattacgcgtacaaataccgcattcccgccaaaaaaaaaaaaaaaaccatttggttcgcctgagtccgagtcggtctcgaactctcgatcgattgcattgtctgtactgcgatttgatcgcgcgtacgtgcgccacgtccacgataaataccctcgatcggctaccatctgctagctctagctctcctcgatcaattcagattctcccctgatcgaggtgaagctagggcaacgcgagagctagcgccgccgacatggccgacgacgacgagatcgctcttgagccaggctacgtcttccacccttccgacgacggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcggcggcggcgaagtcggccgattcgccatgctccggctcgaagaggaaggcggacgacggcgcggatcacccggaggcgccgcccagcgcgcggccgcggcaagaggaggccgggagcgagcagccggcgatcctgccggagttggacctggatgcgttgctgtcggcgccgatggacgacagtttgggagtggaattcgacacggccacgacggagcagtacatgaggtatctgatgaacgacgagccattgccgtgggctccgacgatggaggttgccggcggcggagacgaattcatcgagacgacgaacggaccttgcatgggcgaagaggagatcatccagcggctggcttccggagaaaccctcgacgacattcttggctcgaaccctaattaaatgaaacaagtttttgattgaggtgtagtgagcggctgtagcactaagtagtgcagtgtttttcgtcagagaacaggtttagttagacatgtactatgtactacgtatcaatcaattagttaggtgtttgtttgatcaactgagatgcatgaagatatgcattgctcgattgatcatctcgatcgatcgatctgtaataactaatgagaagagttgaatcgattctttctgtaaagtctgatgtaataatgcccttctgtgaagtgaactaacgaaattcatcttcatcagagagattcagagtgattctctttttgtatcttttgcgagtattcatcagagtgatttgttctggcgtttgggcaaaatctggtttgatatcgctgtgtcgatggctgtatcattgtgcgctaaatctaaatgggccaaattgggaagttggctcgtggtggtaggcccaaccacgcggcatcccctccattatgggccctacccgcggcatctcctcgtggacataggcctggcccatcacgtactcgggggctgtgtataaattattttttaacgcggggtcttgttgtaagtttgccaaatcagcttaaaatgcaaagggtggataggataaggcaaagccattgggctcgtcggagagacaagtagagagcagcgtagtcgccgcacttagccatgctcgcctcgccggcgctcgccggcgcgcgcgccttcgcggcgaccgtgtccgggagcctcggcatccccattccggccatctccgcgccctcgccctcgcaggcgcggcggcgggcctctctcgtcgtcgttgcaaaggtcaaggtgtccactccccaggccgaccgcatcgcccgccatgtccgcctccgcaagaaggtagtaatagcgcctgcacgaggggaattagccaacgttgtttccaatctcttgcaatgcgatgattgcgcgctcctttttgcggttagttggtaggtgtgaggcttgtggggtgagagcaatgtcatgccgttgacgtatttgatgaaatgcctttgtggcggcggtacactaaggagagtaggattcgctagtgtcatcctcagtgacgtccagttcaaacgagtaatatcttgtttatgtatgtcttgattagtcctacttgttagaatgtcagttggccgtgaggtcgcaaacaaacagtttgtggctttgtgcatactatggtgggtgactcagtttgtaggctttgccagaatcagaatgcatgtttctgtgaataaaagcatgcctttgtgtaaaccttacataatttatttcaggttagtggcaccacggagaggccaagactcagtgttttccgctcaaacaaacatttatatgctcaagtgattgacgatacaaagtcatgcactctggtttcagcttccacaatgcacaagtctctttcaaaggacttggaatactcggcagggccaacagttgtaagttgattttgacttacccatgtctaatttctttgcttctttttctctctgaaaataataaattgagcagtgcagtaccacaataataccgtaggtgatgctattaacattttgtaggtgcacttatgtgaaaagatgattgtgcatccatatttgtctgatcagacaatcatgctcaattcaatctcacttgttcaaatccttaacctagtgtcgtctcttggagacattgattgcgaaatcaataggttctagaaaaacttaccattgaaatatctgacgatcctttgctgatgtagctctgaagaaaacccagaggaatgcacaaaaaatgaaagctgtttgaagttgtcgcggttgttttttatggttttatgcatgtggcatttccattttagtacatggttctgagctctacttacaaattaaatgttccacaggtcagatagtataggattaacagtgttgaacacgtatcttaaagtttagtgtgaaaaaaaatatatcgaatatatttctgcagttgtttcttgccgaaagtcacagctctgtttctgatgaaagttctctgttgttctggttggtttccaggaagtggcacaaaagattggtgaagtgattgccaagtcttgcttggagaaaggaattaccaaagttgtttttgaccggggtggtttcctctaccatggtcgcattaaagctctggctgatgctgctagagagaatgggcttgatttctgaaacctccaaatgtttgttcatatctccagaatcacttgttactttctttttcgcccacctgtcgaacagagtttttctttgtagtaatttgatttgctctgcaggcttggctactctttaattgtatatcaccccactatcagctcaccagttattgagtttgtctgcttcatgaagtttcttttaacgggcatattttcagtttaatagatcaatctgttgccatcctatcctacatgtgttgttttgaactctgttcgtgcaaaatggagcactcctacaacctgctactagagttctggcctgcaaaagcccaggcctgaaatggctaatgtgggcttcctggccaacattttgtgccaggcctcgtactcttgtcgaagctgtcaggtgctctggagtctggagcgcgttattcagattacaaaaataaaaaacgtgctaattgcactgatgcatactactgtccttttccttttcatttattttccatcatctctgatcgaattatctatcagtaggtaacatttattttctaaacatctcttccatgagtctttcagagtaatggctgattagtgattactgaagcgaaaatgaacgccatttactaagcttacatttctctcactttcgaaagaaacaaatttcaatgtgccaaaaatcgaaggtgtgtcttgcccttgctattagatcaacaggaaaagctgggagcatttgggaattgcataatctcagtattagttgtgatttgctttggaaagcttaagcgattcaaatgtttgcaaacaaaatttacacttttgacaatcttctctttttcatcggctataatgaagctccaaggtgttcaaccaaagattagcgttattttatttacataacgttccacgtgattatttataaaatgttctgcaaaataaggcaatcagatggaaagggagagcttacacatcaagtccattatgtgattttctgttaatttaattgctcgcggtgtcttattcagtttgcattttttatggtcatttggttctctcttggattggaacacagcaactttcattaactagatctcaatcgtcaacatgttttcaagctacagtagttgttagctagaatctatcacagatatactccagcaatcatgtctatagtcatgcggcgagttaggtattcaaatgcagtggatgcagatttttcttcttcttttgttgttcagtgaccaagagcaagagctatctataaataaaataaatatgttaaatctcgaaaagggacacgacaaaccgctcaggtactcttggagatatatatattacacgacaaacgtcattacgtgcgcatgatgcatagcactttgcattgcttgtgaattgtgaagtcttagaaatgacgttatttcctttttttttctaaatctaaaaaaaaaggttatgttgtttctcgagaaaaatgttatgttattacattgcctgtttttcccaatacatggaaaaaatttagtaaattcaagtactagtgttgcaaaatccaatattttgggtggatttagtaatttgtggagggcgaggtgtatggttctttcatgaggcattctctcatttatccgacttacaattcggagactccggagactgacaatccggactctggagagttcaataaccagagtcatggtctaatttatctgttaaggcccctttgaaatgaatgataaagtttttgaaggatttaatttttttaaaggattttttaatagagtcctttgattcatagggagagggtagaatttttttgttatatagaactgcattgcaatggccaataccataggaaaataaccaagatgttggaacactttcagttttttttattgtgatgcaatcaaatgactactcttcccaatttatgtgttttgaatttatgtgggattaaaaatatacactattccctttttttttccgtgggaggacatcgattcatgctttttttttgtcatgcgtgtttcaaagggctcctaaatatctgctaaaggatggagattgatgaccgttcaagaaaaaaaatcgatgctgacagttcatcgataattcagatagtaaaagatttgtgctgtgaatggtaaaaattgaaaagaaaaaatagcagtagagagagacgggtctcgagtggcgataagcatgcatctgatccgatttccgagtagtccaacaaaagattattttttagatgatagatttttcattaaccctatatccacaaagaatataaacggccaaaatccaacgagagatgtccaaacaagaagtacattgcacgagtcgaagtctccaagagatcattgcagatgcgtgctggtaaaccacgcaacgtacgtacgctcgacacttgcaaactgctgccgcgccacggcacgacactcgtaggttcgttcttgcatatatgtgccaaacttttctacaagcttgacacgatccttaccttgaattgatccaatatatgctttgacttatcattgcaaagattctttcttcttcttcttcttcttcttcttcttcttcttcttcttcttcttcttcttcttcttcttcttccttttctttttttttaaaaaaaagaagaaattgcagttcactgaatggctttcaactagaaacgcacacagtggatattgctgcgatgctgcatctgccggtatctagaacgaacttatagaatccaataaagatttgcacaaccttgcacaagtgacgtgcacaagattgaggagacattgcttcttttttatctttattttgagcaactctgaagaaacctttcagtactacagctctgaagaaacccgttttttctctttaattagagcatatctgaagaaacccctttgtagtacagctctgaagacaaccattttctctctttaattatagcatctctgaagaaatgtaatagcatctgttagagcaagcctgaagaaacttcacacgtcattcgcttgtgacctagataaacaataatgctgcaagtgtacaactatggagttatattgtaagctacttcctccgttttatattataggactttttagcattacttatattaataaattatttatatgaacgtgagtaatgctagaaagtcttataacatggaagtaatagtagtgtactgctcgcctcacatcgatatgatcttgcagcgtcactccacacctgtagctttcacaagttggattacttctcaaatcttaactgatggtagtgctttaaattattgggcaattctggctacttaatttttatctccgattttttaatatataacacaacacaattgattttttattagtatttgtcttttcaaaaaatatgtgtttaaataaacaatcacaccaggcataatggtactcttttcactccacttaagtaagtaattggataaatattattggttaaattttgagaaaaaaaatcaattgtgtcatataatatttaaaaaatagatgaagtaattattaagtacattattattaattattaactactgctgattaataactatattattacaggtgttattgatccgagcttttttttggacaaatatatttgcagatggaaggtgcgaagcatgccgaaagcagcgatgggatttacgacctgagaagtgagaactttcagccggccacagccggctttagactttttttttttatctgtggaattcgttcagagaacaacaaagctttactttgaccctttaaacttatatcacctaccaatggagctagcgtaagtatctagttctcctttgggaaagtcggcaaggaaggaaggattaattaggcaagatgggtaagtgccaacattaagaagttaactctgcacttgcagcggttgttgttacagttacctatcgatgttactgcctagcaacctcttttttttttttttgccgactgatgctgtacgactgtacgtacctccccatgtctatacggtttagtttaatcttaacgaaacattatgctctggacagatagtacattaatacagtaattaattcgccataaagtacgttgatgtgattagatgtacttgcagcagcattactagattaattgtattcgttacgtctaaaaaaaatctgcctacctagctgcctctttggcgatcggaatttcagaacaaactggaggaagttttttttcttttcgtgttaaaaggaaaaagaaagaaaagaagtagaagtatgattaaaaattaattagaagaaatgtgaccactgcatcttaagcacgtagtagtgcatcttgaattttattttgttttgaaccatatgactgtggattattatgagtatatgcagttccacgtactccgttaacgtggctaattttggctccgccatccaaaccgaccgaccgatcgagtccgacggcaccaccacctgtgcagcatcgaacactttgtaaggacgatcatatcattgcaacacgtacttccgtgtcccttgtgtagtccatgctgacgtttctggcaccaaaatcacccaaaaaacacttaattaatttagtttgaaaaacattaataactaattttgtacgacgacgtggccattctcctgcgaaagtaatcgcgtagtgttcatggagacgaaagcggcaggactcctcgcaagaaagaaagaaagaaaacggcaagacgaaattgtacaaaacaacacgatgcattctagctcgatatgatcgatctgcgccgtcctgtatatgcattctagcatggcagaacgcatggaatgtttcagatattcaaaacacacacagccgtcacgtcatggacgctagctgccggcgacgatcaccaccgttgtccacgtactacttccatctaattaacgtgcatcttctaggctctgctcatgcgcctatatatataaaaaacgcacacgaattcgatcgcgttgcatatttgcatgaacaagtcacaagtgtagtagaagtgcagggcgcaagctgtgcaacacacatggcggcgatgacggtgaggccacggccggccgccgccgcgatcatcatcgccgccgtcttcggcgccgccgcggcggcggcgggcggcggcatggtgggcgtggacgggacgcagttcgtggtggagggcggcaggacgatctacttcagcgggttcaacgcgtactggctgatgatgatggcgtccgacccggcgcgccgcgccgccgtcgtcgccgcgttcgcccaggcgtcatcgcgcggcctcaacctcgcccggacctgggccttcagcgacggcggcgaccagccgctgcagtcgtcgccgggcgtctacgacgaggccatgttccaggtcaccaccattcgtcgtatatcaatgaccatttgtcacgtggaatggtgaacaaaaactcacagtttttgtttgattttctctggttttcttttttgcttgcaggggctggactttgtgatcgccgaggcgagacgacatggcatataccttctcctctgcctcaccaacaacttcgacgatttcggcggcaagcgtcagtacgtccggtgggcggccgacgccggccacaacctcaccgccggcgacgacttcttcaccagctccgtcgtcaaatcctactacaagaaccacgtcaaggtacgtcacaatcgatatatacatacatcgatatactagatgttaaagagctggagctcgatctctcgtgcaggcggtgctgacgagggtgaacacggtgacgggggtggcgtacaaggatgatccgacgatcttcgcgtgggagctcatgaacgagccgcggtgcgacgccgacccgacgggcggcatggtgcaggcgtgggtggaggagatggcgccgtacgtgaagcgcgtcgacggcggccgccacctggtgacggccgggctggaggggttctacggcgacggcgagcacgagagcaaggagctcaacccgtggggcatctactacggcaccaactacgtggccacgcaccgcgccgccggcgtcgacttcgccaccatccacctctacccggacgtctggctatggggctccaccgccgacgagcaggccgccttcttccgcaactggacgcgctcccacgtccacgacacggcggcgttcctcggcaagccgctgctcgtcaccgagtacggcaagttcctctggaagggcggcggcgccaacaagacgcagaggaactacttcctcgacgtggtgctcgacgccatctacgcctcggcgtcgcgcggcggcccgctcgtcggcggcgcgttctggcagctgctcctcgacgacgacgtcgtcgccggcatggacgacctcagggacgggtacgagatcatactcgccgaggacagccgcgccgcgagcatcatcggcgagcactccgagcagctggccagcctcaacggccaggacgcggaggcgcttcgccgccgccgccggcggccggcgagctcgcaccggaagacgcgtcttggcagcggcggcgacagcgacgcactccgactcccccgaacgctcttgattcgcttcatctctttgtctagatcgatctcttcatttattcaagacaattttgttcttttctagtttgtatatagcttgcatccttctccttaggtatagttgttcgttggcacatcttgcaactgtaacctgtcgaaatcatcaggaacgcttcaggatggctgttctgacgatgtatgttttgtaccatagtttcctgtataaggtgttttgcaacggttactacgatggagtaccatatttgtttatactaccattcttaattattgacagtagaattttctttactgtttgtaattgttaaattatagtgttgatagtggaatacagtagagaccaccgcaagatggaatgctagctttctgaaaagaaattttgtactacagaactgcaggtccctgcttccaatactgttggccagttgaagtcgacatttcaacctaacacaacgcttattaatcagcgtatccctgactgttttggaggttaacagtggaacatcacttggaaaaaggcccactcagatttatgagttacagtagaaaaaacaaattttatttgccagacatccttttccatctttaaacttgaaaaaacgggaggactacacattgagtgctgcaacaatgacttaacatgtggatgctttcctgcataactgctgagggaaaagaaaagcatcaaagcatcctattggaatcaaattatttacagcattttaaagctaattacgtgcctgtctacttgttgagcgctctgcaagtcttcagccgtacgtggtcaattaacaaggtaagattttctgctctacggggggctgcaacgatggggtgattttccttaatcttcttcattttttaacttccggtgacacaagcacaagagacatgccgtgggaagggaagcaagtagcaaactgatccaaaggccatacatttatacccaaattattcaatgcaggagcaacggatcaaggaatcccaaatcactcagattgcaacgccgcctcaccaagtcggcggcgacccagatggatcccggcgaagccacgacgcggcggttggcggagacgatgaggcgcccatgccgagccgagcgcgagcggtggacgcggtcggcctgcattttgcttgggcagtggcggtgggccggtgacccattaacaggtcatgtcgggcctagtatgtatgggccaaagcttccgcccattaacgtgttggaccgttgacggttggtgttagaggggtgcatccggatgaaagggttagaatcttctccccacgcgcaaagtgagtcattaattaattaaattttaaaatatattaatatgaacttttaaagaaacttttgtatagaaaaatttcgcaaaaagtgtaaggaatctgaagatgggaacttgtagttcagaacgcagtcgaaaaaagattcaataagatttaatctatccatgtttatcggtccatggtgcaagtttagagtttggggcaatttgcttatttgacgctgttcggaagcataacttctaatttgtcctcactttttcaaatttgcttatttgacccatttctcaaaatgaaagatcaagactaaacctgttatgtgaaaacaagataacggtgctaagaaccaaattgtcatatttttttctcttgttcatttgaccataatatataaaagctttttttattcgaatctttgacataatctattatattattaaaggaatagaaaaaggagcctccatattcgctctcatggtctagaaattctcacattaatcggagaaaaataaaaggcagagtccatatagaaatacaatttagaaataactgaaattcggaattaaaaaataagaatattagaagaggatactagagtccatatagagtccatatagaaatacaatttaaaaatagttgaaattcgaaattaaaaaataaggaatattagaatagtagactagagtccatatagaaatacaattaggaaataactgaaattcagaattaaaaaataaggaatattagaagtagcgtatagagttcatatagaagtacaattaggaaataactgaaattcaaaattaaaaataaggaatattagaagtagagtgtagagtccatatagaaatacaattagaaaattactgaattcggaattaaaaataagaaatattagaagtagagtatagagtccacatagaaatacaattaggaaataatagaaattcagaattaaaaataggaatattatgagtagagtatagagtccatataggaattgaaaactaactaaaatttggaataaacataacaaaattaaaagtaaagtttagagtccgtataaaaataaaatttacaaataactaaaattagaaattaagaaaaacatgggaagaagagtttaaagtcaatataggaatacaatttagaagtaactaaaattcgaaaattaaaaattaaagaatattgaaagatgagtttagagtccacatagaaatacaattagaaataataaaaattcagaaataaaaataaataatattgaaagaagagcatagagtctatatagaaatacaatttacagaaaatttggaattaaaaaaagaaatattaaaagacgagtctagagtccatatagaaatatatataatttacaaataactaaaatttgatataaaaaataattaataactaacacgtatataaaatacaatatgaatattacacattagtagttttgtaaagttattgcaaaatttaaaattatgttatcattttaatatatttgaataatataatgagaaaacatatatgctattatatgagaaaatataatgatgctagccacgcaatctgcgcgggccaccatgctagttgtaataaatttagcatagctccgagatttgagacaagtttaatcgatttggcttcaaattgatatatttgacaaatcaaattaacaaaatatgatataattatctttttcccatcccaaattgcatataattaataaaatatagataaagcaaaacacacatagagctgagagccatgcgccactgtcgcccctacttctcacgtgtcgctgccgctgctggcgtgactattgatcccttcgtgcgctgtagtctccgctgctacctccttgcccctgccccccctcgggtgccactacccctggcccctactcccaccatgcaccgttgtcgtcgcaccctctgcgagcccacaccgctgctctcttcatgtgtcgttgtcgcagctctcatcgcacgccgccgctttcaccgccccgctacctccgcacgtcaccacccccactccctcctcgtgtcgtcacctctccctccatctcggctactgtccgccacgctagtctttggagatgaatggatgagaagaaatttagggatatgatgttgtgtacttaggggtattttgtcaatttggcgtataaatagtttttttaaatgaaatcttaacagtgtttgcaaataaggtcaaacgacaacttcaattttaaaaaatatggtcaagtgagtaaacttaaaaaaatagagacaacgaggtttaaataagcaattgtctgttaaagtttccctgtctttcccattgatgaagatgacagcggcaaccaagctgcagtttgccggcttgcagcctctcggatggctgatggacggttgagatgaaggcattgtaggcaagggccaatcctgtccaacccggctccgacacgtgccgttgccagtttgccacacctcgtcgaggcgaatcccccgcctttgtgattcgaaccgctttttgggatcattcgaatccaatccaatcaatcgaatgctgcaagaaaatccaacgcgcgccaccgacacacgcgacgaccacctctctacctcgccgcatccttcgatcccctcctctttcactggtgcccagcgctcgcccgtctccacccaactgaacttgacttgcgccgccgccgccgcggggaagcctccgaataaactcgcagccgcggggcctctccggcgatgctcggggctgcccagggaggatactaggggcggatttcgagggcgacacggggggtgtcgcttgctccggtccgagtccgacgctgctgagccatccacggacctcaaccctaggtatcgctttatcgaatgagcgttcattcgcctctcctttctctgtccctttttttttgggatctagatggggccatggtttgctctgtttctgtttttttttttttggttctaaaaaattcgtcacgggctcatggctagacgtacggggtgttgtggtgtattttggatagccgaacagcacgaattctcaattggctagattacggttggattcctgaatagccgacctgcaatttgggtggattaggtttggttcctggatagcctacctgggatgggttaagcttagattctgtggaagtagaattttggttgattatcaggggcttagagttgaattcagtgaggaattttcgttttcttagatttaggcgtattatgatttagggaggtttcgtgaggaatgggatttttattttgctggttactgtttgatttcggtaggaatttgaagttgaggtgattgtggttgcaaaagagagagaatctggatgtgtgccatctttctattatttaggtcgttgattgcttaagtttcaatctaatgctaaatttattgtattaccattctataacttttgtctaacacccctggtttaaaattttcatgtggaacctgctatggattggttgggatattttcatgagatctcttcatcaaagcatgatctgtgctgttattacaatataaatggtgcacgttgctcttgtttacacttatctgtgatttgttaatcttctgttaaacaatttgctccctatgtttgtcctgccctgaaatctggacttgtttagcacaaatggtgcattttctgagacatgtgaatggctttatctctaggtctatggtttaatttggcgtaggttgatttttgattctatacttttgtttccctatcatttgacgctttacacacaaaaaaaaaaacttcaccgttattgactgactggcattgaatatgaagcatctagctgtaatagtttctcagccattagtatggttacgagttgttatgccatactgattgtatttatcctttttttcctggagtgggcaagggaagctgtttttgtttttattcatcctcagtaaaaattttcatctagatcagattatgtttcctttgtttgcaagtgatgtttaaaagagaaaaaaaaataacatgtgggggctaaatcagtgaacaatataaaatttttcatgaaatgctggtgaaaagcagataaggtgtggcttgagcatagtaagttttgacctatagtgaggctgtacaaatcttctgatgtcaatcatcttgataatgataaatgcatgagttcttgcgctttagttcaaagacctccaccctggcgcgctgccgtggcgcctggcgatggcatggtggccgtggacggcacgcagttcgtggtggactgcggcaggacgatcttcttcagcgggttcaacgcgtactggctgatgatgatggcggccgacccggcgctgcgcggcgcagtggcgacggcgttccagcaggcatcggcgcacgggctcaacctggcaagaacgtgggccttcagcgacggcggcgaccagccgctgcagtcgtcgccgggcgtctacaacgagaccatgttccaggtcatcctcgcttgcttaccatcgtcgtcgtccaaaccaacgcaaaaactcactggttgtcttctctgtaacgtttttctgggcaggggctggactttgtgatcgccgaagcaaggcggcacggtatataccttctcctctgcctgaccaacaactttgacaattttggaggcaagcggcagtacgtgcggtgggcgggggacgccggccacaacctcacctccgacgacgacttcttcaccagcaccatcgtcaagtcctacttcaagaaccacgtcaaggtcagtatatatgcaaagcatatgcatcgataatcgatgtgttacatttcaatctcactcattcattcatgctgccgttgcatcggcgtcgatcgatgcagacggtgctgacgagggtgaacaccctgacgggcgtggcgtacaaggacgaccccaccatcttcgcctgggagctcatgaacgagccgcgatgctacgccgacccaaccggcgccatggtgcaggcgtgggtggaggagatggcgccgtacgtgaagagcgtcgacggccggcacctggtgacacccgggctggaggggttctacggcgccggcgagcacgagagcaaggagctcaacccgtggggcatctactacggcaccaactacgtcgccacgcaccgcaccgccgccgtcgacttcgccaccatccacctctacccggacgtctggctatggggctccagcgccgacgagcaggccactttcttccggaactggacgcgctcccacattgacgccacggcggcgtacctcggcatgccgcttctcgtcaccgagtacggcaagttcctctggaaggaggtcggcgccaacaaggcgcagaggaactacttcctcgacttggtgctcgacgccatctacgcctcggcatcgcgcggtggcccgctcgtcggcggcgcgttctggcagctgctgctcgacggtgacatcgtcgctggcatggacagcctcagggacgggtacgagatcatactcgccgaggacagccgcgccgcgagcatcatcggcgagcactcggagcagctggctgccctcaatggccaggacgcggatgtgctttgccgccgggcaagctctcaccggaggacgcgtctaggcaactcgcttagctgcggcggcggcgacacccttgaactgctcctccggatggtcttggcttgtttcgtctctttgtccagatcgatctcttcatttattgtacagaatttcattcttttgtgatttgttccatgcatccatcttcatgggtatagctgttcgttggcacatgttgcaactgtaactaggacaaattttcaggatttgttcaagatgattgtcctaatgttttgtaccgtagttttcttgtagactatatagaatgctttctgtgaaaaaaaaatactatacttcaaaacaatcccatcttccaatactactccctctgtttcaggttataagacgttttgactttagtcaaagttaaattgctttaagtttaactatatatgtagaaaaaaatagtaatatttttaacccaagacaaatttattatgaaaatatatattcaattatatatttggtgaaactaatttaatattataaatattactatatttgtctataaacgtagtcaaacttaaaacaatttgactttgaccaaaatcaaaatgtcttataacctaaaacggagggagtatttgccaatggaaatcgtcatttgaacctaacacaatattaatcagtacactttcttactattttggaggttaacagtggagtgtcgctgacaaaagtcccgtggaaatgtttgagttacaacagggaaaacatttttgtttgccatatgcatccttctccatctgtttttctttctttttctttttttttaaaaaaaagagcactacacattgagcgctgcaacaatgggccggcgccaagcgcattacttcacccctaatgggccgtcatgaacacctgatgggtttaatgtcatgaaacctgaactcacgctctctcgctgcattttttttttgcagcaattcaagccacaatgatctggaagaacgttggccttccaaatttctttacattgtctctaggaaaggacttgcaggtgcattcagttagtttcagtttcaacaaccctgcagttttatacttatgctgttttcatttaattcgactagtttcaacaacctctagaatttcaaatttagatagtaataatgcatgcatgtgattagataaaaagttagcgctgacatttcccggttgctttgtttgctaggattgtgttgcatctcatgattctcatctcgatttcgcggtaattttcaaacaagtgtacaagcttctcagggtacttcgcatccaagctagcactattgacctgcatctccttcagaatttgcacgatttgcatgtttagtggatttgcaagattgaaaatcagttagccaagtttgggactaaattataagagcctaagaggtcatcagtgaccgatttaatttgtcagccacaccatcagttctaaattatttttgtggcgtccacaaatttggcctgcatacttttttaaaaaaatctgaattaatcaaccctgttatgccaaaaacggttgctgatgataacatttgatttgtgcgtacgtatctgctgacgataaattacgacagaagcaactgaaactacgatatgatggtctgagaaacatcatatgccttaacggacgatcacattacagttgaattttctagttactactaactaattgcttctctaatcgagtctccgccgtgcaactcgatcacatgacacatgcatggtccatacgcagtcaaaaaaaacaaaaacaaaaaacaaaaagaactttgctttcgtctaatatatttgaggcgcgcaagctttgcgtgatcacgaaaagaagtcacagaaaaacgcaggcggtgaatactcgatcgaattgagttccccaaatcgatctcatctcatcaacaaatgctctcaaaattcgtccaatgcataagcatggaagtgaatgagtgatccaatatttcacaaaaacccagctctcaaaagcccactgcaaccgcttaattacttggctataaataaggtggtgaagtggccatgaatggatcacaaagcttcacccactccaaacctctaacacctgcagtggcctgctgcctatatttgtccaattcgacaccgatcgatcagcttaagaggctgagcttaattaataatcactagtggtcacacgtgtaagcactactagttagcatcagtttgcataatcccctcgcatatttgcagctagctagttatacatatatatggcaggaatctagcttggctgtgcttgttcttgatccatccatcgccaattcgccatgcatgcgttcttgccctgagtcgatcttgtgaattggtggtggtcggagagatagattggttggttgcgagggcgaggcggcggcggcggcggcgaaggggatgaaggcgacgtcggagggggcgtggcagggggacaacccgctgcggttctcgctgccgctgctgatcgtgcagatctgcctcgtcgtcgtcttcacccgcggcctcgcctacgccctccgccctctccgccagcctcgcgtcatcgccgagatcatcgtaagttgttctcatcatgccttcatcagttaaatttcgcaatcctttcttgtcctggtattatgcaaccatactatatacaaccttaattactccctccacattttaattttaatgtatgacgccgttgactttttgacgaacgtttgacctttcatcttattcaaaaaatttatataattataatttattttattgtgacttgatttatcatcaaatgttctttaaatatgacataagtatttttatatttacataaaatttttaaataagacgagtgatcaaacgttgattaaaaagtaaacgacgtagtacggagtactttgtcgttgcatgaactgtatggtttatcattttgttcttgaatcctgacacgctgttgatcaacgacaccacctcatcctggcaaagtttcctccattcgcacatccttcttcccatcccaaacagtaattacgaaaaacggagcggtccattagcacgtgattaattaagtattagctattttttttaaaaaaatagattaatttaattttttaaagcaactttcgtacagaaactttttttaaaaaaacgcaccgtttagccgtttgaaaagtatacgcacggaaaacgaggaagaatgtttgggaaaaggggatagcaaacagagccatatggtcactcattcttacctagagtgatataaaccgcagttacttgaggataattctagtaccaataatcacaagatcaccataccaaagaccaaccgatatttttttaaaaaaaaaatgcgtgcttttatactagcacaaccaaaaaaaaaagttaagctttggacctcaggaaaattaatccggctttgtaggtaagggaaccagaggtggtagttgcagaagattgctggctatttttgggtcacctgctagttttatctttcctacttttagagcaacctgtacttagtaagcactaagatgatgttcttgacaagatcagtagcttctgctgccattgacaaatgcaccatgcatacaatgaagaacacaatgcaagaagctgaaccttacagataaaaacgtaagaaaactgtttctgatcgagttcttcctcatcacacgtgtgtaactcgtaccagtccacgatacgtaccacgtgcaatcgtaggaacaacacatactaaccagagttttctttcttcgattttgaaaatataaatcaagcattgcccttctatagaaaatacaggagttgacttcgtgaggatggctctgactctgataagctaccggctagctagtacagttaaactagtaggactagtatgaaccatttcgagccagctgactgtttggattattctgtggcaattactgatgcagctattttctatgcaaatattccctccatactcgtaaaggagatcgctttggacaacgacatggtctccaaaatacaactttgactttttgtttatataaaaaatatttattgaaaaatgatatatgtatacttttatgaaagtatttttcaagacaaatctattcatataatttttacatgttcaaacttaacaacttgagagttatttatgaattatattcccaaggtttgacttaaacattgtcctaaacgacttcatttacaaatacggagggagtatttttcttgtgtagctttctctggactaacatatattttagcaaacagatacagtttccaagaagaagaaagtagagctctaaaaaaaactggagaagtatggttcctttacactttaaaaaacataattttcttagattctgaagaaacatctggattaatattaggccaacagttgcatcaccattgaccaccaaagcacagcagcaatacgctgccaaacaaccaattactacagatcatcagttgattcctgaagaatattaaatataaaatataagtagtatatgtgctgtatcaatttcaggcccatagcatcaatcatactatactctttgggttctttcccttacagttttgtatttaattcttcatttatttatttctttattacccgtttgagcaaaatgggtatgttgcatccgtccaaaataagttcatttttcatccaacccacaacacgtgccaattcaaaacttatcaattctcaatgcaactagttccaattttatctgctctcagtataattattttttactttttacaaattctggtacaatgattacttaaaaatagatttattttattttaggacaagtagtaagagtaggtaaaaataaacttattatgagacggagggaggaagcatctttgtgtgatgatgaactgactgcaatggcggcgtgatacagggcggcatcctcctgggcccgtcggcgcttgggcggaacaagcgattcctcgacaatgtcttccccaaggacagcctcaccgtgctcgacacgctcgccaacgtcggcttgctcttcttcctcttcctcgtcggcctcgagctcgacccggcctcgctccgccgcaccggccgcaccgccctcgccgtcgccgccgccgggatctcgctcccgtttgctctcggcgtcggcgcctcgctcgtgctccgcgccgccatcgcccccgacgccccccgtggcccgctcatcgtgttcatgggcgtcgcgctgtcgatcaccgcgttccccgtcctcgcgcgcatcctcgccgagctcaagctcctcaccaccgacatcggacgcatggccatgtcggccgcggctgtcaacgacatcaccgcgtgggtgctgcttgccctcgccatcgcgctctcgggatccgggtcgccgctcgtgtccatctacgtcctgctctgcggcgtcgcgttcgtcggcttcgccacggtcgccgtgcggcccgtgctcgtcttcatggcacggcggtcgccggagggcgagccggtgaaagaatcgttcgtctgcgccattctagtcatcgttctcgccgccggcttcgccacggacgccatcggcatccacgcgctgttcggcgcgttcgtcatcggcgtgctcgtccccaaggaaggcgcctgcgccggcgcgctgacggagaaggtcgaggacctggtgtcgtcgctgttccttcccctctacttcgtgtcgagcggtctgaagacggacgtcaccaccatctccggcgccaagtcgtgggggctcctcgtgctcgtcatgacgacggcctgcgccggcaagatcggcggcacggtggcggcgtcgctgctgatgcgtgtgccgctgcgtgaggcgctcgcgctggggatgctgatgaacaccaaggggctcgtggagctcatcgtgctcaacatcggacgcgaccggaaggtgctcaacgaggaggccttcgccatcctcgtgctcatggcgctcgtcaccaccttcatgaccacgccggccgtcaccgccgtgtacaagccggcgcggcggcaggcgtcgtacaagcaccgcacggtggagcgcgccgacgccgacagcgagctgcgcgtgctcgcgtgcttccacgccagccgcggcatcccgacgctgatcaacctcgtggaggcgtcgcgcggcacgaggaggagcaagctcaccatgtacgccatgcacctcgtcgagctgtcggagcgctcgtcggccatctccatggtgcagcgcgcgcgccgcaacgggctcccgttcgcgagccggcgcggccacgaaggcggcggcggcggcggggaggtggtggtggcgttcgaggcgttccagcggctcaccgccgtgacggtgaagccgatgacggccatctccgacctcgacaccatccacgacgacatcgtcgcgtcggcgctggacaagcgatccgccatcatcctgctcccgttccacaagatgctctgccatgacggcacgctcgagcccgtggaccgggcgttccaccaggtgaacgtccgggtgctccgcgacgcgccatgctccgtcgccgtcctcgtcgaccgcgcgctcggtggcgcggcgcaggtctcggcgccggacgtctcctactcggtcctcctcctcttcttcggcggcgccgacgaccgcgaggcgctcgcgtacgcctcacgcatgggcgagcaccctggcatcgcgctcaccgtggcccgtttcacggccgccgccgacgacgccgccgaagacgacgacgccatacaaaagcacatctccaacgtgcgcaaggccggaaacgacggagcgttcaagtacgacgaggtgtcggcccatggccggcaagaagtggcgttcgccatcaagacactgggtagaggcaagaacctggtggtggccgggcggtcggcggcggtggcgacgccgctggtggacaagacggactgcccggagctcggccacgtcgggagctacctggcgacgccggagttctcgacgacgtcctccgtgctcgtggtgcagaagtacgactcgagaggtgacactggcacatcgtcgtcgagccaagccggaggagaggcgaccgtggaggaatccggcgtgccaatccgccggccatagtcgccggaggagacggccgctacgtcgaggcagccggcggagccatagtcgcactgcctctctgctgcatgatagcacgtatatagcaacattagtgtgtccctcctgtcggtgattagatcatatttggttgttaattattagctaattagttgttaaattagggttcacaggtttatttagagaaagtttaatagtatagccaactatggctccaaatcgcctatataatagccaatgtatacaatagttacctataaatatatactatataattaataatgtctggtctcacctgtcatacacacatgaatcttagagtctgtgttgtagctggctacaaatatgtagtccgctgctcttatctcttctcttttatatttttaaaatatgtttgtagctgacttatagtttgctattgtacctgctcttagagcatctcgaacaggttccatatttaaattttagcaattttgaagcaaaatcgtgctccaatagccatccggctggccaaactactcctctcgttggccaaatttggccagccaaaatagcctagccaaatcgtgggtcccacctcttccccccctctcgtccgatgaacgttggcgccgcacctttgctacttcgcgccgccgcccgtccgcttaggcgacgccctccactggctccgccccaccgcccctccgcaccgcctctccgcgtcgcccctccgccggcggtgcccctccgcgccgccccttcacaccgccgcccgtccgcgccgcccctccacgacgccgccccctgctttgccgacgctgccgttgaccgccgccggggccgcccctccgccaccgtcgtcctttgccggcgccgcccctctgcaagcatcgacgatgagaaggaacgaaagagaaaaagaaaaaaaggaaggaggagagagagaggggaagaagaggagtggagactgacatgtgggttcgttgttattttggagaggattaatagagagtctgttggagtgatcatctagtttgactagccaaattagatggagaattggccatatagatgtttggagaatctaatttagagagactgttgaaggtactcttagggaaagtgatgggctaactaagttagtggttaattagtacaaaatgcagtgcagctgtaattttgtaagaaaaaagtgttgtaaacttgtaccccaccagttagcgtcaaagcaaaagttaaaatttgaatttttaacttgattcgatattttctgagtaatttcttcttatttttggcttgtaaatcgctacaaataaatatataaaatactgtaaattaacataaatggcgaaaatattgtacatcacacaagcgtattctcacacgaatttgtaatcgttccagcggcacgcgctgccgcctccatttcccacgctaccggcaccgcccaccgccggacttcctcacccgcggctccggcggcgccaccgcccaccgccggacttccaccgcccgcccaagtactccctctatgcccagcatcggcgaacttctcgacccctcctcgccctcaccaatcccgctcctccccccaccccctacctcctctctcctcgtttagttgagattgcttaccctgtttgattcttcagtggtatgatgtgtagatgtagtccggatacgtgcagcgggagcgcgggcggagctggagtatggccaatctagagggcaaagggaggtaaattaaggtatagaatttcagttttatccattacgcctatgctttgttttccaattcatactcactctcatgtgcaaactaaccaggatctggtaattggaacgatccccattcctgcagactcatagtgtgattcattgaatcaagctaacaaactgactgaaaattacctcatcagtgctgagtctagatcataactaactttatacagaaaacattgagttgtacaacatgtatgatgtatctgtatcaacttgttcaatctcggttaactggaaccaatttatgaaaaggtggttatcacttcccttaatctctgctcaggttgttgttttcaccattttccttactgtagatcacttggtgttgtgcattcccgttctttctgtatgatgatcaattttttagactaaactcaggtccaagtctcccaagtccactaaagacttgactaataagtccatccacaatttctttctgtcagtttccttgactgtcaaaatactactccctctgtccctaaatatttgacgccgttgacttttttaaacatgttggaccgttcgtcttattcaaaaaatttaagtaattattaattcttttcctatcatttgattcattgttaaatatactactactactcaagttttttaataatattcacaaaagttttttaataagacgaacggtcaaacatgtttaaaggagttaacggtgtcaaatatttaaggacggtgggagtagtattcagtagtttacacttcacagggtctaacaaaagccattccctgcttagaattgccagtaggtttcttcagcatacaattactatctcatctcaaggaactgcagtagactcttccacctggacaatgttcccacatattctcttcctatccctgctgctcttggttcctgaagaccccaattttgccgctggagcttcagccaatgagtcattcattactttgggatcctctatcaacacaagcagcacccagtactggtcctcctcttcaggccgctttgcgttcggcttctatcccaacggcgaaggcttttctattggggtgtggcttgtgattggtgtgtcaaggacaattgtgtggactgccaaccgtgatgagcccccaattgctggtggttctatcatatttgggcatggtggtgcgctccaatggtcacgaactccatcaactccaggtagccaactgaaccccatatctgacagttctacacctgctgcctctgctgccatgttgaacaccggcaactttgtactgtatgatatgaacagacaggtcatatggtctactttcagttttccgacagacacattgttggcaggtcagaacttgcgtccaggcagatttcttctttcaggtgtctctcagagtaatcatgccagtggcaagtataggcttgagaaccaacaagatggcaatcttgtgatgtacccaacaggcaccattgactctggtagtgcgtactggtctacctggactttcaacatgggcctcctcctcacgctttccttagatcctaatggtaccatatggatgttcgacaggaaaaactcctatacaaagatactgttccatgccaaccagccttccaatgcctcccctgatatggaaatttactatcgtctgacatttgatcccgacggcatcctacgactctactcacatgttttctttaagcttggcagggcacctacaacagaggttgagtggcttgagcctggcagtgatcgctgccttgtgaaaggtgtttgtggtccgaatagcttctgccatctcaccgtgactggagagacaagctgctcttgccttcctggttttgaattcttgagcactaaccagagcacacttggttgttggagagcattgccaaccggtggctgcgtgaggaacagctctaacgatgagacgagagtgacaaccacgatggtcgaagtgaagaacactacttggttagagaacccgtatgctgttctaccagccacaactagtattgaagcctgcaaactactttgcctctccgattgtgcttgcgatatcgccatgtttagtgattcctactgctcaaaacagatgcttcccattagatatggcaggatgcctggtaacaccacactctttgtgaagatctacacttaccagaccatatccggtactcgccaaagggctatgagtatccatgcaaattctgcattgatatcaggggtttccttggccatcttttctctgtttgtgctattagtggcatctctattacttatctgcaggcatcggcgatcattggcgcacatgacgatgacggcaccacggcaagaggactccaggattgatgggaacattgttggcctcagatcctattctttccaggaactagatttggcaacaaatggtttcggcgaagagcttggcaagggggcatacgggacagtattcaaaggtgtcgtggccgacaccaaccaggacatcgctgtgaagaggctcgaaaagatggctgaggatgggcagcgtgaatttaacagggaagtgcgtgtgattgcaagaacacaccaccggaacctgctgcgattgcttggtttctgcaatgagggcattcatcacctgcttgtgtatgagtacatgccaaatggatccctggcaaacctcctctttcactcagatgcctcccctgcctggagcaagagggttgcaattgcactagatgttgccagagggttgcaatacctgcattcagagatagagggcccaataatccactgcgatatcaagccagagaacatactcattgacagtttggggatagctaagattgctgactttgggctagcaaagctactgattgggaaccaaacaaagacattcaccggcatccgaggaacccggggctatctagcaccggagtggagcaagaacagagcaatcaccgtgaaggcagacgtgtacagctacgggatcatgcttctggaggtcataagctgtaagaaaagcatggatctgaagcgggctggggaggagtacaacatttccgagtgggcatatgagtgtgtgatgtttggtgatgctggcaaggtggcagatggtgtcgacgaagctgagctggtgagaatggtgaacgtcggcatttggtgcacacagagtgaacctgtgatgcgaccagcgatgaagagtgttgctcttatgattgaaggtgccatcgaagttcaccagcccccaccccctgcatcatattcgcagtcactaacatgagctgcaagcataattctgagtaagtaaaaggcaaaaaaaaaagaggtctacctgtaacatttttttttaaaaaaaaaactgttgataagcagagtgcaatctgaatctactgaatagatccagagtatatgagaagtggcacttagcaaaaggtgtgatcagaagaaacctcattgattgtgtaaagggaaaaaaacatttgatagcagatacccattacagaacaactctttgtcaacaggcacaaaagaacctagctaattttttgtaattttaacaattataatatttcagactttttttagttgaaatgtcaggtcgtttgctgatagaaatccttgtttaatttgcagaaaaatgatgaagtttgcttgaagcgctgcaaagtacagcaagggtcgtccgtctatcaccagttcaaatacatgagcttgcatcatggaacaccctgaaaattgacaaccaagtcttttacattatgcagctataagttttacattttgatcggtagaatgctatggatggcataagtacaggaacggtcctagcagatgctgttatgctagaagtctaatagatcatttcagtgcaggaaaatatatgatgaatcatgtactctgtttctgatatggaataaagtttatgagttctaaaaaaaaagtacaggaacggaaatccattttcgtctgcgatggagccttgatttttagttaactgccgtgttcgcttttctgatcgcgcaatgcatgttggattgttctctgaatcgttgtaaatacattgctgcattctatcgtatcaaatgatttgaaactatgtactacctccatggctctgtcctagaatatatatgaacttttaactatagatttgaatatgtacttgttcagatttatagtcaaaattattatattttgttacggaggtagtttgaagtaaatgattttgatgtcaagcaaatcaactatttgaagtaaatgatttggcaacaaaatgaaacgatgagaagtcccggcccaccaatggttactggatctcaggctctcagctactattcgtgactcgagttcgtgatgggccgagaccatgatcgctaccaatggtagagtgatcggcacagcaccatcgaaccaaattgcccaaacgccagaacgaatcactctgatgaatagtcgacaaaaaaaaagtatcactccgaaatccgaatccacgatgaagatgaatttcattagtccacaaaagtatcactccgaagtccgaatctacgatgaagatgaatttcattagcccacaaaagggcattacatcagactttacagaaagaatcgattcaactcttctcattagttattacagatcgatcgatcgagatgatcaatcgagcaatgcatatcttcatgcatctcagttgatcaaacaaacacctaactaattgattgatacgtagtacatagtacatgtctaactaaacctgttctctgacgaaaaacactgcactacttagtgctacagccgctcactacacctcaatcaaaaacttgtttcatttaattagggttcgagccaagaatgtcgtcgagggtttctccggaagccagccgctggatgatctcctcttcgcccatgcaaggtccgttcgtcgtctcgatgaattcgtctccgccgccggcaacctccatcgtcggagcccacggcaatggctcgtcgttcatcagatacctcatgtactgctccgtcgtggccgtgtcgaattccactcccaaactgtcgtccatcggcgccgacagcaacgcatccaggtccaactccggcaggatcgccggctgctcgctcccggcctcctcttgccgcggccgcgcgctgggcggcgcctccgggtgatccgcgccgtcgtccgccttcctcttcgagccggagcatggcgaatcggccgacttcgccgccgccgccgtgcgcgcctccgcgcagaccgcgcgcggcgagcggtagaccttgcagagcacctgcttgtctgctccgtcgatggcgtcgtcgtcgaggccgtactccgtcatgcaccaccctagcctcgtgaacgtgcgcgccgaccccgacgacgacgactcgtagacgccataggagaacttctggaggtacccgacgcggcggccatcggcgccgatcacggccttcttgccgccctccgacttccacacgctctcgccgccgccgccgccgccgaccgcgcgctgccgcctcccggaggtcttgcgcttgctggtgaagcgcggggagcagaagaagtaccagacgctgctgctcccatgggtgcccggcgccggtctgtgctcgccgacgagctcggccggattggcggagtagacgtcggcgtggttgatgaggcggtcctcgaaggggatcttggcgatgctggggcggaggaagagggtgatgaggccgtcgtcggaagggtggaagacgtagcctggctcaagagcgatctcgtcgtcgtcggccatgtcggcggcgctagctctcgcgttgccctagcttcacctcgatcaggggagaatctgaattgatcgaggagagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggttttttttttttttttggcgggaatgcggtatttgtacgcgtaagacgagtatgatttactagtttgttgcaaaatggtaattagcccatcgaatttatgctttttctgatgggctaggcctgggacccaattccgtgacgggtgaggcccatcactgaaacgtcgtgatgcggctaggcccaaatttggacagcgtggccggggtcgtgacatcatcaggttcaaagggggttcggagtttccatcctccgaacccctttgacctctttttctctccaccacatgaatgcctttgtttctctggttccttctctgaatttctctgctaatgaagctcaatcaagttatcatgcaccaccattgaactactaatcttctaacacgcgtttattatcgatcttgccaaaaccatgttcatgcatgctctggccattcagcgtctgctactgattgatcatgcagtacaactttggtcccttctctgaaatgttaccatttttcttctgatgaagcgtacataccatgcgttgcatgaggcaaacattcattttctgcagccggagctggagagtagctcaagtcgtgacgccgccaggttcggagattaaagctccgacccctattttgacctcttttttccggccccaacatggatgcaaaatgtctccttcaattcagccgcccatggctctcttgtccttatcatgcatgtatggccacacatggtgaagaaatcgatcgatagaatcaaattcacgagacattcagacatgttggaattaatagatgggctaaggccaattcaaagattaattctttagaaaatcacaaaagcccatctcataagatggtatgtatgtgagtttaataccactttgcttattataggagagggaacctccttaaaagggaggatgccctcctagccacttgaagcatgtgtggtggagagaagaggggggaaatacacgcgctcgccctgtctcgcagggcagggttgttttgctgcgggaaattcggatttgttttgttttggaaacattccaaaaaatctggtgcgtgaaaacggcatggagttgcgcgacttatccggtttgctgcgggaaattcggatttgttttgttttggaaacattccgctgcggaaaattcggatttgttttgttttggaaacattctgaaaaatccgttgcgtgaaaacggcatggagtccgaataagttatgcgcgacttatccggtttgctgcgggaaattcggatttgttttgttttggaaacattacgaaaaatccggtgtgtgaaaacggcgtggagtccgaataagttacgcgcgacttatccggttcggttacgcggagtgaagatcatgcgggcgccctgatcaagcgacctatctctatataaaccgagtcgctgccttcacgcaacacacacgaaatcaatctagggtttgcctcctctgtactgcgccgtcgctcgtagactactacatcccgctcgccggcgtgcaccggcgatcgggagagcaggtctccggaacctctgccttcgacgtcttgcaccgggagaaggcggcaataagatttttgggaagcgcttcgcgcgactgctccctgttcgtccgtgacggctcgccttcctctccgctcacgtgctgcacgtcttcatcgacgcccgcaaccacgagtagttcctgccgagcaaccggtctttccgccacctcgatacgtgttcgacatgttgcgcatatttgatctgttcatgttttactacttagtttacatgtgtagatctaatgatgcgttcaatctagtttgcatctgaaatgtaataaattaaatcattatgtgcttataatttcaacaagacattcacaacattaacagtttagctgttagatggaatcggcagcataatatttacatgggtattactaccgctgcgtattttgccacaggtagacaaatcaagtgtgcttggcgacaagagatttgctattattgcagagagcttagagctccatcaacatggacaaaaatacagcaccggtatagttcatgaaaggtctgtttgctataaacagatccgggataacaatgtgggggtaaagtacggtctggatttcccaagaacagatccaggattttcttgatacaaatgctctcgaagctctacatgaaaagcatcacaagtgatccataagcatatattagacaggcatatgctaaaagaatatctactttttcatgcactatgtcatatgggaagcctatgtttacaatgtacattagtttcagtacgggcaagccaagaatattgtgcaagtacactccggtttcatgaaattaatggaccaaaatattttttttagttgcgccaataaataaatgcatgcaaccttaatatcttgttttattgcgcaaatcaagatgagcataacaatatactgatatgtccacacaacagattgcatagtattaatctcttgcctatcacatcaagtagaaaatgaccgcttgcgcttctgaacatcaaactcaacatcaatgaggccggttataccagctttgatcttctgtcctggtcgtactgggcctacaccctcaggagtacctgcagaggaattcattaataacccccacaatcacaactctaatgcacaacaaactgttctccaaaaatgtgatttaccggtcagtataacatcaccctccattaatgtcatgatggaactgatataacttattagagatggtatcttgaatatcatatcacttgtagatcccttctgcctaagttcatcatcaacctggacaagatttctctatgcttgttaataatttgttgtactttctacttcttagggggcaaatgaatagattcactacatgcctacatatttgtatagttacctttagccagagctctagatcatcaggattagctacatctgattttggaatctgttcaatagagcaagaatcatcaaggaaagtcaaatgcattggatgcagcaatggaattatgtagttcatattcagtagaatgacatcggcagcattcagagaatacgatccacgaccaacaaaaggagatgccaatctgtaactagtatcctgtggttcttttcatatgatattgactcaccttttccagcattctatgatttatttctatccattaataatcataaagattactggtgtatattccgtctcttcagttatccactactttgaatatggtacttggaactatttattacaagcaaatacatggaaatgaaaaataacgtgtcgagtcaccacctgaaccagtttctttaagcaagagaacacattgcttaccactgcactaattggagtgaaggtgtcctgtgctttacccaaagtccaaggaagacctgcagactacagagtacattggtttctaagtataaaacatagtacaagactgaaaagttatcttacattaagaaactatgtgattgattcatacaagtaccaaggatacaactgccaattagttaccatgattttgcacaaaaatagttataaaaaacattgtgtgtatatgatcaaacaagatagtggtaaccaaattcaaaagaaacaaatagttcttgttctagtagcttatacaattattagttgatatgattgcatgaacataataaagaagcagctactgagattatagtgtgcagcttgttgctgaatttcttttatcaatttgaatgttatgctcttatctatcctctgaaactaccaaggatgatagatggcaataaggtgacaagaccaaagaaaactagggcagctagtgcacaccttagccgcagactgaagttctcttgctgtcatgtccaaagcaagtgcataacctgggaaatccaaagatataccattagttataattgtactttgtcactgaaaggggaaaactgaaaaccagtatagctttttgttgactcgtagaacccacattaacaaatactagcataaaagaaagagtaatagtgaacaatctgctacttactgtagcataatttggtattgaaccaaacaataagatcaatttcactaccatgattatttagagaacatgaagcaaccaacgataaaagaaaatgtgactatgttaacgaatactcctcactaatgagactttcatgagcctggtcatggcaaaacaggcattgaacaagcagatggctaagagcttaaaattccatgtctgaatttttctaccaagcctgtcaaatgtatatggacaaagtttaccggaattgctgaaagagtgaaatttatatgtcctatagttgtccactttcagtctaagtctctaaggcctgctcaaatagttctgaatggcaattccaaggttctagtacgtagttttcacagaacaaagcatatcggcatctcctattcggatttttcggtggaaatcatattttgatttatttaccaaacttgtgattttcttccatgatcagggatatagaagtatacaactcatcacacaactaatcagctgaaaggatgccaccagtttagattagatccattttatcacagcacatcctagattatcaattacctcctacgaagtccatggcggatgcttcggggacgtcgcgcgcgcgctgggagatgacaacggcaagctcgacctcgtggtgcagcgactcgaccggctccggcacctcgatggcggcgccggccacgcccgcgtggaggaacgacgaggtgggcttcaggaacagcaccggctcctgcaaccagacgcggcacgggcaccaccgacgccggatcagggcaccccgcgggaagaaggcgaccggagaacccaccgccgccagtggtggttcgggattggagagtactgtaccttggggacggggttcccgagctccttggcgtgggcgacgaagttgcggcccacccctacgatcttcgtgctggccgccaggagcctctgcgccgccgccgccatggccgccggaggagagctgcgagcggcggagggatgcgtcgatcgaggaggtggaggtggtggtgacggggaagaaatggactccagcgcatggtcaagtgacaaaatatacggcccataagacaaaaaccggcatatcatggcccacaagacagacacctgccttcctgtgtcaaacttttataattttgacaaagttttgtagcaactcttgtaacaccaaattagtttcatcaaacctaacattgaatgtatatgttgatagtacatttgtttggtgttgaaaattttactatatttttatataaatttgattaaacctaaaaaaattgacttaaaaaaagaaaaagaaaatcaaaagtggtagtataaaacggagggagcataggaattagtttataggcatcctagaagctcttttaaattcattcagacccttgaaatttcattgtttgccaagatagccaaacttggcattacaaaagctctgcagcattagccaaacacagcatgacaaaagaaccacaccatcagcctaaagcattacatcctttattctcttgaaattattctttacagcagtaaattatctcacaacctcgatgattttggagaagaaacacccgtattgaacttcttgatgtagttatagatgtgatcactgatttcctgtgctctctcctgctggatgaagtgcccagcacctttgattaccactacttcctcaagcataggaacatctttcttcaacctacccttgtgtatgtagcttttgactcctgggagatggtaagccaggtcaccatccccgacaataaactttgttggcactagaacttttgcacctgtccatggtgccatcagctcccaattcctgtgcatgcaggtcagaggttatgagttcctgctacataggattatatgatcatatcatgcaacccacaactgcgtatgttgatgcagttctcaagtccatgggagtgcatgcttgtgatcatgactggtgacaaaatattcaatatggaaattactgaataaataatctgtgtagttcagaacagatttctatatttaccataagtgttttttttcttgaatacgcaggagaattgcgaatcatcattatattaagaagaaggaaaaggaaaaggtcccgacaaactacaagactgagaaaccaaaaagacgcacagcacacggcacacccagtcacccacccatacatatccaccctcacaaagtgttatgcaaacaagaatttcatctctccgagatctgttaactgcagttcatataggttgtgagctcctggttaaaaacacacaacagatgctatgatatctcatagtagtatagaggtattgaattggacaacagttaattccaagcaacaccattatctaaaaaaaaaagttaattccaagcaacgtatgcagtaagacaaacaggatacacagcaatcagtgacaacaggtaaatctaaaggaaaaaatgtgatattgtgcttcatgtttctctctctagtaacctgtcagggagttcaaaaactgtattgcaacgttaaacaggttgtatgtgtgtcttcttttggatagaatttaggtatctggagaaaaataattcgagtgatttgacatgtatgaattctgcacacaatgatttggtaccttaaaaatggcatacttacaggtcaaaacatcggtagtaattaataccaccagcgaagccagtttttgcatacacacttgctacataactgatatcttcctcagagagccaaggaggcaatgttacttccctgttgtttgcccgcatttttttaatggacatagcagaagatcctgttgtttgaacaatcaaggccaatttgaagaatctcttcaagtcaagactggccaattctttttcaactccaggttcctggcagccaagatgacacttgtgaaggcaaattataaaaattacatgactgagagtccgaacatggttcagaaacagttgtgaagcactgacttcatgaggacaaaacttgttcagaaatgaaattattccacatagttgtgcaaaattgttgttgtttttctaagcattatttagtatttactcattagcccatgccaatccatttagcaaactatgtatgattgatatttcatttcaatgtgtacgcaaactacaattggagctgctcacaaagaggaaaaagggcttgcggcacgactatattacattccccaaagatcaattgacaggaaaatttaacaccccagcctagcacatgcacaaaaatgaaatttcctgagtatgtctatgttatgtgttcatctatatgactagtgtgttaagatgaagagcagatgtgagcaccataccactggtaagatactaaaagacttctttttgaaaataagtattcatagacacaactcacttatccattgcaatgaagtgaactattcactaataaacaaaataagcacaatcattctcaaattagttgataattagtggatgatagacatttgggacggggatttagctttaattcttcgattattaaacagatagcagtcgattggccatttctgtggcctacgggaacaaattgcgcacctggaatcggcagacatagtaatcatcgccatacgcgccgcggaagtagtcgaggggcttctcggcggggcgcctcggcatgaacgcgacgctgaggttgacaagcgcgcgcacccggtcaggccgcagcaggcacaggttccacgacacgatggcgccccagtcatgccccaccacgaacaccttcaccgcaacaacgcgcgacgcgtcatctcagcgatttgggggcggaaaggggagagggggcgcgtgctttttttttacctgggggagctcgagggcgtcgaggagggcgacgaggtccccgacgaggtggaagatggtgtaggaggtgtgctccggcggcgcggtggtgccgccgtagccgcggaggtcgggcgcgacgcagcggtatccgcgcgcggccaggtgccccatctggtggcgccacgagtaccacagctccgggaacccgtgcacgaacagcaccgcgggagcagtgccgctgcccggccccgcctccgcgacgtgcatcgagatcccgttcgcctccaccgtccggtgccttaccgccgccgccgccgccatggtctcctctccactccgtcgcgcgacgcggcgacgacgtgcggtgctctgctactggctgtgaacctgctgattacccgaggtagttggagatagttgactgacatgtgggtccagtttcctggatgggccgatgtgatactgggcctagttcctttagtttccaaatgcaaagtggcccaggacggatagagcatttgcatcgcaaagcatggtcaattataccaaatcaatgcatcatccaaacattgggaagaaaattacacaggaattcagtcttttacttatcagtaggactttgcttctttgcgtgacagctgtataatacgaatctcaaagcaacatgtcttcatccctgatttccccagagacttgacttgacgagtaaacgcgttctcctgccgccgccgcacgccagtatccttggcggtgccccctcgcttcggcccttccttgcgtccttgtgggctgtggccctccgcgcctctcgtcgtggcggccagcggtgctagcggcagctaagtggtttgcacgtgttgaccagccgactctttgttagactaactttgcaggtagtggggattatcacttagttctcgccagcacttacgttgtcaattgaaaagaagttcaacagctaaaagacaatggactaggcatgcctataagacttcaccatggtcttggtgatgtgcttctatgatctcgtgatggcttttctctggcagacaatgggtaggcatgccttcaggagttaggtccttgccatggaccctgttggaattaatagatgggctaaggcacattcaaagattaattctttggaaaatcataaaagcccacctcatgagatggcatgcatgtggagtttagtaccaccttgcttattctaggagagggggacctccttaaaagcgaggatgccctcctagccacttgaagcatgtgtggtagagagaagaggggaaacacgcgcgcgctcgctcgcctggcagggcaagcggcgcgcgtgcacgacgttactacgcgtcgaatggttcgaaaaattggctcctcacccttgcggataggttacgcgcgacttatccgaatttgttttgttttggaaacattccggacggttcgaaaaattggctcctcacccttgtgcagatgtagcctccttgtgaaaacggcatggagtccggataggttacgcgcgacttatccggatttgttttgttttggaaacatttcggacttatccggatttgttttgttttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacatgcgaaatcaatctagggtttgcctcctactctgtactgcgccgtcgcttgtagattactccatcccgctcgccggcgtgcaccggcgatcgggagagcaggtctccggaacctctgccttcgacgtcctacaccgggagaaggcggcaataaggtttttgggaagcgcttcgcgcgactgctccctgttagtccgcgacggctcgccttcctctccgctcgcgtgcttcgcgcctttgtcgacgctcgcaaccgcgagtagttcctgtcgagcaaccggtctttccgtcacctcggtacatgttcgacatgttgcgcatatttgatctgttcatgttttactgcttagtttacatgtgtagatctaatgatgcattcaatctagtttatatctgcaatgtcatgatttatttatggaataaattaaattattatgtgcttataatttcaatagacccatggtcggataagatgttggtctcctgcagaaggaggaagagaactcatgaagaaaagacaatgaggaattggagaagaggaggaatcatgctttgagatttggactggacaggtgtcaaacaaataaacaaagtcctaccgatgagtaaaagactgaagtcttatgaaattttcttcccaaacattgaaatttcataggaatacggtccaaattacaacaacatttggtcacatatacgttgacactgattggcacacacgcttgtttgaagagtttttttttttgttttttttttacggcgatgaattgcatctgacagttgagttgagttgagcgcttcagttgggttggggtatgaacttggtgatgaagttgtagataaggtcgctgacctcctcagccctctcctgctggatgaagtggccggcgccggggatgacgacgacgtcctcgagcagcggcacctcggccttgagcccgcccttgtgcaggtagtcctggatgccggcgtagtggtacgtcaggtcgccgtccccgacgatgaacttggtcggcacctgcaccttggcgtccgcccatggcgccgccatctcccagttcctgtccatgttgcggtagtagttgatgccgccggtgaagcccgtcctctcgaacgcggcggcgaagtagtcgatgtcctcctccgttagccaggccggcagcggcagcggcggcggcggcggcgactcctcgctctccggcttgccggccttgtggacggtgaagcggttgcacagtgtccgccttatgatgtgcctcgcgtgcgccggcgcgaactcctcctccgcaacgccaggctcctgcaaacagcaacaattagcggccggtattgggccagattatcctgtgcaattgggcctcataaatgggccgccggcccagagaggatgaaaggtaagtggtctcatgtatggcagtggctgaaccgaccagaggtgatcacgtacaagaatgtagtagtaaaagattacctagagaatcgatatctttcgatgagaaacggaatggccaagtaacctcagggcaagtaattagggcttaatctctcaattccctatttcggcttgatttgctccctccctgcacctctataaaatggcacgcacgtagtgctcagttgatcaatcgatcagaagcagatagagctttctgttgcgtcaatggcggagatcatcctgaacaaccactgcgagggctgcgcgatcgacatccgcaaggccgtcgagaaaatgttcggtaagaagctagatgatgtgtgcagtgccagtgcatttttgtcatggcgatcgatttgacattttgggctgcgtgcgtgcgtgcgtgcgtgggggtgcaggggtaaagagggtttgggtggacatgtatgggcggcgggtggtgatcgccggccgaaaggtcgacgcgacgaagctcagagagcgactcaggcggaagaccggcaagtcagtcaccatcgtcagcgacggcacgccgccgccgccgcccgacgacgtcccctttgtcgggatgatgcacctggcgccgtcgccgccctactacccattgcccgcgccgcctccgccgccgccgccggggagctacctgtacggcggcaactacccctgccagaacccgtaccaccagtacgttcaaggaggcatgccggcgcgcttcgtcggcgacgacacctacgacgacggatgctgctccatgcagtgaccgatcgtgctactaccagtcgtagacgaataacggaataagccaacacgtagtatttcatctactgttccatcggagacaccaacagtagtagcagtatgcattttttttttcttgtactgcgaccacgcactgtaccggtcaggctatcgagtccgtgcaggagaaaatttcgctactccggctggaccgctggttctgatccgtttgggactttgaacaatatttacgatagtattattctactactagtagcatatataaaaaaggttcgtttgcgtctatctgctcacgagttctacctaattttctcccatgctgcatgttgtagtagcttcaaagtagaagaaatatatatgcatatcattcgttacttattataagtcgtttaatttttttcttagtcaaacttcttaaaatttaattaaaatataaaaaaatatagcaatatttttaatacaaaacaaacatattatcaaactatattaaatttaataaaattaatttggtgttataaatattaccgttttttctataaatttgattaaatctaacgaactttaattaaaaaaataaacagtcgaatagcttataagtatataatatgaaacggaggaaacgataagtacgtagaggaaatggcagaggatgaggttctgtgtattgaacctggaagcggcagatgtagtaggtggggccgtaggccttgtggaagtgatcggtggtcttgatggcgtcggcgccggagcggatgaagacgtggcgcatgaaggcgacgctggtgttgacgagcgccgtcacgcgatccggccggaacaggcacatgtaccacgcgattatcgcgccccagtcgtgccccaccacgaacacctgcttcaatccaaaaccagatcagatcagatcagcctctaagttttatttgcaacagctagtagaaaatcttgtaaataaaaaaaaattcactagtagtgacgaattggcatttaattattagtagtactctagttctgcttgatttgattaataagttccaagattttcagtactgatctgcttaagtacatagcattgacagattagtcgtggagtcgttggatgatgccaatcaaattgacaggcaagccacggcgtcacgttgggttgggatatgcccatatttttttttcattccgtctacccattgttgatgccgccttcagtttgaactttgaaccgtatcgaagcactatcgaacaaaacagtcaacttctttgcgctcacatcacaaagccaaatcaaccaaaagcaattttaaaaatggcagccttttcattcgctatccatgttcgacgcttctagggatcacgtattttattttatttagataatgatcacatattcgcatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctcgggcggcgcgtcggtgtcgccgtacccgcggaggtcgggggcgaggcagcggaatccccggccggcgaggtgctccatctggtgccgccacgagtaccagagctccgggaatccgtgcaggaacagcaccgccgcgccatcgccgccctcgccgccggcctccgcgacgtggatcgagatgccgttcgcctccaccgtccggtgcctaatgaccgccgccgccgccgccgcgccctccatgctctctagctccttcgctttcttctctcctctcctcaccggcgagctgatcgatcagcgtgtgtttgcacacttcgcgtgcgaggtgtgagctcgtatttatcgtacgtgtggtgccccctgtcgtgttgacaatgaagaaggtattgtttagtttcaacttttttctttaaactttctactcacttttctacacatataaacttttaatttttttatcgtatcatttcaatttcaaccaaacttttaattttgctgtgaactaaacacatccgaactctcgtgtgaaagtggataaaccgagagagagagagagggtcacgtttgaaaaaaaagaaacggtggcgaagtgtggctgtgcaagcgtgtgacgtggacgctaacgcacgtggcgcgtgggaactggcccccaggaaaacggcgaccggaagagtgtgatcatagcggctgaactattttctcaaattaattttataaaatttaatatacttcgatcaagctatttctttaaggtggcatatcatgtaactatacagatttaaggtgaatttcttattaaactgtagatttaaaataaggtgtaagataaataaatatcaagtagcaaaatctcataactataagtttgttagtgtcaatttaatcataaaattaccacgtttataactccaacgtaatggtaattctagggaatttaagctttagaatttatagttctatgataactccaaatttattttgagagcgataacttcaattttaaatatgtagttttgtaatactttattataaatctatagttttgttataaaaaaatagttaaatttgtaagtgtataacatgataaatctataattttgtgataattcgtttaatatattatagtttttgaaatttagtcctttacttttggatgaaataggaaggttatattgacttggtcatggcctgcatcaatttcagtagcagtagagtaggtgcatccacgatgtgcttgaaaaaagcgataccccatcaacatgttcaataatacatttatataagtgctataaatcatattgttgaggagagatcctcaatagcggggaattgtgagaccccccatttgtgatttcggccgggggcggaggctcatctcttgaaaatcactcgctcgtccctaggattaccggcaagcttgcacgcagtcggattatacaggttcgggccgctatggagcgtaacaccctactcctgtgtttgggattatggatgagttttacaaagatttcttcactctagaaagcgcactcgcttcctctcttctggagttcaggttttctaggcgtcctcctctgtctcagtgggcagggtcctccttttatagctcaaggggataccatatgcgccgcctctacctaccctctatcggagggggatcccactccacttttcctgggctttaaaccgtgccttctcccggaagctaagcaacaaccggttctcgagtggaaccaggcgccgcccccgcctgacacgggggacagccctgtcattccctcataaatgaacgatgacctgtgacagcccttcctcgagtgacgcttggacgtgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctgtcacgcccggaaattcactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctaagacattgaaacttgaagacatttatgtggtcaacttatggaggtcagtcaagtggatcgaggaaggaccgaagtgccaagtggtcaagatggaatgaagtttggatcctaccttagaacctatgccgccaaagtgtccttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtggaaacaataacaatgaagggaacccaattcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactactaacccagtggaagcaggtgattggttgcacactattgagaagaagttggaactgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctccagaagatgtgcgtactgacgaagaaaggcaggagaagttcctggaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagccagaggcagcatatcaggccactccaaattggtgaatcttcttccgctggtcaaggacagtcgcaacaattgaacatcgctggtgagatcaaatcagagactaatgaaagcaatgatgttaacatcgagcaagctaatcagccggtgccagttcagcaggaccagtctcaggagaataacactagtggaagggagcagcaggtatgtttcaactgttacaagccaggccactttgcaagagagtgtccgaagccgaagcgtcagcagccgcaaggtcaggtcaacaacattgtcgtcacaggagccaatgcagtgccagttgcgtcttcaagagttgcgtcttcaagtgttacagctcagccactagtttcaaagcagcagtagttttctttaaagccttagaataattatctgagttatggaataataagatagactacagtttacctatgcccttttctttctagccgttccgaatctcgggacgagattctttgtaaggggggtagatttatcacatcctgatttttgtttcaggatttataaattatttaataaattaataatagaatttatgttaaatgatctttaatttacaagtgaagttaaatgtgggaaataaaatttccttaatataaagcatggatggatttaatttttattaaattctccatgattaagtcaactctctgaaattttctcggatttttcggagctcaattcctaaatgatacaaagaacagttcagtaattatttgattttaatgatctaattatatttgttaagagcttttcttgtttaaaatccttaaattataaattgttgtttaaaaggaattattagaaatgattttaaaagcctagaagagaagatctaattttaatctgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctcctctctctctctctccccggcccagtcggcccagctcgagccgctgctctcttctctctctcggtgccgctgacaggtggggcccacctgtcaggcctgtcttcctcctcgcgccggccgccgctcgaaccctagcgccgcgccgccgtcgtctccttccaaatccggtcgatcctttcccgatccggtgaaatcaatagaggggaaatgatcttctcgatctcctcttccttttctcttatggaatcatcgcctaattcggtttggaaactcgtggattcgaggtcgaatcggatcggtctctttccttcaaaccccgatctttccttcccgtcgccggccgccgtgggccttcgtcgtcgcctcctagcccctttaaaaggttccccgagctcttctctacccgccgccacctttgccttcgcctctcgtcgtccgtagtgccctagcgccgtgtagcttcgagccgccgtcgtcgccgccgctccagccgtgcgccgccgtcgtttcagccgtcgtcgtcgctcgggaaggtcgccgtcgtgatcgtcaagtcaccgccgtcctcgtctgcctcttcgtcgccgccggagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgtcgccggtggtgacgtcatcgccgacgtcatcgtcgcccttccccgtgagccggtcgtggaccgttcgatctcggccgtccgttttggataggttctatctcgaccgtccgttcccgtgaaccgctgccgtgcacccggttcaccgcaaaccttagccgctgacgcaataatcctcttttccttttcaaaaataattcattattgcgtcataattcaattaaaatccatataagtgttttaatccgatttaatctttgaaaattcataactaattcatttcattgtaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattgggataacttatgacttaatattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatggttcattgcggatcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctttgtggcttgctgagtatgtcatatgctcattcttgcaataatcaatcaacctcagttgaagaaaaagaatccagaaggagaagacgtttggcttataccccagttgagctgcctgtgggagtggagccggagcttcggtagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagtttggaaattactagtgaatttccgggcgtgacactccctcctccgcatggcagccgggtgagggcctcggggcgaacccgcgggatagcccgagggggtgacgccatgccccgagccccccccggccgcttccacgactcgcgtgacgcgcgaatggggctaacttgcaaagtcacgtcgccggagggaaagtaaccctctacttcacatacccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttgctcaacttgcgctcatagccgttgtgcactccacctcgagtgtgccactgacagacgcactaaaggcgggagcggatacaacgggcgacgtgatgagtgggcgcaggatgcgaagagacaaatgcgggcgcgaggatcgtgggggcaagtatgggagcgcgaaacgaggaggcaagtgcggatgaagcgaggataaaagggggcggaggcagagactctgcccccttcctttcaccaaccgcccactcgtcctttcgcttctcaaaccctaacattctcgccacctcatactgtctcacgctccacgctctccgccggttgccatggcccaagacaccggcgacgcagtgctcccttcctcccgcatcacagcagacaggcaccttagccttccccgcaagatcatgccggacggtgccgtcgtgcgggcgggagagtcgcggccacggccacgatatccggagcgatccatgcacctcttgtccttcgccatgacgggcttgattccgccgttctccagattcttccatgaggttctggatttctacgaaattcatgccttgcatctcgcacccaatgccgtgatgacgctggccatcttcgtgcatttgtgtgagatgttcattggggtgcgaccgacgatgcggttgttccaggccttcttcattccgtagcttctgcaaggcgcggtggtggggggatgctacttccagccccggccaggcacagcgggtcagtacatcgagagcaatctccgcaagaaatgggaggactggaataaggactggttctacaccgcgttgccggaccatccgcgacttcgagttcccgctggccctcctgaaaggtctgccgcatggctggcgacttcggagctgggcgaggaatacgacgcggtgtgggatcgccttaggggcctgcggagcctgggcctcacgggggcgatggtctttggcgattacttccgccgctgcatcgcacctcttcaggaacgatcccgtggagcgtgggaatacactggtcccaacgaccccatgcggacgcatgtgggcgagcgctgggactagggtgaggaggacgcgaagagggtgattcggcgggtgctgggcctagactccgctgagccaacactaatcccagatgggattcttcccctctgctgctaccgtgaccgggagagcattctggccgtgatgtcagccatcgtgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatctttttgcaaaagcagcattcagcaaacatttgagaatttaataaaacagttaagtattaaacaatattaacccaacgctatacaacataccctgttgcataggcccaaccattctgaacaaccatcccggctgcacagttctatctccaaaccaggaatataccattccaaaccaggagctaatcaaattattaccaattatagcatcatttactatggtgagaagtgtgagactaatcacgaaagacattgttagacccgcccataaccgtgggcacggctattcgaatagttttactctgatcagaagtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttataaacaaggcatggactccccagcgacccccgtgggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcaagtaattaattaaccagtcacgattgaccatcatgaacaatcattaagccatcattaaaataatagtgagtcataagttatcccaatagtgtgctaatgtttctaagcatggataagcaatcacatctaatatctagctgaaccaatatataaagctcaactagtcaagttataataacccaaggtatcaaggaataaagtaaccaagaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttgtattgattttaattgaattatgacgcaataatgaattatttttgaaaaggaaaaagagatttattgcgtcagcgggctagggtttcggtggaccgggcgcacggcggcggttcacacgaacggacggccgagatcgacttgatccaaaacggatggccgagattgaacggtccacgaccggctcacggggaagggcgacgatgacgtcggcgatgatgtcaccaccggcgacggcggctcggcggctcgggcgcgcatgctcgccggcgaacggctgcactacggcacgaacggagggcaccaacgggtagagggcgacgcggcgaactcaccggcgaccaaaaaggcggcggaagagcaacggacggcgacggcgacgaggttgaaacggcggcggagatcgggtcgacggtgacggcggtgctccggcggtcttcggcggcggcgaagcggcggacgaggacggcggcgacttgacgatcacgacggcgaccttcccgagcaacggcgacggctgaaacgacggcggcgcacggctggagcggcggcgacgacggcggctcgaagctacacggcgctagggcactacggacgacgagaggcgaaggcgaaggtggcgacgggtagaggagagctcggggaaccttttaaaggggctaggaggcgacggcgaaggcccacggcggctggcgacgggaaggaaagatcggggtttgaaggaaagagaccgatccgaatcgaacttgattccacgaacttccaaaacgaattagccgacgtttccaaaggggaaaaggtagaggagatcccaaagattgtttcccctcaatcaatttcaccggaaacggaaaggagcggccggattttggaaggaaacggcggcggcgcgaaactagggtttcgggcggcggcggccggaggttgacgacgaccctgacaggtgggccccacctgtcagcgggcggacgcgcgcgcgcggcggcggactgggccggactgggccgaggagagagagaagggttttgggccgactttcggcccaaagccaaaagaagactttttaaaacctttttcaatttaaattatttatgaaatgcaattccatttattaaaaatactttcttagctcaaataaatcccagaaaaatctaggaattatagaattaagcaaagtatttaatgaaattttatctggccccattttatattggaatttattaattaaaattagatcgtctcttctaggcttttaaaataaattctaaaaattccaattaaacaacaatttatatattttgaatttttagggtgtgacacatcggcgccggtaggagccggtccagtcgatgcggcgccagcggtagcgccgtcggcacgggtggcggtggtgcgaccgcgggcgggagccgggccggcggtccaggcggcggtggctcaagggcgcctggatcgagccgcggacctggagatgattccgccggtgacccaaaggggaaacggaaggtggcctattcccggccgccctctcccccacatggaggaggtgccgagcgtgcaacggatcgttcgccaatgggccacaagcgacctgccgggcccgaggctggtcggaaaaagaagcggctccggaagatagcacaaacggagccatgccggggggggggggggtttcatcgagcccccaaagtggaccttcaaccgccctccccgtaggtacgattattggcgctcactttggtgctcttacccaacccattttcttgttccttctttttcttttgttaacatgatctaggttctcttgtagcgagattccttctcagggaatctcagggtcagaccccccgcaagggacgaaatctgaacggttggggcagtccgagcccggccaaaccaaggccggggttttcgcagcctcgtggcgggacccagaggacacgcactgggcccgatcccgagcgaccctcaggcgggacccgtcctactgtgggtggcaggggtggcgacgctcctcccgggggcggctccgggaccagggtccacgcggagcaccaccaaggatcgggggatgagggaggtcgcggcctgggagccgaagccggaggtggtcccgagcttgaggttgaggctgggggcggtcccgaggctgaggccgaggctgaggccgggggcggtcccgagcccgagcccgaggccgaggctgaatccacccgaggacccgaagcggggggtgagagggacagccgttcccccttgcgcttggggcgccctcgaggctggtctcgcagaaggggggccgagagcagcccccagtctcgcgggggatccagcagtaccccgtcgtcccgggggcggaccgcggccttttcctccccaactccggcgagtatggagccacttctgcaggtgctcgccgccgccgactacactgtacgagaggggttgaacacccaagttcaagccctagcggaagagcgggcggccctggatgcagagtgggaacagctcgccgcggaccgcgcgcgagtcgacgaggggcgtcgcgccgtggacgacatggtaagggtgggggcgcaaaatgcatcaaacccaactagccaaaatccaggcgcgcgaggaggcactggactccgtcatgcgggaggcggaggaggagcggcaggcggcgctgatcgcctcgagcgtcctggatgaagcgcggggcgatatccgccttcagtacgaggctcacgccgaggacttggcgaagaggattagggacgcgcgcggcatcctcgacgcagccgctgcccacgagcggcgggcatcggaggccgacgcctcgctgcgggcgcggacgatggcactcgaggctgaacgcagggccttggatgatcgtgcccgctctgcacaggagtttgaagccacaatccgtcggcggatcgaggtcctcgatcgaaaccagcgcgagcaaaacgcgtgcggtgaagaacaggcacggcgggcccgggagctggaggagtgagcacgcctgctagatcagctggagtctaccttggccgcccatgaaagaacggcggcagaggtggaggcttcccttcgcctccgtgaagaagccgcggccgagcgtgaccggatcaccctcgccgcgaaagcttccgcggaccgccgcgcggaagagctacggctgcgggaagaggcatgccgggaacgggatgccgcactcgccgagcgcgaagccgaggtgaatcgccgcgaggtagccttgcgccggctaggcgagcaactcgcgaaacgagaggaggccgttgccgggcgcgaggctcgtcatctggagagcgcccgcgctgagcgtgcggcaatatcagcgaaggtctccgagctggaggcccgggagaaggacttggtagcaggcgggccgcccggcggcgcgggtttggcgagccagctcgccatggctcagagtaccctcgccgacttggaacgcctggtgcaggatcaggctggggaaattgcggccctccgcctcaccaacgagctcgggcccgggcaactctccgacaccgtcgactggctggagcacgcggggcgccgagtcggcatctctgtgcgtcgggacagcaaactcccgcccacacagccagcactcgcgcttcggctggacgggctggcggtggacctggaaaggctggaggaggaggtcggcgagaccataaagtcttcgtcagtttctttggcacgggctgcggtggagctggtcctcgcgagccaccaagcgcgcgaccccgaattcatgccgtggcatgcgctcgaggattttcccccgggtaccgaggcaagggcccgggagcaagtccgggaggcggctaacgcgattgtctcaagcttcgaggggtcggccccccggttcacctccgggcttaccgcggacgaggaaaacggaagcgggggtgacgacggcgatgacgactaggacgacatcgtcagtggcgctggcctcggggggccgggcactccgtgaccactcgcgcctttaattcctttttgctgtgtgcccgtagcaggcacttcttgtatttaggccattgtgccatcctatcttgttctgcaactgaaacttctttaacccctcttactcttttgctttttccattggatgcctgtgatataaagagaagaaaaaaccaggacaaaaggggattattagactgcctgcgattgatatgtcgttttgaccccccctctcgggcttgttctagcgagaagataaatccgcgctcggtccatggaatctaagtggtgaaaggcaagaccatcgccccgagggagccgcccagcaggactggccagaccgaggctgcgacgaccgggggtcggggacgaccgtgtgtaggcccttccgatcccccggggttcggcacaacccggggcgcggcccgcgctcgtgctccctttcggcggttttcaggccgtcttacggcacttagggtttagagtaaacgcggattatcccttgaaccgggacaagccagagaaaggggagaaaacggtctccacgaaaaccaaggggttgtgcgggggctggcccgtgctccaggaaagcaaaaaatctcgatgtcatggatagaaacgacaaaggtgctcgatattccaggggttgggcagctctgtgccgtcctccatggttaaccgaacggagcctagccagggcacttcgatcactttgtatggcccttcccacattggcgagagcttcctcagccccaggcgcgactgaacgcggcgtaggacgaggtcgctagcttgtagtgatcgggcccggacgtggcgctgatggtagcgtcgcaggctttgttgatagcgcgcggcacgcaaggccgctcgccttctccgttcttcaagataatcgagatcttcgcggcgaagggcatcttggttggcctcgttgtacaacgcgacacgaggcgacccgagggaaagctcgaagggtaggaccgcttcggcgccgtacaccaagaaaaatggtgtttcccctgtggcgcggcttggagtggtccgatttgcccacaacacggcgggcaactcctcgagccatgaatccccgtgcttcttcaggacgttgtacgtcttggtcttgagtcctttaaggatttcggcgttggctcgctcgacttggctgttgctcttggggtgggcgggtgaggcaaagcacaatttgatacccatgtcgtcacagtaatcgccaaacagctcactggggaactgggtgccgttgtctgtaatgatacggttgggcactccgaatcgagacgtgatgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgatctgtaaggcttgggccggctggtgggtccacttggcgtggaaccggcatgccttgcaccgctggacccattcttgggcatcttgtaatgcagtcggccaataaaaaccttgccggaaggcttttccgaccaaagttcgtaaggtcgaatgggctcggaactcaccctgatgggcgtcggctatgagctcgatgccctgctctcgagaaatacacttcaagagtatctcgttggcggtacgccggtatagggtcccttctacaaggacgtaccgtttggagatgcgcgcgagcttttcagcttctgcgcgatcctcaggatgagtattgccttcgagatatgcccggatgtcggtcatccacacgacctgacgaggggggtcagggttgaccccctcgggccccgaggggcacaggtcgcccggagtcgggtcggagggcgtgtcattggggtccctcaaagggctcggtcgtgccgatggttgcgcgagcctttcctcgaaggtccctgggggagtggggctcgtgccgacgcaacatgcgacaactcgtcagcaattgtgttgtcgcgtcggggcacgtgctggagcttaagtccgtcgaagtggcgttccatgcgccgtacctcgcggacgtacgcttccatttgcgggtcgttgcactgatactctttggatacttgatttacgatcagctgggagtcacccaagaccaggagacggtggatgcccattccggctgccgccctcaatcccgcgaggagcccttcatattctgccatgttgttcgtggctcggaagtcgagacgaacgacgtatttgaggacatccccgtttggcgaggtcagcgtgactccggcacttgcaccttgaaggttgagggagccgtcaaaatgcataacccagtgcccgtcgcgaatgtcggcgtttggatcctcttcttctccagggaggggaaaggggacattagacgaaacaggttcgtccaccggggttcattccgcgatgaagtcagccaggatttgacttttgatcgcgtgccgcggttcgaagtgcagattgaactcagccagctcgatggcccattttaccactcgtccagtaccctctcggttgtgcaaaatttggccaagagggtatgtcgtcactacggaaacccgatgcgcttggaagtaatgacgcaacttccttgaggccattaagacgtcataaagcattttctgggcctgcggataccgggttttcgcatctcgaagtgcctcgctaacaaagtagacgggccgctgcacctttcgacggggccagttcgtgttgtcaggggctgatgactcggagcgcgcctgttcggaggtcccggggggatcccagactgcctcgggatcataaggctcggggccacctgccaaagcctccgctcctcccttgggggcctcggggtcctcccgggggctggaagctttgggcgctaggccttcgggggacgaggggccatcgcaagccgaaggggcctcccgttcgccttcctcacgctcaactactagggcggcactcaccacatggggggtcgcggccaagtagagtagcaatggttcctccggtcccggggccaccaagacgggagggaagttaggtaagctttcagctgattgagagcttgctcagcttcctccgtccatacaaatggcccggagcgcttgaggagcttgaataggggcagcgccctctcacccagcctcgatataaatcgactcagggcggccatgcatccagtgacgcactgcacatccctaagcttgctaggggggcgcatcctctctatcgcgcatattttctcaggatttgcttctatgcctcgggaagagactagaaaaccgagaagtttgcccgccggcacgccgaacacacacttatcggggttcagctttacgcgcgtggacctaagactatcgaaagtttcggccaggtcctgtagcaacgtgtcttggtggtgcgtctttaccaccagatcatcgacatacgcctctacattgtgccctatctgattacttaaggtaatacgagtcatgcgctgaaaagtagggcctgcattcttcaatccaaaaggcatagttgtataacaaaaggtgcccacaggagtaataaaggcggttttttcctcatctttcctagccatacgaatttgatggtatccagagtatgcatctagaaaacacaaaaggtcgcaccccgcagtggagtcgactatttgatctatgtgtggtagagggaagggatctttggggcatgccttgttgaggtcggtgtagtcgatgcacatccgtagcttgccattggccttcgggacgaccaccgggtttgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctgaggaccccgggcatatctgacggcttccatgcgaaaacgtcagaattcgccagcaggaaggagacgagcgcgccttcttatttggcgtccaaggttctgccaatcttggcggtcttagatggatcgtcgccaagggggatttccttgacgggcacctcgtcagccgaggggaggcgcttcttggaagcgtgggacgcagaggcttctggggcctgcggctccgtggccaccgccaggttgtctgcgcgctgctccgcgcaggcgagggcgaccttgacatcaccaaggacggtgatgggaccagcaggacccggcatcttcatctagaggtaggcgtagtgggtggcgaccatgaacttcaccaacgcgggtctacccaaaaccgcattgtagggcagattgaggtccgccacatcgactggcccccccatccaccagcacatgcttcatcttgacgttgtggatggtcggggagaccaccagggccaactttccccccccccccccgagcgagcaccgtcggatggtcgctctggtcgaatgtgagcttcacctccgaccagcgcaccttccggaccacctcatgcgtgggaacaatggccagaagctcccacttcatagccttgaagcttcggcgagaggtgtgagcgcaagccccccccccccggtcgagcgtggcgacggtcccctgaggtatctggaaatccagatcctcaccgtctccgccatcatcggcgggggccttgtccttggcctcccctcgctggtcaccggttgaggtcgcgggggctttgccctcccgtcgaccctgccgcttttcctcatcagcctttcggaaccgctcggctaaattcttgaccgagcggcagtcggcgagactgtggcggtaagtgttgtgtaccgagcaccacttgtccgccgaccggccctcgccggagggaatggtagggctcggcctatcgacggtggcattttctttgcgcggggcccgcgtgggcccgtctgctgcaaggacatggccctcgtcatcggagcgggctggtttccttttgcctctcctatctcactgcttagagcgggaggcagattcgggggtagccgcagccgccgcaccggtgctgggagagttccaggcccatgcctccttcttctgggccaccttgtccgccagctcgaagagctcggcagtggtcttgagctccttggaggcgatcttctccagcatgcgattatgccgcacgctgttccggaatgcatacacaaccgcgtgggctgggatgcacggaatggtgttgcggacctgacagaagtgttgtatgtacgaacggagggactcatcatccttccgccgtacagcatgtaggtccacctcttcccccgggcggggatatgtgccctggaagttcgtaatgaactgctggcacagatcctcccaggagtgaatggagccggggggctgggtcatcaaccagccacgcgcctgacccttgagggccatgggaaagtaattcgccatgacccggtcgtcactccctgccgccacgataaccgtggtgtagatctggaggaactcggagggattgatgctaccatcatacttctccgtaaggttggggcgaaacttcgggggccaccggacattccggagactcgccacaaaggccctacaacccgtccccccaggggtgagtgtggggggagggccgcctcgtgaagaggagcgtggcgctccagatgaggaggcgccttcccccatacgggtagctcggcgctcgtctcggcgtcgctcgatgttgattcgagcgtcctgcgtcccgtagaggccgtcatggcacctccggctttccgaggcccctgacgatgttggaaccgtggaccgcctcgagatcgtggccgatcgacgagcccttctccttgccgacgaggagagggtgaccgaggtacgcgacgtaccagcggcagcggatcggccactcgtggctaactgccactgggtagtagtgaccaagttggccacgtcgtccaaccagcgctgaacaggagtctccagctccgggtttaccgggggatgccgcagaagggcgcctgctacctgaagcgtgccttggggcaaaccgccgtctccatagtcgagacggcagcgtgccccggcgcgtcgcggcctccctccgccagggggcggagagagagccgaatcacctgaacgagtgggatcctccctccgcgaaggttcgcggcggggaggagttggagaaccatggcgacggtgacgaggacctcggctctcgccggaatccccactcccggacagggtgggagtaaatgccaccgcctcctcctctactttcaggacctcgaccatggtcggctaaggcctggagaaaattgggacgaaagaaagcgacttcctctcggaatgcgcaaccgcccctacttggcgcgccagctgtcgaggagagatcctcaatagcggggaatcgtgagaccccccatttgtgagttcggccgggggcggaggctcatctcttggaaatcactcgctcgtccctaggattaccggcaagcttgcacgcagtcggattatacaggttcgggccgctatggagcgtaacaccctactcctgtatttgggattatggatgagttttacaaagatttcttcactctagaaagcgcactcgcttcctctcttctggagttcaggttttctgggcgtcctcctctatctcagtgggcagggtcctccttttatagctcaaggggataccacatgcgccgcctctacctaccctctatcggagggggatcccactccacttttcctgggctttaaaccgtgccttctcccggaagctaagcaacaaccggttctcgagtggaaccaggcgctgccccccgcctgacacgggggacagccctatcattccctcataaatgaacgatgacctgtgacagcccttcctcgagtgacgctcggacatgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctccgctgcgtggcagccgggtgagggcctcggggcgaatccgcgggatagcccgagggggtgacgccatgccccgagcccccccccctcccccccgcccccccgccgcttccacgactcgcgtgacgcgcgaatggggctaacttgcaaagtcacgtggccagagggaaagtaattcccctctacttcacatacccccgggtccatatctccgacacatatcatcagaaatcttgaggggatgtcccttgatgcacccatttctctccactatagtactagtttaataataatctagagtataatgataccatcactccacgaaatgaagtttaaaagccatattgtgagtacctgcacgttggaattttctcaactagatgtggagatgaacacgagggaacacggcgtgtaccgcgatttcattatgttattattatgagattgcatctagtaacaagaaaatgtatgtgttagacaataattatgaaactgacggactaaccatccataccgacaacatagtgtgtgccaccgctccttttcgatacgtacaatgccctactatacgttttaattttattcctcattagcatttacagagtacgttaccatgatcgatctaacaaaaactctacttaaggcgccgaagaattaactaattaaaaagtgattttacagttcttgatacgatactgaaagataccgtgttttttatgtaaaatttaatacctcgcgatatcttcaataataataataatagaagattaataccttcaataacagtagaagatatcaaatttacattaaaaatttttggtgtatctccgaaggattgtaaaatttctcgtgattaaatgatagtgtagcatctgaccacgatcgaatcatgccagtttcagagcaaggcggcgacggtgacgagcttctcgaactggcgcgcccggccgcttctgcgacgtcggggaggcgaacggcgtgggctggactttccgttagtgggcctcattcaggcccactgttatcaccgccgatccacatttccgtcaataaaccgacagttgactcagatgttagttcaaagcattggccagagtgagtatatttggatctgtaataacaatatttactttacttgcagtttattcacgtgagctaaaccaacaaaaagagagagggaaaaaaacgaagacgggatacagctggggaagaaattagggtactcaactctgaaaaatcaaaacgaaggctagctaactatgatcgcaaccagagaacgtacgtactgaagagggttaactagggggctctcttaattaagggataatcgctggataatccagtccagcgaactgaagtgaagaagcaagcatattcagtgcagccgatgaggagtaggaggagcaggaggagtagaacgaggaggaggaggaagcggtgacttcttcatcttgctgatgaagttgacggcgatcctcatcatcttctggaactggacgaggctgtgctccaggatgaccgccatgtcgccgttgagctccctgcagctgtacgtgcacatggtgacgtcgttgatggcgcgaagcacgagcgtcttggcgacctcgtcgtcgccggccttgagcgcggcggcggcgccgtggatctccttcatggcgctcgacaccgtcacgctgcagttgtcgaggcaggccttgaagtccggcacggacttgttgaacccggggagcttcccctcgaacaccgtcgccgccaccgcgccggactccgtggcggcctccatggcgacggcgaccagggacctgaagtccacctgccccggcgcgccggcgatggcggcgccgtggttcgacaccgacgtcagcaccgtctggatgtccagcaggcggtggcccaggtccttgacgcacagcttggagaacggccccgccgtgcacgccgccaccagcgggctagaccccggcgggaggcgcgcctgggcggccattgctgaggcgcacatcaggaccacgacgaacatcgccatggacaacaacgacgacgccatttaatttccttgtcgatcactctgctaatgaagcttttctagttgttattcaagatctgaattacagtaaaattcgatcaaacgcaataatatatataagctgaagagacagatctgttggtttgatcagtgagtggttcttctttgtgctctcagctcgtcgccgtagtcgctgaggctgggaggggttttctctggatggtgcgtgcatgcgcgccatgagtggtcgcgcgggagtgaactagcagaggaagcgggccagcttgtgcgagtttgccgcgctcttccctctcgccgtctcgcgtcgcgtacccgcgcccccgtacgtcaccgctgtcacggtgtcacattgacttttctagttgtgtggagtatgtttctgcagcgcttgtactctgtcagctgattgttgcgagaagaggtcggctaagccgtgtctcgtagactttgatcacatcccttttatatacagtgcaaagtagctcaaataatttcgcatgtaagtcccttttattttctattttactctttatattttgttgatttaggggaaaacttcaatattttacaatgaacacctcaaaaatcatgaacatttataaaatcacattccctcctctccaccggcaacttcctctactgaagcccctctctgccagcgccgctctccccccaccccttctgccgatgacactccccccaaaacactgatgatgctagcttccatccccatccgccttgtatggggccatgccatctcctaacgtgctgctcgagctgtgcctcggtccgccctgataaatcctaacgatgaacacatgttttaattgggctcagcagtattcactaaatatgggaaaggcggatgtggcatgaaatctctgatgtgtaaagctggggctaaacaacaactaggcacactgtgaaagccctaagggtactcacagtgcaagccacaggtatgaggagcctggactaggtcacaagttagaaatctctatctcacagtgaaaagtggctctaggatgacttaatttatcatgtgctcccttgtaattttttactttaatactcatatactttttaaaatttagagagtagtctagcaatttgcatagaacaccctaaaaatcagagaaaaaaaaatctactccctaacctcttccccgccacccacccgtcactttcatgttcccctcgcttcaccggctttaccactcacatcgtcggtgatgagctcctcagtggcgccatttctcccctctctcttcccggtgccacctctatccggacggccgtcgagtatattgaaacagcaaaaaggccgaaggcaactccgacggcgcgtcaaggaagccacgaatgggtcaaggcggccgccaatgccgtctcgtcgagctccgccttccgtcctctctttcttctccggtaggtggcggcagaggtgacggcatgaatctggcgaccctcaacggcgtggagtgagacaacacggatgtggcggtgggccttgatagcagaggactccaaggcaagttaatggctgacggctccgtggagtggccctctacagcggaggaccccgaggtgggccttggcggtggacctcgacggcagaggactccaatgcaggctgacggctccgtggtgcggtggagtggccttggcgggggctgcagatctggccgtagcgatgaggttccgcaacggctcgccgtcggccagtctgccgccaccaggttcttcctttctccagtcctcatctcctccccagctcgctggcgatttatggcgatcacggaagccacttaaggcgaggctacagttgtaatctccacaatgcgggtcgcgcccatctatcctcatgccgcacgccctcgatcggatcaaagaacctttggctcattttggctacgcatagtttgtttggtcactataggagcgaacgtggagtctaatctactacgtggaaggtcgaggggcgaacgacatgtcgacgcactatgaacgccctaacattgcagcacattgatatctgatattttgtctatcgggcttaggttgatggacagtagcagcagttgatcatatattgcacttgtttattgagttgcgcgtttactcgtgtaacgagattagaagtatggttaactttgtgtttatcacgcgttctcattggatgttatgcatagtatatctaccgttgacaactagagaccttttacagggtctgtattccaaaaaaagtagaaatccaacgctccataatgaaaggtaccctgtaaaaggtatttgagtattggcataggcacttaggtaccaagggtaaaaagataaatttgctagtagagaggaaaggaaagagttgtccgtaaattcagatcggtaccgcgtcggtaccagttaagttgcatggtactagcattaaagttctcatttacgtggttttctctagatttacatttttgtttccaaggacatggtagaactcttcccattaattctccattacgttatttgcatagttattttgatatttatattttgttcccaagaacattaaaatatcactcaaggtttacgttttaagttttacattttatttgtggaaaaaagaaaattgtagataaaatattcctaatgattgcgtccatctgaacatgctatgttaggttaaccaacaatatcagagcttctctcttgaccctatcttcttacaggttcacctattcaaaccctagaagaagaacatatgagaatatctcattttagtcccttatatgaaggaatttgttaactatgtaaataacgaatcaatcgtgcaaataagtataggagcagaggagatctttcccgatgcgcttgcacctagccgtcgatcggcccatcttgaaccctcaactgtgccgatatttctctggaccaattcaaaccctagaacaagaacgaagccggggtcaaagaaatgaggcgttgatctttttttttcccggtgcagaactgcagatcgatcgatgcattaaattgttcgaaagatttactttgttttctacctaacaattctggtgattgcacccaggtattcgattcactcaaaatgctccaggtattcgattcactcaaaatgctcattttttagtagttaattactccattgctactagttatgaaaattttattccatacttgcccctcttttaatcaatggttcacattgttctacctctcaataccttcaagtacctcgcaaacaccgtaaaaggtctctgacaactattataccagttgtgccgctgaaacccgacttgaaacccggctgtgtgtgttgtcaggcagcaagaaagataagacattacttacaaatcaccgacggcatgtgcgtacaatagacacattcaaacatatatactgcatctatttgatgcaatgcaaagatttatgaatgaattgagagggaaagttagaattgtctaataaccgtcatccagtttatttttatgtcttccaactagctcttggtatgcaatgttaccatacatctgagaagtagtaagatattatgcgcggtgatactactatgctcttaaaatcggtttctaaggttattaaaaagttattaaaaatttgaaggtatattgcttcagttccatgcctccttttgaatgaatgaatatttcaggagaattttgagaggaaattaacgtttcttgtaaaattcttgttttcaatatgagaatttctagcatcatctttttttcgtcgggacaatacatgaaagaaggcggtccgaatttcactagagtttaaaggagtttactacataaaagctcgttaaaccagttttgctgatgaaagtcgtattctcggcgcttacaagttacaacgctaaaaactacactttactacaatcgtgttgctagattagactagcatcctgccaaattaaccacttgtgtctgtgatccacaggccaacaggcggagtttcacagatgcacagaaaatacgaaaaggtggtccggtccgtcgtgagacagtcagagtttaaaaaaaccgtacggttattttgattatcatgtatagtaacctagctttaattttttttcctgcaacttaacaaaagagtagaaattccggtctgtggcatggaatgaccgttcaacggcgcatgattaaagggttggcgtgtcagcgcatttcagcacacactgtcgaatttctggagtattccttcttattggaaatatatgggccggccggcaatatatattttgtaagaaaaacatcaaaacaatcaactgtacacaccctcgcgcgatctcctttacggttctactaccacatataagcatgcgtgtacacacataatatgcaccatgcatgcatataatcacatgagtaattttatagttcttgagaaggtatcatgaggtatcatttttttctatcgtagatttgatatctcttggtatctaaatactaggaggtaccaaaaatttaatgtaaaatttggtaccttatgataccttctcaaggaccgtagaattgttctaatcacataaaaactgctcagtacatagttcttcacaaggccggccgaatacgagaggtgatcgatcgacgattcgaagctagctagcgtcccatgtgttgcacggcgggcgcggcggcggcggcggcgcggcgctccatgttgaggtgccacccaagcttggggtcgtagccgcgcgcggcgagctccctgtactcctggatgagcgcgcatggctcgcaccagcagtggatgcagcagtcgccgcagggctcgccggagaggccgtactgggcgcgcatcttgccgcggtaggtgcaggtacatccactggaacccggtgatcacggccagaaacacgtagagcgcgccgctgtggccgcacgacgtcgaccccctgtccacgatctccgccaccctcccgaacgtgatgcacggacaccaccatgtcatgcaacctgcagatcaaaatacatgtttgtttaggattaattgattaattctctgtaatccatacactacttgagaactgatctttactgcttggtcgaccgaaaaccacaatagtcccaacactgaaaatgttttttttcccggtttataactccaacagaaataaatgatctttagttctaaatatcatatttagttctgattcaccttctaacagggcctttcaggggctgggatctttcgtcccggcctatgcatgcttgccatggtatggtgtggccggaggcgcgcgccgcggcggcgagaacgtacgtacataggccgtagtcgtcgaagcagtcgcagaggccagacgaccagggagcggagccgacggggacgccgggcgctggcccggccgttggcttgtctggctgcatctcctccttaattcggttgcccctgctagctgcaagttcttgtgatcgacttgttgtttgcgctgggaaactgagcacaagctagctagcgggcgggacgatgctcatatatagcacgcgacaagttgcattggccccggtgtgatctggacatatctggttcggttaaaccaattagtcattgaggagaagacgaaggaaattccatgggacggggcctaaacctcgtcctctgtagtcgtccctgttacgattttgacatgcagaggacgacgtttaggcatatcgccttttagacgatatgatatgacatgatatatgcatcaagattacattgattagtcaccatcctgtccgttgcacggattattattgactaggcaaatggtggcagctgtttcattggcatccgggagaagtagtgtgtttgtcgataacggcagatccagtgcaattaaagagtatttagatgcatatccagttcaattcaagagtatttagatgcatatcgaatacagtatgtcatacgtatgtttataaaataaaaataaataaaaataaaaactgaacatgtttccgatgctttaatatgtcgtccgtatttgagtttgtttttaagttcgttcatttttaaaagtacataagaagtcgtataagaaacccttttaaaaatctcgcatgctaatttagaactaaagtcggacttctaattgctttacaattctcaccagaccgtaagaaagcaacgtgcaagatatgatcatcatcccaatgaggtttctggattagatatcaatactatcaaaataaaaatcccatatatactttttagaaaaaaaattaacaacaatacgattaaaatagtcttcacccgttgtaacgcacatgcatttttttcttaaaaaaaaaggaaaagagaacgtattcgacctaagaagcaaatgactttccgttttcggccatttgctatttttgatatatcctttttcggcccaaccacacacgatcaatccggcccattaccaaatttggccacacgttttcagactttcttttttttgtaattttcctgtggtctttattactccctccgtttcatactataagtcgtttgactttttttttctaagtttatagaaaaatatagtactagtatttttaacaaaaaaatatattataaaaatatattcaatgctagatttaatgaaactaaattgatattttagatgttcctaaatttttctatagatttgatcaaacttaacaaattttaattaggaaaaaagttaaatgacttataactagcatggtggcccacgcagattgcgcggctagcatcattatattttctcttatataatagcatatatgttttctcattatattattcaaatatattaaaatgacattataattttaaattttgcaataactatacgaaactacaaatgtgtaatattcatattgtattttatatacgtgttagttattaattatttttaatatcaaattttagttatttgtaaattatatatattcctatatgtactctagactcgtcttttaatatatttttttaattccgaattttttgtaaattgtatttctatatagactctaggctcttctttcaatattatttattttttatttttgattttttattatttctaattatatttatatgtggactctaaactcatctctcaatattctttaattttgaatttcagttacttctaaattatattcctatattgactttaaactcttcttcccatgtttttcttaattttgaattttagttatttgtaaattgtatttttatacagactcaaaactctacttttaattttattatgtttattctgaattttagttaattttaaattcctatatggactctatactctacttctaatattccttattttttaactctgaatttcttttttttcttaattgtatttctatatggactctatgctctacttctaatatttcttatttttaattccgaatttctattatttcctattcgtatttctatatggactctatactctacttctaatattccttatttttaattccgaattttagttattttctaattgtatttctatatggactctagtctcctcttctaatattccttatttttagtttcaaatttcaactatttctaaattgtatttctatatggactctagtctcctcttctaatattccttattttttaattccgaatttcagctatttctaaattgtatttctatatggactctaccttttctttttctccgattaatgtgagagtttctaggccatgagagcgaacgtggaggctccttttctattcctttaataatataataatagatatgtaacagagggagtatttaacaggccggcctaattcatccattcagaccgaattgggctttttctcttttacacacatgcatataaagtttgtacttagtccctcatattcagccatgtgtataaaatttgtatacgtatgcatatacttagaattcatacatataaactttgtattgtacccaatacaaagtatatacatgtgtatatacgaatagagcggagactagaagcccaatttggcgaccgcggcgagggctcaggaaggcgacggcgaggacgggagctcatcaggaggcaggagctcaggaagtcgatggggccggcatattttaagttcacttacttcaaaacagtcattcaaaaccaagtttattaaacatatgtggccggccggcagctaatttgaagcaaatacaacagatatataagaaatgggctgaagaacagactcgacgaggcactcatcttaagtagaccacccgtactattagcgtcgcatcggcgggttgtgcttgggcgggacgtgctggttgtttccgagccagccaagcgagggtttgtagccgaggctcttgaggtgcctgtactcctggcacagcgcgcactgcaggcagagggcgtggacgcagcagtcgcagcatgggtcctcggggaggtggaagctgtcgcgcatcttgccgcggtagcagcaggagtagaggcagtggcagtgggcgaagaagccgagcagcacgcacatcacgcccgccgcgcagcacgtcctctcccccctcgacacgatctccgcgctccgcccgaacgtgatgcacgggcacaccgtcgtcaagcaacctgcatatatataattagtttgtgtcacataaagacgtgaatattaaggaatgatctaatatggtaccaaatgttatatggtaaaattactcaatcaatatatatattccgggaaataagcttaaattagcttagaattaatagatggtctatacaataaatgcaatatatataatctggtgaaggacgatcgatagaatcatcgcaagtagtatagtactgatcgacaatatggaagtaatatatacgcacaaacttcgcagtcattgaagcaggcgaagagtccggatgaccagtcattgtgttgcggcctcgccatctcctccgatcctctccttcgctagtgcgaccactgaccagctgctgctgttgtgatcggcaggcttgctagctaggagcgatgagcatgagcttagctaggagcgtggctcttatatagcagtagcacgatcggtatgcatgcatgtttactgaaactttaaaacgatgatttttaattatatatattagcccgatctaactagcgtttggttgacccaattaacttagttgactccaccagaaccgaccggcaacactagtcaatgaggcagtgaatacctcggacatgacctagatcaggtctcacgagtcatacaatgtcgctggcagtggcagtagtacttcctcctccgttaaaaaaacaaaaaaaactaacataataataatataataataatataggatgggacatatcctaatacaacaaatcaatgtctatattcgtgtttgggttttttttttatggatgtagtaagtagtaccaactattatatattcatgccttagaaaccatgtttattttgattatcatcttaattagcgtgtggcataccaactatgtgcttgacagttgggagcttgggggatttcacaataactatgtacgttcacttctttttcgcgtatattgaagttccggtcagttaattagccaaccggccgccggaatttcgactccttcccaatggctatttcctgaccaatcttttcatactctatttttttattaaatggtgtctcctaatatttttttaatctcaaatgattaagaatttctttcaacgaggaaaatgtcaatcgatcaagatcaatatatcagttgcaagttgtcaggaaaatgagtaaaagagacaggttctgttcggcttgtttacacttacctacttcttggatcggtactacaacattagaacattataactagctagttactaacttaattagtaccagagttaggttaagatagtaccattagtaacatatttgtgcattgattgctggcaacagctaagctaggcacaaatgtactaggattctaggaactcatgacatttctgtgctgtcgttgcctgaaaaatgatccgttgatttggtcttagaaacctaccccacgagatcgatcttgagctcgaaaacatgagcccaatcagctcattacatatgtgctactgctactgaaagggctttgttgagaaaactgtgtgcttgaaacagccaaacataggcaggatcacgcctgatctgataggccattataagggcatactcagactgatgacgttttcaaccataatatcattatttgttaaaattgataattatgtggctacatttagtttgttattaaatattggcaatgtatatggaattttggcaacattttaaagccaatcctatcaaaattttgacaatgttatcaatttgttaaaattttggtatattgccaagttttggtaatatttattttggcactaatctgaacaaactctaacttgtaagtactgtacaaacaagacttccgagggtctgtactgcaggtcaaaattcatgcaagagaatacttgccatgcgaaagcctttcgttatatattggtatagtagcttcactgcttatgactcactcgattagttaagcacaataattaattgttgagaagaaatggagcaagggagaggaaattctatttgggacttgggcatattgttttggaactgaatattactacgagtagtaatgagagttttaggccccgttcgcttcaggtggcgtgcaaaatgtgatacataattagcagtaattaattatgtattaaacttcgatataatatttttttaaaaaaaagtacaagggagcaaaatgttgctcactacaagtagctcatccaatgagataaccggacaggactccagtgtatccggatattgggccgagagcccagatagcccatctggcgacatgccctccttgggccggatggtccatcaggagagcagctaaagataaaatatgggccgcatgctcatcgctaagcgaaccagaagggcccacccaattttgtcgtgcggtaagggtgaggaatttttttatttttaattttttttattaaaagttttacaaaaataattttccattttaaaaattgacg

SEQ ID NO: 58434 - DNA, 47880 bp, Oryza sativa
ataaaataattaaaggaattaagttttgatttgattaataaaattaaatagatataagggagaagtgtaaacttataaaataaatatggtagaaccaaagcatctagaataaagttcatgaaagatattcctaattacttaattaaatcaactttgaaattaccattttaccctcctatttttttcctttttcctttccccgtttcttttaggcaaaatttgatacaggacaatcaaaaatcgtgtaattggctgagagacaccaaaaaatgtgacactgccgatggacactacaaaagttgtgtaattagttataggacaccgaagggattattttataattttcgggctaaaagaggggagagaaatttcgaattgacgggaatgtcccctctactccttcctcatggccgccatcaagcgctcccaggccaccttccacttctaccactaggccaccaccgcccagactcccgccgccgtcaaggtcgtcagccgcgtctttgccgaggccggattccgtagcggggacatcaagctcaccatcctccgcccggctccatccatgccgctcctcggccgcctccccacgcgcacccgcccacagcctcgccgacgagtatgcctccttggcacccttcaccgccacctacggcaccacatcaccgccgccggcgtcgtccttcttcactgtctgaaagccctgcacggcgccgccgacgttcagcatgttggcgaggccgatgggcacgaagctgatccgccgctccaacaagagctcgtaggtgaacggctcgagggtgagctcgaaggactcgttgcggcggagcagctgaagcttctgtgcctccacgaagtagacggtgaagcagtcgacaccgtcgccgttgccgccaccgcttccgtgcctccacgaagtaggcggtgaagcagtcgacgccgtcgcctttgccgccgccgccatgcctccactcggacttgtgcctgtatagctcgttaattcatcttctcctctctccttcacatttgtttctaggtagcttacttgctctaagcgatgataaattagtaatattcaattatccaccaaatgagcaattaattaccacatgactactgatatacaaacacagtccatctccttggtattcactattacataaaagcacttatgtgccgcttgggaaccgatcataggtaccggatatcccaaccggcactcagcaagtggcacagatgactttagtttggccatttgttgcattaattttgacaaacccatctagtagtcacatgcatgcaaagagattaattattacctccatatcaaagtacatgtcactcttaagtatgatttatcccatcacatttcatttaaatttctctctattctacccccccccccctaccactacactctaaccattacttccttcggccactcactaaggcgcacacatattttaaattgtaactctttaatatttgatctgcaagactttattataaattaaatttatttgatgaaaattatattattggattgtcatctatatttacttttatatgatatgattttgctgttacaaacattataatatatgagaaatttaaagtcaacgattttttttttttagtgcatcaggtctgaccgggtcttagtgagtgggagagaacgagtatcatttaaggatagtataaccgtctcttaaactttaatctatgctaaactgctaagttattcagaatgacggatgaattatctgagagacagatcgatgttgaaccatcctgtcaccttctgctagcttttgcaacagtagttaattactactccctccatcctataatataataagttttaaagttagacacggttactaggtagaagtgaatggtggagggttgtaattggattagtagtaaaggtaggtgggaaaaatgaacgatggagagttgtgattggttgagaagagaatattggtagagaagttgttatattttaggataaattctgagagctaaaagttgttatattttggaacggatggactacttcattatagcccatagttagactgatgattgactaattgttagagcaaggtttatagtatagccagctaaaagctataaaaataaccacatcagcaaattatagttagtgctaatagctagtgcatacaatagagatctactatcttctattgctacacagttcccatcaaccatgaacaaatgcattcggtagaatgaggtgaccccacccagcttcttgcgttgccatagcgtgcagccaacagcacttaaatgctttgccttggatagagtgagcagctagcgactaattagtcgcctgtttaatctctctcaccacctttttcacctccagctaagcatcaacgctgacatggtcatcctatcgccagcatctaccgtcttactgtacctgctctaagtacatgtgtgacagctcaggcatgtctcccgttctgctggacacgcatgattcagctgaagaaaaaaattgatataattggagcttttcctgctatcataccacgcttgcagttatgagctcgctaatccgagtacaactcgcagcatattctacacacgcaatatatctatctattatattattaaagaaatagaaaaagaagcttccacgttcactctcatggcttagaaattctcacattaatcggagaaaaaaaaaagcagagtccatatagaaatacaatttagaaaatagctgaaattcgaaattaaaaaaataaggaatattagaacataatagagtctatacaggaatttaaaactaactaaaatttggaataaacataataaaattaaaagtagagtttagagtccgtataaaaatacaatttacaaataactaaaattcaaaattaataaaaacatgggaagaagagtttaaagtcaatataggaatacaatttaaaagtaactcaaattcgaaattaaaaattaaagaatattgaaagatgagtttagagtccacatagaaatacaattagaaataataaaaattcataaataaaaataaataatattggaagaagagcgtagagtctatatagaaatataatttataaaaaattcggaattaaaaaatattaaaatacgagtctagagtccatatagaaatatatataatttacaaataactaaaatttgatattaaaaataattaataactaacacgtatataaaatacaatatgaatattactacacattagtagttttgtaaagttattgcaaaatttaaaattatgttgtcattttaatatatttgaataatataatgagaaaacatatatgctattatatgagagaaaatataatgatgctaaccgcgcaatctgtgtaggccaccatgctagtttataagtataacaacaacaataatagtccttgcacccacatgatggtgactagttagattaagcaaagtcttcttaaaacaaagaatgagtagtgataaaccaaataaatcgatcaataagacataaatgaccaagttggctgttaattaaacaaacatcatcacgtacgtactccccgtgaactcgtagtaggtataccggacggaacatgagtcagccattctattagatctgtcctcggaagatggaatccatgcaaaaaaaaaaaattcaccgacctgcacagccggagacgatcagctcgatatatcgatcgtgtcttcctccgtgtgtctgctcgctacgtacgcctctgccatgaaagaaccgactgcccgcatggccggcgtcgtccaccgtttcctcctcctcctcctcttcgtggcggccgccgtcatgccagcatcaaccaatgccgcagcgtcgtcgcagaccgacgcgctgctggcatggaaggccagcctgaccgacgtggccgcgctgtccgcctggacgcgcgccgcgccggtctgcggctggcgtggcgtggcctgcgacgccgccggcctcgtcgcgaggctgcggctcccgagcttgggcctccgcggcggcctcgatgagctcgacttcgcggcgctcccggcgctcaccgaactcgacctcaacgggaataacttcaccggcgccatcccggccagcatctcgcggttggtatccctcgcgtcgcttgacctcggcaacaacgggttcgtcggctccatcccgtcgcagatcggcgacctctccggcctcgtcgagctccgcctctacaacaacaacttcgtcggcaacatcccgcaccagctcagctggctccccaagattacccacttcgacctagggaataattggctgaccaacccggattatcgcaagttctcgacgatgcccaccgtcaagttcctgtcgctctttgccaactccctcaacggcagcttcccggagttcttcctcaggagcagcagcatcacctacctcgacctgtcgctgaacaatttctctgggtcaataccagacttgctgccagagaagctcccgaatctgacgcacctcaacttgtccatcaatgcgttctccggccgaattccggactcgctcaggaggttgacgaagctctagcatctgcgaattgagtacaacaatcccaccggtggcatccccaagttcctcgggtcgatggggcagttgagagttcttgtacttggcaacaacccgctcggcggtccgatcccgccggttcttggccagctccagatgctggaggagctccaagtaatggccgccgagcttgtttcaactctgccattgcagttggccgatcttatgaatctctctgtcctgaaccttgcctataacaagctctccggtaacttgccgctggcattcgcccggctgcaggcaatgagggtgttcagaatctcatccaacaatctcacgggtgatatcccgagctcgaattcttcggtgtggacagcaacatgttcactggaaatatcccaccagagcttggtaaggcaaggaaactgaatatgctgtccatgtacgacaatagattatccggcagcattcctccggcattggggagcttgacaagcttgaagtatcttgatctgtcagcgaataatctgacaggaggcattccatatgagttgggtcatctcagcaatttgcaattcctcaatcttagccataactccatttcggggccaattatgggaaatttgggaaacaatttcaagctgcagggagttggttcatcagggaattcctccaattgcagctctggctcagcattctgcaggctgctctccctcgagaatctagacctttcaaacaacaagctcactggtaagctgcccgactgctggtggaacctgcagaatctgcagttcatggacctctcccacaacgacttctcaggtgaaatctctgcactcgggacaagctacaattgttctcttcattcggtatatcttgctggcaacggtttcactggagtttttccatcaactttagagggatgtaagacactggtctccttagattttgggaataacaagttcttcggtaatattcctccttggattgggaaaggatttccttcgatgaggattcttatccttaaatcaaacaacttcactggtgaaattccttcggagttgtcgcagctttctcaacttcaactactagacatgagcaacaatggtctgacaggatcgattcccagatcttttagtaacctcacttccatgaagaataaaaaacttaatatctcctcaggaattattacaatggcttagttccgatgaaagaattgatacaatctggaaggggcaggagcaaatttttgaaataaaaatttctggattaaatttttttcaactacttacgggtatcgatttgtcaagtaactcattatcacaatgcatccctgatgagttaacgaacctccaaggccttcaatttttgaacttgtcaagaaaccatctgtcatgcagcatacctggaaacattggtagtttgaaaaatctcgagtcccttgacctctcgtcaaatgaactttcaggagctattcctccaagccttgccggtatatctacccttagcattttgaatctctcgaataataatctatcgggcaagataccctttgggaatcaacttcaaacccttactgacccatcgatatacaacaaaaatcctaggctatgtggttttccgttgaacatttcgtgcacaaattcttcacttgcatctgaagagagatattgtagaacatgcgaggaccaatatctatcctactttgtgatgtctggagtggtttccgggctttgtctgtggtttggaatgttcttttccatcgagaccttaaggtatgtcattatctgctttgttgatgccatacagtgtaaggttacgcagaaggtgtcctatattaatcaatttctttctagaggaaatacggcttagcatctgtgcagctgtgtttccgtaatgttaccttatgatgaagaagtatatttagctttctgttgttctgtaattggcatgtttcctttgtatattaagactaagaggaatttaaaatgctactttatcttatccaaaatcttatggctttattctggaaatactctatccggcagtattccagaaaagataggcagtttgaaacccttgtggtgttattcctccgagcatttcaaattcgttatgctttggtatgttaagtatctgaaatagggtgaggtaaccactgtaagtcaacttcagtcaattgtggatccatcagtctatagcaacaatctgcttctttgtggcttccctccatgcacctacactggataaaaaaatgaagaccataaagaaatctatgcgccattactttattctgtaatattattggcctttttttttgtgtgttttggctttagtttggagctctggttttacttaagccactgagttttcatttttcactttaccagatagaaagaagttgtgcataagcagtagacattaatgcactcttcagttgcaaatcagcaaccaaagaatcatacagttttcagtttatattggccatttttgaaatagttaattcccattcaaaaattaagtatattagatgcatttttatggcatgcatgtgttcacctgaatgaacagctgtgttctagctactctagtgtactatactcattcctactactattcttgttgtggttgtccgatgtctgcagccagcaacctcaccaattcgaattgaacttttcatgcatcatgttttctggaatacgcaaaaaattgtgcatttttgtattaaaactttgaaaaaagtgaagtattacaatattataattctgaaatgctatactcagggaaaaaaaaagaaatacactacgtcatgtcccacaccaccaccacaccctaagaaaacacagccacgaccaagaacctccaaaaggatgcctctaaaaaggttaagacattaaaaacaccaccatcgcccatcccaaaagatatggttttcgcctaaaagatcttattaaagaggggaagagaggcacctcgacaacaccttcaagagggttccggcgcctaaaggcgttgccgctgtcagcttaagattgggctggctttcgcctggcggaaccaaggtatccgatctggaaggtgcggctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaacctcatgagcttattatcctatgtcggaacaaattagttaaacttgcacctttcttgttgctacctcaccaatcaccaatcttgctgacacgtgactgcaatagcaccaacgccgcttcgccggctgtcctccatacggttgtcatgctgccgacacgaccacaaccataaccatgaccaatcttgcgaccaaccactgttgcactatggcgaccaattattagccttcttcccatgccatcacctccatcagctcaccaagaaagggaggaggtgtgaccgccaccaaccgctacatgttggcagcctcgaccttcctttcctgtcgccatcttcaccgtcttgccatatgggactccccatgaccaggtaaacctatcaagaaggtgaggagctccatggagatgtgaaggcaccatagatagagagcgacccaccatcatcgctgcccgtgatggcggtgctatgtggccaaatccgggctcggggccccagatccagcttctgctccacccaacaccagctacgccgccacacgggttggcaaacagcaaacctccgtcgttgccatgcacgctggtgctccggtcgagtcgtcctcaaggcgtgttaaccctccgcctggcaacccctgtgcatctccatgcgcccaaggagaggccccatcgtcgccaccactggccagccgagcggccgttcgcgaggagaggcaagggccgccaccgtcacctgcgtaggcttccaccatcgtcgcccgtgccgacctcctcgacaccagctgtcgcggcatcccactgtcgctagccatcatggccttccacgcaggaacccgcgtgggactcccgccgttgatgctccatcgtgccagcaactccaaccagatctggttcagaggcggcggatccacctgacggaagactagatccggctacggcagcattgaatctgtggcctacacgctgcgtcatcttcccagcgatccatgcgccaagccaccttcgtcacgctgaaggcgaggcgccgccagggttcggccccgctgccgccatcccgacttgccgcacggttctctgacagcggcgaggagagggagaggggagagcggcggcggcgggtggtaggattcgccacccaggcgtggacgacacggagggtgctgcttggatttgagttttttttttttcatacatcatgttgaacgaaagagcagaagcattgccactcatttacagcatcacatacatttccgtcatccactgaatattcttctaattcacattcatagaaggaaaagggactgctgcagtgaacagttctttctaagatatgttgattttctctcagagaattatatggcaaagtcataaatttctccatttctcttctctgtcttacatttacaagtttattgtttagcctatgggggaaaataataatattaccacagggatagtaacaacgagcaatacaattgtacaaagttgatgaaagacaggttttgtgattcagtgtacagaataatttctatatatttatcagcagttaatgtaatatactatcctaagcttacccttggcattaatataatctgaggatgcatcttacaaatcactaactgcgaagttcccttcctcccctcctggtgctttacatctctgcacagatatatattcacttctggtagtctgttagcttgctaattgtgatcagtttgaatggttcagagaggtaggcttgagtatgcgcagaaatctcctgcgctacagatctcatggaaggcctggattcagggttcacccttgtgcaaccaagcgcgattctcacgatgaacacgacctcttctgcgagctgccctgttggagcatccagccgctggtctagtatgtccttgagcagtagatcatcttcttctgatgatgagatggctggcagggatgttaagaggtcacctgggtgctttcccatcatgacctctagcgcaaccacgccaaagctatacacatcgcacttctccgtcaccctcatcgtgtatgcgaattctgcaagaaataatcgaagtcggtaagtgttaatggtgcggtgccgtacttgtcggaatttgagcagttccttttcccaatgacaatctttcaaagttctgcaaatcttcaggacaggagtatgtggcaatctattcaataatgaccactctacttacagtaatgacttcagtactttcatgaatcacaataatgtgcaaaacaatcttaaatagatcggatctgagtttctttctctcattttttccttttttaaacaacagacaattcgacaactatatttcataactactgctcttcatttggtagttacttgcacaaaatgttcttttatggtcagaaatgtttgacagtttatcatacactacattactacctgggagtatcgaactaaatttagccatctggtttttcgttaattatgactgaaacatcccaaatgctatttggtgctaccataaggatctcactgaagcactttgaagtataactaggatttgatattataagctacatttcaaaaattgtatgcataagaaacatgtgacattttaaggaaaaaaatgttcaaatttaagaaaagtacctggagccatgtatccatatgatcctgccacagaagtccagttcgtcgatgcacccccaagcaacttcgccgtgccaaaatcacacaagcgcggctcaaagtctgactcaagcaggatattattaacagtaatatcacgatgaacgatggctggattgcagtcatgatgcaagtaagccagggcatgagccagcccctgcaccaccttcaccctcatgccccaatccatcttcttcttcccttcctccccatacaatgtcttccccaagctgcccctttccaagtactcatacaccaggtacatgtagtcaccactggtgcagaagccatggagcttgacaatgttgcggtggcggacctccgtcagcgccttgatctcgttctcgaagctcttcttgttcacatccggtatgtcacccgtgtcggcgacatggaagcgtttgacggccacaacctgcccactggagagctcagcccggtagacacttccgaaccctcctttgccgatgcagaaggtttcattgaagttgtccgtggcgttcacgatgtcgaagaatgtgaacttgccttccttttcccagattgtggactcatatgaataattggtgttagattccacctctttcttctctctaggcctcctcctgcataacagtatgatgcaagtaacaacggctagtagtaacaccactccaactactgacacaactgttgcaatgactactctcttgtgatgcccagaagatgatccggtagaactgatgtcacaaggagttagaccttgcacatcaccacagagccccgaattcccaacatatgcagaagctgaagcattctggaaaacattccctgacggtatactcccggtgagtcgattataagagaaatcaactgattcgaggcttgacatgcgagaaaaccctgccgggatcgaaccactgagctcattgtgtgataagttcagtctctgcagagttatcagcttctcaagatttggagggatcgcgcctgatagagaattgctgctcaaatcaagcaggatctgcagctgagccagattaccaagctcacttggtatctcccctgacaacctgttcttgctcaaatcaagcaatatcagagcatcaagcttgctaatggcaactggtatcgtcccatcaagcatgttccctgagaaatcgactttctgaagcttggaattgttgctcaagctcgccggaatcggcccggaaaaggagttatggctcaggttgagattgaagaccctgatatttcccaacacaggtggaatccctcctgtcagattatttccagccaaattgagatccttcaagcttgtcatgctcccaaatgccgccggaatgccgccggatatgcgattgccgtcgagatgcaggagtgtgaggttgatgcactgtccccaggcagacgacagctcgccggtgagcttgttcccggagacgtccaggtacaccagcttggggtgcacgccgaaggcctccgagatgtcgccggtgaagtggttctcctccagccggacacggaccagcgccgtgcagttcttcaggcacggcggcagcgcgccggtgaagttgttgtagttcgccgtgaggtggtccagcgcgaagccgtcgcagatgtggcgcggcagctcgccggagaagctgttgttggtgaagctcacgtgctgcaaggccaggcccttgccgaggtccgccgggatggtgccgctcatgtggttgtcgaacacggcgaggtactggaggctcctcagggccgtgatggtggctggcagctcgccgtgcagactgttggtgttgacgtcgaggctttgcaacgccgtcatgttgccaatctccggcgggattacgccggtgagattgttgaagaatagcgccaactttgtgagctgcttgaggttgccgaacgagctggggatcggtccggtgagcgagttcaccgacaaatccagctctgtcaggttctccagctcgccgagctctgccggaatggagcccgtaaacttgttggtgaataggtagaggatgttcagtttgctcgccttgccgagctccggcggaatcttgcctgtcaacgagttgttctgcacttggaaggatatgagctccggccagctcgtgaacaacaccggcgggatctcaccggtgaggttgttcgtggaaatgccgaagtaccgcattgcccgcatcccggcgaactccggcggcaagccaccggagagctggttcaaggacagctcgaagaaaatgagattcttcagatttcccagctgcgacggcagagttgaagagagccccgagttcttgatgtcgagccgctgcagcatctggagctggccaagaaccggcgggatcggcccgccgagctggttgtcgccgagttcaagaatcctcaactgcggcatcgacccgaggaactccgggacgccgccggtgagattgttggcggccatccgcaggtcctgcagcttcgtcaacttcccaagcgacgccggaatcgggccggagaacgcattgatggacaggttgaggtacctcagattcgggagcttctccggcagcgtgtccggtatcttcccgaacagagtgttctgcgacaggtcgaggtaggtgatgttgccgcttttgaggatgaactccgggaagctgccattgaaggagttgaggtagagcgacatgaacgtgacggtgggcatcggcgagaacttggcgaagtcctcgtcggtgaggtagtttgctcccaggtcgaagtgggcaaccttggggaggcggctgagctggtgcgggatggcgccgacgaggttgttgttgtagaggcggaggtcgacgaggccggagaggtcgccgagctgcggcgggatggagtcgctgaagccattgttgccgaggtcgagcgaggccagcgagcggagccgcgagatgctcgccgggatggcgccggtgaagttgttcccgttgaggtcgagctcggccagcgccgggagcgccgcgaagtcgagcgcgtcgaggccgccgccaaggccggcgcccctgagccggagcgaagtgacgcgggcgccgccggcggcggcgtcgtaggccacgccgcgccacgcgcacaccggcgcggcgcggctccacccggacagcgcggccgcgccgtcctgcaggccggccttacacgccagcagcgcctccgcttccgtcggcgtcgccgcattggccagcgcagggatggcatcagccgccacccctaggatgatcagcagagggaggacgaggcgtgccatgtgggattgtgggcagtcgacgccttcattggcgaactgttgtgatacgacgagtggctaaaacaccagcaaatgggttcgtcgcacctccaaagccacgtgcgcgtgaattcatacgagcgtcgccgtcgcttcccgccatattggactctggctaggtcaatcgttcaaaatgggaggatttcttccacacctgcgtagctatctctcttacagcaatgtgaaaatcgcaagaatcactctgtaaatgtcatttgagtttgagattttttttatataaactaatttattacaaatatccccttctaatttaccttggttattttgagattcttcctcagttgttgtcgctcgcaccttttttttctctctcctcaaactcaaggtaacatttaggatggttttttaataattttccaatatatctttaccaattcataagtaaaactcgatgcaggaaataaaaacaacatgtatttgttgttaaaaattcaaaatgtctctgcagtttttagtgtttaacacctttaaatattagacatatatttgatcatttatcttattaaaaaaaataaaaaataagtcatgctaaaagtatatttaataataaattaaatcacaacaaaaataaataataaatacatatatttttaaataagataaatgattaaacatacgtgacataaacattaaaaactagagggaatatcttttattggcttctatctagttttagagcacattgtggctatgttaggagatttattctaaaaaataaaaaccaaaatatatttaaccggaacttcctttttaaataaaaaataactagcacggtggcccgcgcagattgcgcggctaacatcattatattttctctcatataatagcatatatgttttctcaatgtatcattcaaatatattaaaataacaacataattttaaattttgtactaactttacgaaactactaatgtttaatatccatattgtattttatatatgtgttagttattaattatgtttaatatcaaacattagttattggtaaattatattcctataaaaactctagactcgtctttgaatatttcttttttaagtaaaatacactagcggttcttaaacttgtcacgaggtttcacttaggtccacgaacttgtaaagcgcacatcgagatccctaaacttggtttaatgtatcatcccggcccaaagcgttgtttgaccgtggtcttgcctacgtggatgatggcatggtggctcttttttcttctccactttactttttcctcctattcttttatcttcttcctccactagagctacctcgagctcccccttgtcgaagaggtcgaagaagagagaaatgaacgaggaagaagggagaaaaaaaataataatgtgccatgtcgtcgtctacatgtcatgccacgtaggcaagactatggtcaaacgacgctttggaccggggtgatacaataaaccaagtttagggacctcaatacacactttgcaaattcgtggacctagatgaaacctgcttacaagtttaaggaccgccagtgcaatttactctaattttattatgtttattccgaattttagttagttttacactcctatatggactctatactctacttctaatattccttatttttaattccgaatttctattatttcttaattgtatttctatatggaatctatactctacttctaatgttccttatttttaatttcaaatttctactatttcttaattgtatttctatatggactctatactcttcttctaatattctttattttttaattctgaatttcagttatttataaattgtatttctatatgggctctagtctccttttccaatattccttattttttaattccgaattttaactatttctaaattgtatttctatatggactctgttttttctttttttccgattaatatgagaatttctagaccgtgagaacgaatatggaggtttctttttctattcttttaataagttaatagattggacaatcaaatttgtctagtcatccatctgggtgagggaacaactataagggttttgttataaaaaaaacaggttctattgaacgcttctagcacagttcaaacgcttaggagccgggtgcatgtaagtaattattcagcgaagcttaagggcttgttgatttgatgtcattttcaacccttcagtgatattttatggtaattccagagctttccactctcaaatattctaccaaattttggtaagatgcacaaaccaaacactttcatccacaccttattaccttaccaaaaattggtcatggcaaaatttagtattatcaaattttggtaggtttattttcgattttgctatatctcactcgaaagattttttcttatctctcactcgattttctcacttaaatttacagtgcattttcttgtaagttacagtgtaatttatgaaacttacattgtaatttgtaagttacagtgtaatttttgaatcttcgcatgtaagttttgatatttgtattggatttggtctttttcttgaagatatggtaatttagtgtccattatgatatttcttagttgctttttgccttttactgtgtttatcagattttaattcaaagattaaaaatctgtatgatacgattataaaattttttcgaaagatacataggtactcccgtttattttagtgaagtaagcaagcactgaaatcctacgtcagccataccctgttgaccatagaatctcctatgctggtagtagataaatacattcacatacattttttcagtgatatttcgtacaaaaacaaatgttcttaacacaaaaatcaaacaaatggccctcaacaatagacaaaatgtgaaaataatttgtacaatattaggtgtgtaatcatcaatacagaagttacaataaaattttccttccaaaaacacaagaaggtaaccgggcattcacacggccttttttttttctcctttgtactttatactaagaaagtgagaattttacattattgacagtttaaaaaaaatatagtaattaataactatgtacacccacactaatacttcttccatgcttttaatatctcaatttattatttaaaaaatagaaataatagagttatatctgtgtttgagtctcaatttagcatattcatgatttgataatttcgaattttggaattaacaaaaaccgagctgtcctatgcttggtctgtcaatcatattttctataatttaggtcctatttggcagatctcacatgcacgctggagtagtagtttaaaattttgtatttcatctaaaactaaagcaaaatgattcatccaaatgtaatgaatatagtaattcgatttcagatgtaatgaatatccaagcatagcagcatttgttggtagtatataagatggacatgttccatataattttggatggatgcagtaacttcttacatcttagtcttgatacaaaggaagtttgttgggggtcctatgactcctgccaattacagaacactgacaaaactaaccatgctacatcttcagatggtacagaaagaaaacacacagctacaaatactgatcagtatttcctcttgaaagaaatttatcaacagaggagactttctgcataactttacattgcatgccatcaacaaaaccgaaaatggcatacctccaggttccgatggaaaggagcattccaaaccatagccaaaaaccgaaaaccactccagccattacacagtagtagaaatactggtcctcgcatgttctacagtctctctcatctgacgcaactgaagcatttgtgcatgaaatgttcaacggagggccacagagccctgaattatggctgtatattgatgggtcagtgaaggtttgaagttgattcccggtgggtatcttgcctgatagatgattatacgagagattaagagtgctaagggtagatataccagcaaggcttggaggaatggctcctgaaatttcatttgacgagaggtcaagggactcaagatttttcaaactacctatgttttcaggtatcccacacgatagattgttccttgacaagttcagaaatcgaaggccttggaggtttgttaactcatcggggatgcattcagacaatgagttacctgacaaatcaatacccgtcattaattgaagtgttttttggaaaattatctcctgccccttccagattatatcgattctatcctgataggtagacccatctaatgatcccgcactggatacaatttttggattcttcatggatgttaagttgccaaaagatgtgggaatcgaccctgtcaaactgttgttggtcatatctagcagttggagttgagaaagatgtgataactcagaaggaatttcaccggtgaagttgtttgatctaaggctaagaatcttcaaagatgaaaggcctttcccaatccaaggaggaatgccaccaaagaaattgttgttcccaatatctaaagtgaccagcgtctggcatccctttagcgctgatggaaaaacaccggtgaagccgttgccggcaagatgaaccgattcaagagaacaattgtagcttgtattgactgcagggatttcacctgagaagcggttgtgggagaggtccatgaactgcaggctctgcagattccaccagcagtcaggcagcttaccggtgagcttgttgtttgacaggtccaggatctggagagaaagcaacctgcaaaaggccgagccggagctgctgttggaggagttgccgttcaggacgttgtacttctccggcatgactgcgccgccgtcgtatagcctccgagccggcctgctggagaagtctacttcatcattgcggtagtagttttcgtcgtcgtcgccgtcgtatattctccgtaccggcctgccggagaagacgtcgtcgtcgtcatcatggtagtagttgtcatcgtcttcgtccccatcgtaatggtagtagtgatcgtccacatcggcatcgaggctcaagctcgtcacccgttgaggagatgataacagcaagagggagagggagatgcagaggaagagacagaggcgcagcacgagaggggccttggctgccatggctggatttggtagagtgcaaaggagcttgtggaactgaagtattgaactccacttgtaaagctgcaggagtatttctttctctctttcttggtatggctatggacagggggcgaggttgaccgtgaccatgggggtcgtcgggtgggggtgctgcggattaggaatttggagcgctcgccgtgtcgcggtcggcgcatgtttcacacggcacagcgacagcgatggaccagccggctccaccatgtgagatgacttggactgatgacccgagaaaggcacaatggcacagtatccagccagagtcaaggatggagccaatggcgagcagtgcgttttgcagtcaaaatttcagaacacacggtggagttgtcagagacgaatggtaccttgatcatgagaggctcgcccgatgatggcgctcccgcgcgagcgacgtcgcccgccgcgctcctgtcccctcctcgccgtcttcctcccgccccgagtccctcctcctcctcccaggcatttcctcgagcacatcatgcgcgcagcacgccggcgagaccgagacattcctcaaagcgccgccgcctgggcaaaacccaggctaggtgggggaccgagctctggccgccgcggatgctgcagcgcttctattggagccacgacggcggcggcggcgcgcgacggccgggaccctcgctccgccgcgtcggagacagaagccgacgccgacgcgagcgcaaagtagctcgttctgacgcggtttcgtcctcgattcgcgagcccggcccaaacaaaacgaaacgaagtccgcttccgtcatctatacggcccattattacatactccacacggtgcttttgttcatgggcttgatccatttagtacggcccagcacagtcctcgtctcgatggcccatcacctgtaatgggccgtacttctccacggtgctactagagatggcaatggggacccaaaacctgtgacccgacgggtttttactctattaggagctaattgtgttctaactcttatacccatgggtctactaatgggcaaaactcttacccattaggtacgtgggtatgggtccgttctttacccacccatacccaccaacccgtgggtgaaaaaacctattgattaagcctaaaactataagcaatataagtctcaacgactactaaatcataatatgaaactcctttcacatcttaagcattgttctattctagttatatgaaattattatttgatttcttgattatgtatgtggttgtataattttttttactcgcctttgtatgctaatgttaatatattattgctagagaaaatattgatggtttacaactctaatatgactaattatagtacaaaactataaatgctacaagtcaactatatgggtatgggtacccgttggatacccgttacccgcacgggtgtgggtatggggaagattttgtacccgcgatgggtgtgggtatttaagtgggaaaatttagacgttgcgggtgtgggtatgggataaggaaacctgatgggtatgcacccgttgccatctactgctacacgcgcgcctactaacgagcggagtcgtcaggatgatgaccagctgacgtcacgttggcttctacttactctctccgtcccataatataagggattttaagtttttgtttgcactttttatcactcgtcttattaaaaaaaatttggaattattatttattttttgtgtgacttgctttattatccaaagtactttaagcacaacttttcgttttttataattacacaactttttaataagacgagtgatcaaacagtgcaaacaaaaactcaaaatcctttatattatgggatggagggagtaacattttctgaacttcatcgggaaaagcaaaaaggtttattccgtaattccgtatgaaacaagtgaatagcgatattagacgaaggcagcgacataaaattgtactaggctcatagcaaggaattcatatcaagttcagttatacttgtaagaggaggtgcactaacatactgttagccagctataaacatatttgtcaaggagtaatcctctctagcgggagatcgtgagatcccctttttgtgagttcggccgagggaaaaggctcgcttggggagatcgcgtattcgccttgaacgctgctatatcatgtgtgagccccaagattatacaagttcgggccgctatcgagcgtaacaccctactcttgtgtgtgggattatggctgagtgttagaagggttcctaaactccggagagcgctcccgcttctcttctcctagagttcaggtttactgagagtcgtccccttttctcggtgggcaaggtcctccttttatagttcaaggggataccacatacaccgcctctacctactctttcatgggaggggcacccactctatcttgaccgggccacgatccgtgccttcgcccggaagctaagcagcagtccgtccttgagcgggacccagtgctgccccccgcctgacacgggggacagccctttcattccctcataaatgggtgaagacttgcggtggtcctcctccacggagggaactccaaatgacgcttcgatgggacaggacatacctatctccactccgccggagacagaaacgacgtgggggcacggccgcccgtcaatcggacgtgaccggcaacaggccggtcacagattggtcacgtccgactgacgtgggtcagtcaggcggcaccgcacgtctgcccttaccgcattaaacgcggtgagggatagttggggcgccgcgcattgatggctgttcagcccgggtcctctccccactcactccccccgccacatggcagctgggcgagagccttgaggtgaggcagcgcgaaggcccgaggggcacgacatggcaccccgaggcccctcggctgcttttgcgactcgcgaggtgcgggagtagggccaggctgtagagccacgcggcaggataggaaggtaacttcccctcactttgcatacccccgggcccatatctccgacagtagcccccagcaccacgtcggacattggtccctcgaggacagtctgacgtggcgcctcacgacttctcgtgccgtggttgtgggcccgacgggaaatccagacggttgccggcgagcggccaggttggcacattagccaaaatggcgatttgaccgccgttaaccgcgctgatgatgggggcgcctagggcgcgaaaatcagggggtcggctagaccacgcctagaatcgtcacccacgccgcctcgactccctcgccctttgtgagttcggcggggggcagcgggtgagatttgagggcttggtgggcaaagctgtgtgatcttgagggggttcaatcccccaaagacgatgagacaaaagggatttatacaggttcgggccgctaagaagcgtaataccctactcctgtgcttgattgattgagtgtagaacacaagtgcttggggttgcaagacccaagtgccagttcgctcggaagtcccccctccccccttctctcactaggactggacctccttttatacctcaaggggttaccacataggcccaacaacctaacttcctcgagaagtattacaatctttgcattaaatgcatgtcttgttccttaacttggaagccgcatacacgtcgcctcggtcgtagggcctaccaaaccatgccgcctgacacggggggcgcccatgtcattcaccatttaatgggtgaagacttctgggctcctttacaccgggaaaacgggagcctagctttaaccagagcgggaggaccgactctggctgggataagaggatgagaacctctcattatcattatttgatgggacatgtcaggctgcacgccgcctgacacacgagcagcgcacaggcgtactagccagtcccatcggtcattcgaccggtcacagaccggttgagtacactgacgccgcattaaatgcggcgtggcgcgaccgctcgagtcgccataaatgcgggtaggtgggcacctgtaggcggacacctaacccaccgtacgtggtgacctagagagggggtcgggggagcccaacccctagtcatgggagggggcggtcgccgcctgacctcgggcccgatcccccctcgggggagggccacgtggcgcctggggcagccttctctctctagtctcggccagggagtggccgccgccctacctcgggcccgaccctcctcgggagagggccacgtggtattggggggcagcctcctccgtccaatctctgggagggagtggccgccgccctaccttgggcccgatcccccctcgggggagggccacgtggcgcctagggcagccttctccctctagtctcggccagggagtggccgcagccctacctcgggcccgaccccccttgggggagggccacgtggcattggggggcagccttctccgtccaatctctgggagggagtggccgccgccctacctcgggccggactcccctcggggagggccacgtggcattggggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattggggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggagggccacgtggcattggggggcagcctcctccctctaaacatgatacccccgggcctatatcaccgacaatattttaatgagataaaatatgagagagaagagcagcgggctacagatctgtagccagctgcagcacggatttcaagacgtagtgtgtgtatgataggtaggacaatatattaatagtatagtaagtaactactgtataaattggctattgtattggctatatgtgaattagagctagtagtgggctattctcctgaatttgctctaactgcaacgcacacgtggacccacaatccagagtcacacggatcgagcctacataaattctctgtatttattgtagaggataacatgtcataagtaaaataagagtgtgtttaattcacgttaaattggaatgatgtgatagaaaaatttaaagtttgtgtatacaaaaattttaatgtgatggaaaagttgaaaatctgaaggaaaagtttgaaactaaactcggcctaaatctcaatgccatagtgaattgccgtaaattgttgtatcgtcattagtgctagttacgacggcaacataagtaagtactcctaaatttgttgctgttgctggcttgctgccgcggcagctatacccagctggtgcaccatatatagacagtttttttctttactgttgcgattcgacgtactagtattatttgatccggagagtccacacaactgaacaaaatggctaaaattgatcctaattctgcccccatgttctttcttttctacgtttattagtacttcagaaaaaactaaccaacttcaaatattaaaagatggagggagtatatatcaacctgttgtattgagctttacattagctattaccgcaaattatcctctttttttcttaaacaacaagtacaatatagtatgacgtttctatcgatattaccggagattatcctcattatgcagaagcacgtgtctagcattagtatgacttttacgcgaacattcgtgtattagacgtaccctcgactcctaccgaaatgtggtgggaatgtgagatgatcaaagcagtagcttgacagtcttttttgctagccccctcaattatttcactccttcagcaaacttggacacaatacgtcaatatcttgttatgtttttatttcttttgatttttttttaaaaaaaactactcctgcatagttatcgtgttatgcatggtggtgatcgttcggttcaaagtttcaaacacacttgttcacattaatggaacccaccgcagttaatagcgctggagagggccatactcctgtgtgaggcagtacagtttgttgcgtgtcgtgtagccgtacgagctaccagtctaccacagctatctatctcgcggagtaataatgacttggacttagagcaggtacattagcaggctataactgcaaacatattttaagaatataaatgaggagagagagaggagcggtgggctacagatttatagccatgtgtagcacatactccaagacacagtgtgtgtatgataggtgggactagatactaatagtgtattatataactattgtatgaatgaactattatattggctatagataaattggagctagcagttggctatactattaaacttgctcttaggaatgtactactagtattattttctgttcctaaatatatacatcttgattgtttaacaaaaatggtactactacattggttgacaaatcaaaatattttttattacctcattggttagattttaaattgtttgtactcttctgattgatccatttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgagagcgagcgctcgccatggagaacggcgccggcgccggggacgacgagtacacgcgcgacggctccgtcgacctccgcggcaaccccgtcctccgctccaagcgcggcggctggaaggcctgctccttcatcgtcggtacgtgtaacgtgttcgtgtgtatagtcgtcgtcgccggcgagcttggtggtgatgtttgtgtggtggtggtggtggtggcagtgtacgagctgttcgagaggatggcgtactacgggatcgcgtcgaacctggtgatctacctgacggagaagctgcaccagggcaccgtggaggcggccaacaacgtcaccaactggtccggcaccgtcttcatcacgccgctcatcggcgccgtcgtcgccgacgcctggctcggccgctactggaccttcgtcgccggctccgccgtctacctcatggtcacatctctctctctctctctctctctctctctattcagctacataccctgttctcttctgcctctgtctctcctctctattcaacggaaaacaatattaaactctcgacaactcaaacaccacggttatggaaaaatctgaaaaaagtttcttaggaattttgaaacagttttactcctgcatgaacggagaaaaaaaaaattctgaagcatggtttgcaatttcggcgtatgcaaattatagctcagtaccgaaatttctgacgaaagagtaatttttttacacattttaaaatttagaattcgggtcttttaaaactgtttaagcttgattcttttgttttcgtgtaatctcatctgcatatatatatgtatgcagtggttaattattgacttctcatccaaatatgataatatatataattggaagaccctatcttgttttactcaactaatttctcaaatgtttgaaaggcatctaatatctccttatcataaatgatgttatattatattcaatataatttgtcgatatatgattagaagaggtaatgattaaagacctctcgtcagctaatagtaaaccggtcccttgtccctatccaaatttgcatagtagaccgtatcttcatgctacttcacccctgttaattaagaagctactactctctccgttttatattataagttattttgggtttgtattaactcggttctcttcaagttttaccaagtttataaaacggtcaaattagttttataaatgcatcattgaatatatttttatagtatatttattttgtgttgcaaatatcgtaaagtgaaatttactcttatatttttctgtaaagttttacttatgacagactcgaagttacgaagccgggtagtggtaatgaagcaatcggcaaaagaaaaccattctcccttttttttttaatcaagaaaaccagtcttgattggacaaaagaaatgtcataatactcacttcacttcatttgtcctgtttgcacccataatggggttcacttcacttcacaatgtcccttttaaaaaaggttttacaatgtcgacagtaaccgctttgttatcgtaaaccgtgttgcactcaccacacaatgttcataaaatttacctgtatacattattgatggtgtcaatatcattaacaatggggagagcaatatttcgacggaatcttcattttgaaggaaatgcctggatttggagataccttctgtacaatgaaagtgcaagaatgaatgccatgtgtgtgtggcatcccagtaggccggccgtacgtcattttgtatctttgcatttgtatcttcgaagacaataatctgtgtctttccaaactaaatccgacaaaaatgaaaccatcaggaaataataggtcaactaccatgaccccatgtgagatctggtcctgaaaaataggacaatggggtgtaagattgacaccaggttttgcttttgatataagcaagtaggggggtaatcctttccaaaatgtccaaaattagtacagaggattgatgtgttcatgttgtgacttcaagtccatttccactaaaaaattggagatttgggtaaacgtcacagctaattacgagagcatgctggaaaatgcatcttttgttttagcacactttgtactgttaataaaggttaagttctactccctccgtttcaggttaaaagacgttttgactttaattaaagtcaaattgctttaagtttgactaattttatagacaagtatagtaatatttataatactaaattagtttcatcaaatcaataattgaatatattttcataataaatttatcttgggttaaaaatgttactatttttttctacaaacttggtcatcaaaaatcaataattgaatatatttttataataaatttttcttgggttgaaaatattactattttttttacaaacttagtcaaatttaaaacagtttgactttaaccaaaatcaaaacttcttataacctaaaacggagggagtagttagtactaatatgcttttctaaagtagaatatcaacttcaccaatttttggtttggtgggaactcaggcttctaatttgggctttactggtgcaaactgcaaacccacacatgcttgacaggttaacctaacacaaaccttgttcatcacagtccaagtagaacttctagaaaccaaacccaagttcaatttcaagctgaacacatgagtttgaacattatttattcgttcaaattaaattcacctgaaatttggaaacacatggaagaattcctctctttcaaatttcttctgaatctgaaccatccaaattaacaaacgcagggcatgctgctgctcacactggccgtctccgtgccagcactgaagccgccgccgtgcgacggcggcggcggcgccgcctgcccgcgcgcgtcggcgctgcagctgggcgtctacttcggcgggctgtacaccatcgcgctcggccacggcggcacgaagccgaacatctccaccatcggcgccgaccagttcgacgacttccacccgccggagaagctgcataagctctccttcttcaactggtggatgttcaccatcttcctcggcatcctcttctccaccaccgtcctcgtctacctccaggacaacgtcagctggaccgtcggctacggcatccccaccctgggcctcatggtctccgtcgccgtcttcctctccggtacgccgctgtaccgccacaaggtgccccagggtagccccctcgccacgatggggagggtcgtcgccgccgccgtgtggaagtggcgcgtcccgctccccgccgactccaaggagctccacgagctcgagctcgagcactacaccacccgccgcgggttccgcatggacgcgacggtgtccatggcgttcctgaacaaggcggcggtgaagccgggcgaaggaggaggaggatcggtggcgcggctgcccgggtggacgctgtgcacggtgacgcaggtggaggagacgaagcagatcgtgaagctggtgccgctgctcgccacaatggtggtgccgtgcacgctggtggcgcaggcgggcacgctgttcgtcaagcagggcgtgacgctggaccgccgcatcgggaagttccacgtgccgccggcgagcctcggcgcgttcgtgacggcgacgatgctcatctgcatcgtgctctacgaccggttcctcgtccccgccgtgcgccggcggaccaagaacccgagggggatcacgctgctgcagcggatcagcctggggatgctgctccagatcgtgacgatggtggtgacgtcggtggtggagagccagaggctggggtacgcgaggaggcacgggctggtcgccaccggcgggcagctgccggtgacgatcttcatcctgctgccgcagttcgtgctgctgggcgtcgccgacgcgttcctggtggtggggcagatcgagttcttctacgaccaggcgccggagagcatgaagagcctcgggacggcgatgtcgctgacggcgtacggcgccgggaacctgctgagcagcgccatcctcgcggccgtcgagcgggtcaccggcgccggcaaggggagaacgccgtgggtgaccaacaacttcaacgcctcgcgcctcgactactactacgcgttcctcgccaccctcgccgccgcgaacctgctggcgttcgtcgtgctcagctgcaagtactcgtaccgcgtcgagtccacggagaccatcgacgtcgacgtcgccatggacaacgtcgcgcagggcggcggcgtggtgacggtcaaatcagaggcagccccaatggcatgacagcacttccggaattgtatcctgtctattcccgtctggattctgaagttgcaatgtaatgaagaaacggtgatgatacatattagcactttaaaaatgttaaatgaaaattttatttactcgttctgtaaaggaacggtaatacggacaatattcacagcttcacacaatcgcactagtagcaccatcgtttctcttatgcctatacttaagctaaaatgtgaattttaaagcttcactttagagttgattttgtgttttttttaaatatagtttattttacagtatttgctttcgaatcgataaggacacgtcgcataaattattttttaatttgttaataaacgattcgcatgaacgtaagtataagtaaaaggatggaaccataaatatctaggagtaatttggtgacaacgatggagatgcactattacagtcatgacgctagaggcaactaactccatccatcctaaaatatagcaatatagtacatgatgggacatgtatgtccatattcatagtactatgatatatcacatctcatattagattgttatattttgcgacggatgaagtatttgagagatactagctccgttttttaatagataacgccgttgactttttctcacatgtttgaccattcgtcttatttaaaaaatttacgtaattataatttattttgttatgagttgttttatcactcatagtattttaagtgtgatttatatcctatatatttgtataaaatttttgaataagacgaatagtcaaacatgcgagaaaaagtcaacggcgtcatctattaaaaaaacggagggagtatatcatatcggccgatgatgtaagctagtagctgatcctttcaaattatttatctttctaggtttggacttaagtcaagtatttccatctttttaccatcagatatatgttttaacaacatggaaattatgtaccaccagaaaacaaggcacgcttatatataacgtgttcatatgactaggtaacactctaactcaactggattgaccgtagtcagctcgccacctgagctgaaagcaggcacaatattgtcgatctcggatacttcgctactgtaaattgacgaacatgacatcaagacgagaaatctaaggaataagtccagtttgactcccttaactagtgaccgaatttgatctgtatccctaaaccacaataccggatatcttcgacccccaaactattgaaatcggtgcaatttgactcccttggcggttttggagggcagtttcacttatgtagggcccgctcacatatgggacccatatacgatcctccctttccttcccttattcctccttcctttctctctctcccccttaccttcccttcttcctcctccctttctctcccttaccgttggtgcaccagtagttcagcagcggtgccgggaccgggccgtcgtttgttgtttgttgggaggacgccaagtagggcgacgtcgaggagcgagacggtggcctctccccggaggtcctagtggcgtgggcgccgagccagccgcggaaggagacgcggatctaggtgttagagacggcggcgcggagaggaggagggcagaagggggaaggtggggccgggactccggcgagcggggcaatccccgttcacgtcgctcctctcgaccttcgttgcatgggatgctaccatcggttgcccactcatccgcgccaagctcgatgccatgggggccacatctaccaccagcggggcccaatgaggcacgcgggggcaaggacatgagggcgcgccacgttggggtgctcgtcaagatgtgctggtgtggacgtggatccctgacgcgcttgtttggatttctgcaggaagtcgaagctgtcccgccggcgccactccagcacctgcccgccaccactccaaaacatgctcctcgcacacgactgaagaaggggtagagagagggagagaggagggagacagagggaagagtaagaagggaaggagagagaggatgacatttgggtcccacatgtttgtgggtccacaatttttttttgaataacaagtgggtccacaatatatatatatatatatatatatatatatatatatatatatatatatataagttctaatgacatgtaagcgccacgtcaacgccacgttgtacgaacactaggtcaatactaccacgtaggcgctacgtcagcgaagctgccctccaaaaccgcaaatggagtcaaattgcgcccgttttaataggtgaggatcaatatatccggtattgtagttcaatgataggaatcagattcggtcactaattaagtgagtcaaagtgggcttattccgaaatctaaagtaagcttatttcataacaaaattcagctcagttactcttgggtcaataagctagcctaataaaccgggaagaaaagtcagaaaacaatctcgctagcttccacctctcatgctgcagcatgcttataaagcaaagacaaatctagggttgatttagccttcatactcaatggagttattcctatatgctccgctgagatatgttgtttgtttcactttcaatcggttaaacgttgactgaacagtcgtcatcatcacgatgtaatttctacctttcaatcggttaaacgttgactgaacagtcgtcatcatcacgatgtaatttctacctggaaaggaggcgtcgaaggagcttaatgaaacatatcaaatacaatgcaattagacaatatgagtgaactcttcatccaaataaatccttatccatgacccaaaaatcattctcttccattatctgaagaagattagctcaccaagttagtagaagtgttcatcatctatcctcgactagttcaaaagcagcaagaccaccttcccacggtgtgtaaatgaaccccaaaacagaaaaaaaactcccaaataacacgccacaaaaggtatggtaggtgtggcttgacaatattacattcactggttgttaggttaagcattaaacaatcacatgtctcagcatctgccactataaaagttcatttttaaggacagtcatatagaaactttaattttctgagtctaattattggtcttgataatgtatccaaacatttacaatcgttatttttcatgatccacacatactgactatgacctatatgaataatgagacgaccaatcaagaaaactgtagtaaagaataattaggcaatttgttttgttggtttgttgtgggatatgttatatgttaatcaagttagtccttcttattggagttgaagagatgacataaaaaatgtttctatgtgaacaaagtaacattaagaagataacccgttaaactctttttttcttatagtaaagcgttcaactttgtgttgcgactccaaagctttattatggcacaaaaactttacacaaggctctaattattcttttactataaatcttaatttgttatgatgatgatttttaaaactaacttttaacttttaatttgttgagttggacgacaagttcagttatgtaaagctccaaggtcactgatagaagtgagcaactgttagtattttcatatttacttttcaatgatttatatcctaaatggcaattgcggagttcattacatatatatcaatagctaaacttgttatatgtattacaggattgatcagttgcttaagcatcatctcttatcgcccttataggaaactatggctcaaaaataaaaacatttaaaggatattatttttttctaaataatatggttcattgcatgttgagttttttgttacaactatataagatatatagttcttattgatgcggcttaatacatgttgatttttatagtaatgactatattaagtgcgctataaatgcaaatgacatataaatgattatgattaaaacataagaaagattgaactattattattttctatattatggctcactgcatattgagcttttgattatatctactattataaaaattgaatatatttttgccgtcattcgtattttggtatgtcatccgtatttgagtcattttttaagttcgttcgcttttgaaaatgtagatccgtgtttgagtcagattttaagttcgtttgcttttaaaaatacaaaagaagtcatacaagaaatttctttaaaagaacttgcatgctaacttgggattaaagtcggactcctaactgcagctcatgtttttttaaaaaaaatatccaagcgaattcctgaatttcattctatctaaaccgtataacaataataagattaaaataacattcacccattgcaacgcacgggcatttttctagtaactatataaatatgatatatcaataatactctagcacatcatatcttcaaagcaggttgcggaggacggtcctatttatatttctataaaagtgtacggatgtttgacaagtggaaaatatccaaatcccccttaaaaatctctttagagtttttaatgctcatgagttatattcctatttaaatactttttatcctggtaaagggatttcttcttggacctctttaaggaatacctacctttttcccttttccatgtctagaatcatcgaagagaaattatattgacaattcaacgtatctttaaacctttccacaagcatgcatttcttgcttgccttactttgagtagtccgcgtgctctggactgtgttaacgaccaagtttggtaataccagcatcggagatggagatgggatcgaagcggaatcgaagatgatggttgttgcggaaacagagtaaaatcggctggagtccgggtcggctacgactgggatcggctaagtctgagttagactgggttaagtgatacagccgattccgacaatacgatctgtgtacgatgtcgggttcgagttgatgtgcttcaagatgattgccatgcatggatagagtcctgggaaggcaattgtatctattaattaggatattttatgtaaattccttagagatatgtttgggcaaaagtctgccgcaaagacttatggtatcttagagtttgttagaaatagtagtcgtgtccggtatgggcatatcttgtaattttcgggtataaataggccccgagccctatgtaatttttaacacacgcacgttcaatacaatttcggcgcatcgccaccttttgctttagttttatttcgacgagttcttactttcgggttgagctgcatcggtttcgatcttcgacaagaggtaaaacttgttgtgatgatttgctttctcgggattagtgcttccatctcatgatactctaatcttgtttatgtgattcgtcaagttatcatatatcttacgtaatctctggcaataccgttatctaacctacaattggccaacatctatcgaggaaggcagccgattaggttagatgtcgatgttgatttagattatataagatatctaccaccctatgaaatatccagcggcttgattgtctagatattgttcttcttttcatacttaatgctgcatcagttgagtttgatctattaagtcgtgcttagaatcataatctctagcctgcctttggttgccgatcagggtagtatcggagtttcagccgatcttatctgatttaactatatttgttttatatgcttaattgatatgttaagtctgccctttatatcaagatcttgtcgcatctaaatacgttaagcttctacttgagtattctacttgctttaatatcttaatataaagtggtatcggagtattagccggtacatactagatctatttgatcggctatgctataaacatatatagtcttgttattaatgtatattttgatctaagtgatttatattgtctcggtgtggtgaccgatctatcccaatcacttgatttaagtatacgtcgatataaagattatatattgttaatatctacagccgatcgagtagatttagtttcttgctacttattgatgatcgccgatcgattcacatacgacatcggctcggagataaatgatatgttatcggcacctagccgatcggctatcatttatagatttgaccacggtttctttgtctttgtttcttgttgattgcaggatcaaatcaactggcacgctcatacatccgaaggcgagctttggacctgcactggagttaagcagatctcccaggcctcgtgttttctgtcaacagactgttgaatagatcaaagtggaaagtggaaccatgcttcctctccttggtgagtttgccctccttcagttctagcaagatgatggtgacaatagagtcactaactcttccaggtgctagacatcgttactacataaattgacatatgtgacagtccaacatgacccatttgagatgatcttatctctaatagctatagagatccaaagtttggatccaaatttcagtccttttccatcacatcaacctgtcatacacacacaacttttaagtcacatcatctccaatttcaaccaaaatctaaactttggatccaactaaacacagcctaggttgaaaagtaccatgtttgagatatagctatagggaacgacctatcatagatgtgacctcacatctgtgcatgatgggtgacattgtatgaaccgtccaagatgagctctcactctaacagatctattatgagatgttacgtatgcacgggttttatctttaacctattagtcatcagagatgacttattcacttacaaacaacactaacctattatgagatgttacatacgcgctatggcgggtcttatattgaacccattagtcatcagagaagacttattcacttgtagacaacactaactcttgtaattcccgattctctcgtactctccacctcctagctactagcatcctcctctccacctcgagttgccctgcgttgacgacctcagtgctaatatagccaatgaagcagcaccccagtggcctttgcttatgctgccctacagcaggtattatactgccctgtaaattctaagttgaatatctaggaacagtattactgaatctggcagtgaaaccttcctgtgcttgtttctggtttgatgggatttggttgaagcaaacaaccatgactgctctgcttgtacaactcttgtccctctgctcagcttacttgaatgtgtactgattgtgtgcttcacccatctaactctttgaatttgcacttgagattgttttttctaggagctttctgttactgaatctgtagatgggcatctactgcatcatcgctttccatatggattgttgtgttcatgtctttcaagtttacatgactatatctcctaatcttaacatggatatgtatatcatataaaatttcaggcttcagaaatttttttgaacaaataatttcaagcatcagctatgcttcaagtcattgtatgaagtatgaaacttcagccatcatttaacagttaacattttggtgctaaacatattaactatattctttaaaagcttacaattattatgtctactactcttggtaaatattccctacctagcttctatattgtgttgctaagccacatataacattttggttgctaaacaacttctactactggatgttcttagaagacaaagaggtgcgtagagatgattttgtgcttgtggattgtaaaacgccaactgacacacatatgtatgtcctagcagacactacttctcgttcactgttatattgagtcagtatttcagatgggaagtttgtgtgccctgataaaattctgaaggtgcagtgccatgtggaccatcagaaagtagattatggcattcttgcgaatcactttgtgcgcataggatcaactttatacattatcccttcatctccaagcaaaaagatgggcacaattgagagcaggtgctattagccagctctaaacatattttaatgagataaacgatgagagagaagagaagcggactgcagatctgtagccagctgcaacacggactccaagacacaccgtgtgtatgacaggtgggaccatatattaatagtatagcaagcaactattgtataaattgactatttaattggctatagatgaattggagctagtagtgggctgtactattagacttgctctgatgatcaggctattacggtctgctttgttcgaacagaacgatctcctgtatctttcagttgatttcgtagttgaccatggtagcattgttggtctaggtgacactctgaagcatgtgtttatcctgcaaatggcgaaatggcaacacatggagacaatcctcgagttcatctctagatcgaactaggagcatcattgtttctgggttcgttagcctaggtgatacttctttcacagtgaccgatgccaagaccagtgacttcttctttccttgacttaatggatcaagaatggcgtgtcatcgggccacgagtaccctaaagcatctccaacagcctctccaattttgactctccaaatgtctatttggccaactctcaatctaatttggcaagtcaaactctttactccaacagcctctccatctatcatctccattacaagtcaatgataaatgaaacccatatgtcagcctcatcataccttcttccatctttttttccccacccatggccatactacatctcccttggcatgctgtttgggagatgtatattcattggaggatacatctacacaccatgggaaggtgaccttgctacattcaaatcagaggcacccccaatggcatgagagcacttccgaaattgtatcctgtctattcccgtctgaactctgaagttgctatgtaatgaagaaacggtgatgatacatattactgtagcactttagacatgtttaatgaaaaatttatttactctttatgtaaagaacagtaatacggacaatattcacagcttcacataatcacactagcagcaccatcatttctcttatgcctatacttaagctaaaatgtgaattttaaaacttcattttagagttgattttgtgttttttttttcaatatagtttattttacagcatttgctttcaaatcgataaggacacgtcccacaaactattttttaagttgttaataaatggttcgcataaacgtaagtataaacaaaacgatggaatcgtaaatatcgagaaaattgcatatctatcatcgtataagatgggattagctcaaataccattactcaaatgggcttcactgaaaaaacaatcctcaaccaagatatctttgctcaaataccatcccaggcgaaaatgccccttagcacttcttcttcctccctccctccttcgttgaataggttgacggtatagatggccataaggcccgcccggcacggcctagcccaggcactggctaggcacttcatgcccacgggctacacctcaggcccaggcacggcccaccagtagtcgggccgtttcgtgccggcctgagccctgaagacacgtgtggcccatcgtgccttctttaaaataagtttatttcccctccatcctttttgggttgtgacatatatatagctaaaataagtctattttacgtcccaactctttaggccatgccatataatatgtctattattcctccctattctttgtgccgtaccacacatagggttgaaataagtctgttttgcatccctgaacttcgtgccggcctagcgtgccgaggtagcagcccgggcacgacactgctgttgggccggccgggccaaatcactgggccttgggccatatggtcatctaccgtcgagggcaacgagtcagggtggggcggcaacgcgcgacggcggccagcgagtcggggcggggctaaagtgtgtgacaatgtccgagactacacgagcgacgacggtgaggcagtggagccggtggtggtcgccggtgaactattcagccactggagggagggagagaggaagaagaaaacctaaggggaatttccatccaggaaggtatttgagcaaaaacattttggttgaggatggtattctagcgtagcccatttaagtaatagtatttgagtgaatcccatcttatgcgatggtagatatgcaattttctcgtaaatatctaattagatgacaatgacagagatgcactattatagtcgtcgttgcgccaaaagcaactaactgatactacatccatcccaaaatatagtaacctagtacttcctccgttttacaatgtaagtcattctagcatttcccacattcataatctagatagatatatatgtctagattcattaacatcaatatgaatatgagaaatgctagaatgacttacattatgaaacggagggagtacattacatgatgggacatataggaataagttcacctgccgtccctcaactttacacagagtttttttgacatcccttatccacatactagaaatcttcacccctaaactatacaaaaccgtctaatttagatcccatggcagcattgatgcctagtttcgctgacgtggcatcctagtcagcacaaataaaataaaatgtggggcccacatgtcagtgagagaaaatgatgtgggccccacatctcctctttcttttcattttctcttctcttctctcgagcaagcgtggcgacagatgggggagaggcggtcagcggcggagcaggggcggtggccggcagagcgggcgcgacgggggcagagctggcccagcgggcgggcgagcgcacggagaagaagctaggcggcggccggcggagcgggctgtcgtaggctctccggaccttccattataattgagagatgaagtgaataattcaagtcatcaaacaagcataatgaaatatccgacgcctcgagagaggaatattggagatattgctaggcctttagcttgccagtcaacttcagcctgagatgtgcccgtcaaaccactcgaaggcggcgaccagatgtgttacacattcaggagacttgacaaaaatggctaaagttctacaacatctcaaatatttctaactcatactcatgtgaatctagttcccaggatgtgcactagattcacactttcatctcaagcatgattatacatagcaaacacaaataagatgaaagcatctactttagttacattggccgaccggccaaataaataatagaacagcggaagcttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgatattgagtgaagtccttaggtcggtttgggcgcactctccccctatcggtacacaactaatcaccatatgtgcaccacttgaggcccaaacctaaaatccatgttttccaccattttatttatcaaaatcacaagtattaaagttttgtccagattaattaaaaatcaattttcatgtttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgaatcaggaaaatgtcagcacctaaatcacttcttcaccgattaagcaatcatctatacaaagtatacgttatgcaattaaacaccgaaatatgcgaaaaatccaaaatgttctaaaatgcatgatttgtgcacagagatcaggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgttttctggggtgaagatatttgttttctaagactaacacatttggtttcataatttttagagttaatatgaattatttatgtattttacaagttttaacgtgttctaggcatatagtccctatgtgtacatggctttggagatttaggtccagaacttgctctaacttgctagtgttgtataaaatgagtattttagttaactaatctaatcttagtttataaaattttagtgttcaaattactttacttcacattttataagctaggggatgttctatgttagaaacttaagatatcaatctggagattattatatgagttaaggatactaagttttggtggaaggggatggatctatgccttcactggttcaacaagttttatttggatttatttggagctaccaagcatatatatactttttcatatgtattgtttaaccactactatgtgtttagtacctattctaccaaattaaggttcagagccatggtctgtaagagggtgctataattcactctactaggttgaagtatattacttactggttctatagaaaatttggttcacttcatttagactatagatgaattttctacaaatgttacaatttaaggtatgctccatgttgcttataacttacttaaatacttaggggttttcattatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaaagatcaatatacaaaaagatccctgaggtttctaagaatcaacccgcagacctagcctcatatgtcagtgagttgaaaagttgcacattaatccttatagttgtttaaattctcgaaacaaggtccctgacttcttttctcatgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcggggggtgatgcatgtgcttctacaatcatgtattggttaattgggtgcatacatgtatgttctacaggctgaaggatgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagagatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggttgaggcgaagacgctggcgcgacagcttggcccggcttggtccagataagcgggaacggcgatgatgtcactgcggcggtgcacagagcgcgctctagagcgaccatgacatggcggcgttcccgctgctgtagaagatgaaatggaatgggatcaaaaccaaagttgttcgtcatggtgagatgagaatggaacgagtatgagttagagatgaagagggctcgacgacggttggcgatgtccctcttcttggcggccggcgacgaaagagaggtggagagggagagctggagcttcctccctcggttggatcggtactgggatggtgggtgaagaatggtgacgcagatgggtggaggtgaagcctcggttcggcgctgccacgtcgaggccacgcgtcgtacacagccggcgccaatctctctctctcggctgtctctggtcggctgcaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctgaaggtagatgaagatacctagattccattttctttggttgcactcaaaaattatggatagattactcacagaaattagaggaatatgggttctttggaaactagttcgaatttttaggagacctaaacagagaagataaattctggaaaaattatttttattcatgataaattacctagcatttgaataaattattttacttatacacttttatgcagttaaattcacttttagacaaagtatggttttagccgattaagaactacagttaatctagtttttattagtttgactgatttatttgaggtaccaaatttagttattaaattataccaaaattacagtgagttgtatgtgttgattagagcctacatgaattttcccatgattttatcttgctcgcaggacttatgtcttatatgtgtttccctttcctaaatgcatgtaaatgtttataaaagttatatttggactctcattaacatgaggtgatgttgatatgttagaattacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcatgcaagagttggatcaactccacctaggtttaaaatggaaatttttggtttacaaaattgaagaacttccctttcaactagttttgatggaaattccttaatcctagaattcaggtatgttacacgggcgcggcgggcaggcaagcgcgcgggaaagaagctacgcggcgggtggcggcaggcaaagcgggcatggtggcaagcggagttggcgcggcgagcgggcgagcgcgtggggaagaatctatgcggggggcggaggccggctcccctcgtgacttcgtgggcgtccatacctccgccgccgatgtccctccaccatcgccgatgttgtgctcgtcttgcatggagatcccctcgcgacttcgcggcggcgggcaagtacggtgggcgagcatgccggcgggcagagcaaccccgtcctcatcgtgctcctccccttcgtcggaagcgagagcagcagcgaggcatcaggcggaaaacgagcacggttgcgggctcgctgagatgaaggcggc

SEQ ID NO: 58435 - DNA, 2724 bp, Oryza sativa
atggattgcaaacggataactgatgccgggatgcgcttgcttgccaatagttcatctttggttaacctcacattgcaggattgtcgcggttttaccgatgatggagtcagtgaggtcgtacgtgcacggaatttggattctctgattgttcaaggctgtcgcgtttcttggaaagctgtgaagggggctgccaaatctgttcgctatgatcgtaattgcccggtctatggccgtctaagtagatcgagcatgatatccactctggattaggtgcccctcaagattttcagttgggctcttttagatcccctgttgaattggttgagtacttgagttgttgccaggttcacatcattgattgttgtcggtttcatttttcatatacctgaatctgctttgatttgttactgttgatgctgatctgttgtagcttattatggtgagccttgaattttcgtgagccatctgttctgtgaaaaatcatggtattggtcactagtatggtacactgcagctactgatatatttcttggtactttcatctttgtttacctttccaaatccatctatacaactagttcttttgttagtgaggttaccctgtttgaattctgattgttttttagagtgttctaatttgcatttcctctcacaaaaatagcatgaatacttagcttttcgtagaattatcaatctgaaccaccttttttttctggaaaaaaatctctactctgttcaacattgtgggcatataagcatatcgcataggaaattatatcttaactattttaaaactactttaaaagcacaatcgtcttccttcctctctttaaaagaaccttcctccctacaaaaaaaccgcttcctcaccttcccaaataaaccggtccagaaaaaaaccccaaaacccaaatcactgtgaaaaaaccagcatataaagaaatttaatcatatttctctcttccaatctcgttatgattcacgggcatatatatgtaactaacatcgagaaaacttcattttatgtgattccatctatatatatatgcctaagcttaagtattagtaggattgcggctgctgtgactattttcacatattttagcagttttgaaactgctctcagatttagaacttatccacgcctttttgttcaattggttaaagcatttaccatgttgaactgcggtcatacacactgtttgaagactatgaaaaccttgtatggttaaccggataagtttgagcgactaaatattatttttctacaaacgaagtgtcttttttttaataatgcatagatattcagcctctatatccgcaaggggacatacacagtcaaataacatgactgaaaatttgacgaacttgtggatatcgaagcattggctacaaattgtcatgtctatgcttgctgactactactctccgtttcatattataagacgttttggtatatgtatttcttgtaatctctattatatatgcagtaataaataaaattcgtcatcttaaacataataaatactccctccatctacttttgatagttatatttccaaatctgaaaaatctatttttgataggcatatttcaatccaacaacctatcatcttaatgtctttctcgaatttaatgcgtgattctctattcctccacacaagattggctacatggacatcgagaaatataaatattaatgaatcgcttgttcacgaggaatgactagtagcatgtttaaatggatgataagtagaatcacttatcgttggtctgtgtgtcaagatgaaatatgactatcaaaagtagatagagggagtaataagttgctgttcttatgaatcgatttgctccatcccatcccaagaacccaaatagggagtagtacttgctgaggaaattcaccatcctttgctgctcgatgcaaaagcattggatcttctctcagcctgtgaacgagtacatcatctcagtctatgaagatcaacatgtcaatcatacacgcaagtatatgaagatcaacatgtcaaccatacacgcaagtatatgacaagaagaaagcaagaaacctggccagctgcatcgattagggtcaaaattaccaactagtgttcactgcatgagtatgtaaacctatttgcacctttcaacactgggctagtatatatatcatgagaaaaagtgttgccgctttttttttttttgacacgccgccaaacacaattccacgaatcacctaaaactttgcggtagtacggagtcgtcaactatcttgacctcgagaaaccctttgattaagatggatttagagatcaaaaatgggctagaggaaccgatttagataaatagggataaacactcatctcgtggacggaacggaatgttttcgggacaaacctacaaagaggattcgcactttcgcagcgagggcagacggcttgcaacgcaaaccgacgaagatggatggaacctggtagatacgatattgaaagaatgatttaattggctatggtgttggttgtagattgtgtctcaattgaactggtcatagctcttataaagagactggtcttgccttcttcaggaccttctctacgttcaattaggtgtagaaaccaattaggactcgaaaaatctcagctcaagcaagaaaaccagagaaccgataaaactggacttggagtcggactccgccgatttgaccggccacatgctcaacctcac

SEQ ID NO: 58436 - DNA, 889 bp, Oryza sativa
tatgttatttaactatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacgggtgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccctctctggtagtatcggtgaaaacccatacctctatcttcgggatcctgagctagtgtgtttgtgcctatccatcggaggcatgacacatgaaactct

SEQ ID NO: 58437 - DNA, 5798 bp, Oryza sativa
taccccgagagccatacctaatggacaaaacaatgtgaaaattatagattaaatctatgattttttttttttggggggggggggggcatgtactctgagtactctcaatgaagccagcagcttagattatacatttgtctacttcaattcttcaacatagcacatctacttgtacatctgtacatatattcaacatacctgccaatattattaacgtacaaaaagagagatttatttatatgaccttcaacatagcaaagcattcacaagaatgggcaacatttggacgggttactgcatctaacggatagtcaagaacaatatcatgaaagatctcagcaggattgaaaagctgatcaatagttcagaaatgtgtcaatattgctgaaacatatatggttactaccaagagaaattttgtagtacttaaggatcactctgttatattttgtagtactctgttcctaacttttaatttgatgttatcttcaaattgccacatgcaaggattgaagaatgttcttgagaatttaagagtacaaagttttgtcaactctgtgtataatgaatttgaatatacaatttttctcaataatttttggtgatatttattaatcggtgtgcacggtcaactcaagtcggtcgttatagatccatgcatttggttctcgaacttggtcatcttaacaatctaaacacgttaagagaaggaaagcatgtgtgatgtgatggtgtaatcctaggtattacgcacacatgactgcgctttcaatacaaattagtagggcagtgatatgttattggtctccgtcttttatgcatacattagagatccactcgtggttacgtgagtgtagtgttcgtgcgtgctggtgtgttttccctgtaatctgaaaaaaaatacactaggagcataaaatatggtgggctagtgtcaagctttatgcagtggtatattttttctttttcctggttatgaccttcacgggatgtaattttgttttttttttcttgctatatcaatagaacttcgcacctcgcaccgtctcgtgcgagtagttaaaaaaatgctttatgtagttgtggctcatgattagccattaagatccagacatatctccctttgcttagcataagggcacccgcaatggttatctatagactctctataagagatccatgtcagcatattttcctacttggaagagattaaatgaagagagagagagcaaagctatctactaacctggagacagtctatagagaaaaacgaggcaatatattagagagctatagatacccatgtagacaaaccattaaagtggtttactattaatatagtctattgctgagatgtacatgttttatagatagcacattactttaccattgcgggtgctctaaggaggtctagatctatagatttggttgaacttaggctgtttttgagaaaggggagattgagaagatacgcaaaacgaggtaggctattagtgcatgattaattgagtattaattatttcaaatttcaaaaatagactaatatgattttttaaaacaactttcttatagaattttttttgcaaaaaacgcatcgtttagttgtttggaaagcgtgcgcggggaaaacgatgtgcattctatctccaatctcccggaacgaacgctgccttaggctgcgttcgtttggagaataaagggagtgagtttgtttcgtattccgcgcgcacgcttcctgaactactaaacctttcgttttttgcaaaaattttctataggaaagttactttaaaaaatcatattaatccatttttgaagtttaaaatagttaatactcaattaatcacacgctaagggctcacctcgttttacgtatcttcccaatcttctctatctcattctcctcaaacatagccttagtcatcctaacaatcgaaatacactaaaagtaggtgaagcacatatagtatggtgataaaacgtgggtgcatgactctatccatcgagatttaaatccttatgtccacagttagtgtgtgcgctctcaatagaattttagtaagaacagggatatgctaccggtctctgtctttttagcgtgtattagacggctcactcatgagtgtgagtgtggcatgcgtgcatgtgtaatagtaaaaaagaaaataaaatacgctggggagtaggaaaaaaatgggccagtgtcaagcccagatgcggtggtggcccatcattagcccatccagcccaattactcttgctgtccccctggcccctccatctccatggcacaaaacctccgcctctccatggcttcccggatcaatcccctttttcctcccgaggcgagggttttggcgaggagatcgagcagaggatctctttagcctcccgttcggcccaatccaccgtagcccaggcccatttagttgtccgtccagccgcgcgccgccgtgcctttttattggttgctgcggttccaagaaacccccgccatggcctccgatggtagtttcttccgatacggtggttagtcagtgcccttcttgcgtgtgcggttcttggaatttcttgttttctttgtctctcctagcgattgtttgttggagggataattttttgcttcttgtcaatggcggtcgccggatggatcagtggctcgttcgctccgtgtttcttgtaggttcggtggttgcagatgtcttaaggtgcaattcttgttcggttttgttaatgatagttagttcttggtcggagaggcagcaatctgtagatgaataattaggttgccactcaatcgacacaggaaaatgttgcggaagttcatgaccatatatatatgcttcttgatgagtttctctactgtcgatggcggataattctgcagctccttgttaatggaggttgctggatcggtggatatgaccattttatgcttcttgaatgttcaggttgcagatatctaggtttaattcatgttcgatttagttgatactagttagtttttgctcggagaggcagcagtctgtagacaaatagtcaggtctccaccttaattaatatttcagttgacataaaaatattgggaagttcatgaccgtatatatgcttcttgaagaatgtcttgtctatactgtatttcgatcacctttgatatgcatccttctgatccgattaatttcggtccagagcgccagatagcagctaaacctgaagattgcccagcaatgtcatcaatgttgtcattggaggatctcccggatgcattgctcgcagagattgtaaagaggattaccaacacaagtgacctgaagtccatttcccttgtgtcaaagcgtctgtacactatcgaggcggagcaaagaagttctatccgtgttggctctgacctttgtccagcgatagatgccttgtcagcactctgttcccgattccccaatttgttggaagtagagatggactactctggttggaaatttcactggaatctgctagaaaaacatattttctcattgcacttccctgtcctgcgtgatctcaccttatacattgatgatattcgtatgggttgtctagcttcttgcaaaaatttgatgtccctcaggttgaactctgtatcagcgataggctcatgtggacttctctcggtggctgttggttgcaagaatttaacttctctccacattattaagtgcaaccatattgttggcagtgataagtggctggagtacattggcagtgctgggtcactggaagaacttgtagtgaagaactgcaagagaatcagccagtatgatctcctaaaatttggccctggatggatgaagctcaagaagttcgagttcaagttcaagagaagtttcaacacatatgaacctcgtgacccctgttatgtggataactatcagtatggatatgatttctgctgtgaaagtttgagggatgtcactttggctacgattgtaactaaaccagagataggacttcgctgtctcctgacaaagtgcaaagcattagagagactctgccttcactatgtaattggcataagtgatcatgacatcattacaatctcccagaactgcagcaaccttagaagcatctcactttctcaagagatgctgctctgtgaaatacctggaggcacaggcgtaatggctaggacaccactgactgatgacagcctcaatgctctagccctgagatctcatatgcttgaagctgttgagcttatgttttatggttgtgctcctgattggccatctgagatagccttcacacaggatggccttgtgacactcctccagtcctgtccgattcgtcatctcgtgctacgtggtgctaacttctttgatgatgaagggatggaggctctctcatgtgcacaattcctggagacactggagcttatgcaatgtgttgcggtaactgatgtcgggatgcgctttcttgcacaaagcccatgtttgaagaatctcacgctgcagatgtgttacgaggttactgatgatggagtgtgtgaggtggctcatgcacgggatttggagtctctcactgttgaaagctgtaatcagatttctgtagaagctttgcatggggccgccaaatccgttcactacaaagttgattgcccaagctactacgatcgatataaagattaggtcattgctgactgtacatcatttgtagttgctttttcagttttacctttccaccatctttctgtacttgctgttgccacgtccttataccgcttattgttctcaattaaaccagtgtttaatggttatcttttgatttatgcaggtactacgtgtgatgagtgaaaactgggatcatttactgcaactgtgctgtataccatattatatgatcttgccaataacaatctcaatttggcctgtaagcagtactactgtttagctttgggagtgtctgcaactatcaactcttttgtcgacgaagcgctacagaaaggtggaagtggaactactgccaatcgtctcagactttcaacattttccttttgtgtatgccaccttcattgttatggcttacaagaaacgtttcaggatataattgtgcctacatctttaacagacgattatatgtttctatcacgttttgtttctgtgcctactctaacctctgtgaactgatcttttcgcttcctacaaaactggtccgaaaggcattggatcattgggtgtagtcaacaatgtacactgcattacctgcttatagtacaatataagatgtttattcatatggtttcttcgtatgaaaagctggtctgttattgttaaattatgatttcatgaaatatgtagtcttgagatttacaggcagtgtttcaatttcaggtcgaaatttctgaaattttgggtttacagtcgatcctggtttctctcgttgaatttttttttctgaattagctaaagtttgctaaaatttagccaaaatcctctatagtttcaattgaaacttctgaaatttcggtctcgcccggaataattatgcatcccagaacattgaatctttcaggtataactggagtaagttttcaggacatgcctgcgtaacttgctacctgtgaaattggagacaaaactccataactccgatgcataattcttatcagtatctgcaaattctttgcattttaacaggttattaggcgtggtctttttcttgcacgcgtatgtcagtggctaactccatactactattcattaaatcttgaaaaatttcaagttgtaatttgctttccacaggcatatgtaccattttagctggaa

SEQ ID NO: 58438 - DNA, 977 bp, Oryza sativa
tcatcacttgcctctcgccaaggacctcgccgcccgccatgggtcccgccgccggcgctaccaacgtgaagtctctcccgttcttcaagaccctcaacctagccctcctccgttcgtcgcgcccgcttgtcgtccctggcgccggtgccgcgtcactgcaccggtcgcagtcgtgcaagcgggcgccgacaacgttgccgccgccaatgaagccggcctgcccagagtacagagagaagatagagagatagaggagcaggaggaaagagagagaaaggaagaggctggcctgctgacgtggcatcctgacatgtggggcccacgtgggtcccatgctgactcagctgccacgtcgaacaaaaccagggtcaaacccgccgagggacctagtttgcactggttttgtaagttgggggacatgttgtatccggttttgcggtcgggggacgattttgtaattcgatgacaatttgagggaacttgggtgtactttttccttttcttttttactaaacttgctacaaatagaatctctggggtagctcagaaagtaattagtcccactcatacaacttttatatctgggaggaatattatggagggggttgtcattcttcatgaaactattcgtgagttgcttcgaaaaaaaagggtggtgtaatttttaggattgattttgagaaagcttatgataaagttaaatggtcttttgtttaacaaaccttgagaatgaagggcttttcccaaaaatggtgtgattgaattggtttcaaaggtggtcatgttggtattaaagtgaatgatcatgtgggatcaaattttcaaacttttaaggttttaaagcaaggggaaatatagttgttgatatgttaactatattaattaagagagcaaaagatgatggttacatctctagattggtcccacatttagtggacgatggtttatctattttacaatatgctgatgatactatt

SEQ ID NO: 58439 - DNA, 14005 bp, Oryza sativa
aatttttctacacacacaaacttccaaccttttgtcacatcattccaatttcaaccaaactttcaattttggcgtgaactaaacacactctgagattgaagaaaaaactgacgcatttgtgagcatttatttcagggcacttattttagctaggggaatttatttcagggcattgcttttgttcttgtcagttagatcctatgcacaaatcacaatatcttttgattttgatttatgatatggcttgaaaacttcatcatactttgccgtgaatgatgctagttgaaactcatgaattgcctgatggaatgcattgctttgtttgctgcatggccaaatcgaatacatgcattgctatgttcattgcaattgtaataaagttccaaatcccaggcagaaagcatgctgagttgttgctgattgttgcatccattatgcgaagcccaaggcggcagtaggaattaacccatggatggcagcgacgcgtaccggcgagaatttagcatggtgcctcaacatttttaccacctaatgcacatacctctatactactccctccgtgttttaacgtatgacgccgttgacttttcgacaaacgtttgactattcgtcttattcaaaaattttatgcaaatatgaaaatatttatgtcatgcttaaagaatatttgataatgaatcaagtcacgataaaataaatgataattacataaattttttgaataagatgaatggtcaaacattggacaaaaagtcaacagcgtcatacattaaaatacggagggagtaccatatattattaggacggttaattagtctatttagtactccctccatctatttttgatagtcatattttcaaatctgaaaaatttatttttgataggcatatttcaatctaacaacatatcctcttaatgactttctcggatttaatgcgtgactctccattcttccacacaagattggctacatgggcatcgagaaatgtaaatattaatgaatcgcttgtttataaggaatgactagtagtatgttttaatagatgataagtagaattacttatccttggtttatgtgccaagatgaaatatgacaatcaaaagtagatggagggagtatattagtagtcctaatgatatacttcgtattatagagtgcatgtagattgggtggtaaaaaagtcgagccacgtcaatttgatggtaaattcgctgcttcatcaaactttgcaggtacacgtgctgccagttgctgggctttcatgggctgtgatgggctggtttccgtgggctgttgagtgggtgtgcgcacgagccgttggatcggcttggacgatggatattacacttgactgcacgctggtatctgaggatcctactcccccagtcccccgcgagcgagcagaggcggcgccgtcgctcgtcctccgccaccgccgccggcgccgatacccatccatcccgcgccgcgagcgagtgcttccgccgcatccatcctggttagcacaccctctttcccatctctctctctctactcacgcacctaccgaattcgcgttaaccctagcttctgttctagaaattttgccttaaccttagtactaatttcttcccaaaaaggtttggggtgtcccatgttagatccgtccatgaattaagctgcctgtcgaaccggttattctctggtataactcctgtcaatgtactctgcctcagttcttgattgggaaacctttccttgctagttgctacctaattttcagtttttcatcattgtacttcagcttgtgacttactggattaatcagttgggatggagtatatgttggatgaactcgtataaattggtagtatgcaaattttggagactcataattgtgagagttatctagctttatttgttgccgttcacttgtttctctagtcaaagatgcttgtcttgaagttgatgatgttagcctttttaagattcaatcaatgatgctaaagtatttattcaatatactaattgcaattagggttgttcgcccatttacaactggtgtaaacgagcttagcttagctgtcgcgtgcttgctgaaaatgaatacagccagttgttcggtcaaaacctccgatgaacagcccttattgcaacatagttgtatctgtcataagattatcttctctatttttgttatgccgtgggcttattgactgaggttgtaatcgtgcaaaacaggaggacagggtactgggtgtgggcaggcaggcactgaaactggactacactctagcttcttagtgattacctctagatcagctcagcaaatagatgctattaaccactttgtttacaactttacatgcatgataatcgtttttgtatcctgaacatgagaatttgaaatttgtagtaggtgtcaattacttcaccaagtaaagtagctggaaacatatactagtagccatgcgggagtctggtcttccaaatcaatcaaacaatctgtgactgggtatcatattgcacattaatatgtatgctaaaggtcctatgtttaaactgttactagaagtgcttatatttgtttgccttcctgctgctcttgtactatattctagattcaaatgtacaacatcttattgctcatgtaaacattaaatactaattgtaactgtctaaatttcttcagagtttttagtgcttactaaatttcttcagattttccgtttgctgtctaaaactcttaaaagcatcatgttttcatgagaaagctaacgtttacagtctcctggtgtgaagggcatttgcaatcagtgacaaaagttcctcagctgtggagccatggccgccaagatacgcatagtgatgaaatcttttatgagccaagctaacaaagttgaaggggttattccatacgcgcagaaggttggattgcctgaatcacgatccttgtataccgtgctacgatcgcctcacatagacaagaagtcgagggagcagttctcgatgcatgtcaagaaacaatttctggtacagaaggcggagacgcacgagctgcagaagaagctgttctggttgaagcgcctgcgcctgcttggtgctcagtatgaactccagatcagtttcaagacccgtttggacaagaagctgctccaagctgctttgtcgtcaggttgctagagcacttcacttaccaccattcacccttgaacaagactgcttttgcttctatgatgtcttcatgatgagattgtcaaacagtacttgcatccattaagcatttcatatgatgaaactacaccatttggaagagtttgaaggaatgtagtagtaatccatccaaaacgttcagatgctctgaattatgaagatgtggcatgatatgaaacagatatccttccgtttccgggcttctctttggttttgttccgaatgccgtttaacaagtcatgacattcctatactttgctccctgtgttaagatgttttagggttgtctgtaagtcaaactttttcaagtttgcttaaatttatagaaaaaagatttttacacaaaataattataccaggaaaatatattccatggtagatctaatgtaaccaatttggtgttatagatgttactacatttttctataaatttgattaaatttaaagaagtttgatttagagcaaaacctaaatatcttgcaaagtatctttcttcgtttgttcttgattctaataatgcacatgaatctatgagaaaaaccgggtacagtggatggaaatggagatgagctgtcaatttgtattttatatggaaataagccgctttagaccccctttgattcaaaggaaattcataggaattttaaaggatttcattcctataggaatttttcctatatagccctttgaatcaaaggaatgaatactatggaaatttagcatgaggtggaatctcatgttaagaatcctttgagtcttttatctctcctcaaattcctgtgtttttcctacggctcaatcaaacggtcatttctatgtttttcctgtgttttgtaatcctctgttttacacttgtattcctgtgagaatcctatgtttttcctattcctccgttttttcattcttgtgattcaaagggagccttagcttgagttgggcactccactttctcgacatacacttccttatttttcgcatgcatatgcctcctaaattgttcaatgaaacttttttttttcacaaaaagaattatatatcaaagttactttgaaaatattaatctatttttcaaaatattttaactaatacttaatttatcatgtgctaattttaatcatgcgctagtgagtaacttttttttgtcatagagagagagatggttctgaatcatcactgtagaacaaagcctaaagtagtctatcacattgttggtcaagagttattattattttctaaatcatttgaatttgaattttttaaaaaataaactcttccaaaacttgttttcatatatgatgtttgggataattgcatctatatccccgcttttaatcccaactgttgttttacccttactttttatggtttgaaattttaccctcactacgaaccaaccgtttgcccccacttgtaacgcccacttggtgggtcccacatttatgtgttaaagaaacacaaatggaaattaaaaagagtattatggaatataatttaccattctacccctgaatgaatggatagggatgaaatccctctcttccccactgagtgtggctgtgcctgtggacacccgaaaccctagacctatagacggcggcagcagttcgggcatgtgcgcggcggcagcgagcgtgggacggcgctccggcgagtctccggtggggcggcggttgtggggcttcccacggtggccgctcctaggcgcggcgagtggtggccaagcgcaatgaggtagggcgcgatgaaggcaggcgtcaggcgacgaccatggggcgtgacgaggcaagcgatggctgcaggcaggcggaatggaggaaggtgaggggcgggaggaaatgcttaagtggaggaaatcctatcaatggagcaaattttcatggaagaggttaacaagtgaattgattcttgtcattgtgggaggcctcagtctaccggacgaggggggccagcacggatgcggggcagcttgcaccggacaaggagcgacatgggctgggccaaagaaaaggaagggagagtggagtgggtggagaaaagaacttatttttgcaacaaaaaacccacatattttggaaactctctattaagggaatttggtttattttttgttccataaaaaatgtttcacctaatgaaacattccattacaataaaaaaaaaaccactgtaacatacccgaattctaggattaaggaatttccatcaaaactagttgaagggaaagttcttcaattttgtaaaccaaaaagtttcatatttaaacctaggtgaagttgatttaactcttgcatgaataaaatttgagaacaaattaaaactttttcatctttaacctaggacaaaaatataaacccaagtgaaagcatgcattactcgcataaatcatattttgacttgagtccttcatgtgcatttgaatctttgatttgcatttcataataggtctcatgaatattaactaagatctaaataaacaactaaaccattagggcgtagtgatagctagaggaagttaaaatagaaaccatacaccttaaaatatatcaacatggctaatgtcaaacctcacaaaactaatttggacatccatctgaagacttgtcatgaacatgaaagtgaacaaataaattatatcatatagggtatattctatcttaatcatctctataagcattctcttaatttaatactaaagtaaacttatgcattaaataggtaaggagcttatgacatgtgtaaggtaaactgtaattctaacatatcaatatcacctcaggttaatgagagtccaaatataacttttataaacatttagatgcatttaggaaagggaagcacatataagacataagtcttgctaattatctaaaataattcgtgcaagataaaatcatgggaaaattcatgtaggctctactcgacacatacaactcactgtaattttggtataatttaataactaaatttggtacctcaaataaatcagtcaaactaataaaaactagattaactgtagttcttaatcggctaaaatcatactttgtctaaaagtgcatttaactgcataaaagtgtataagtaaaataatttattcaaatactaggtcatttatcatgaataaaaataatttttccagaatttatcttctctgtttaggtctcctaaaaattcgaactaatttccaaagaacctatattcctctaatttctgtgagtaatctatccataaattttaagtgcaaccaaagaaaatggaatctaggtatcttcatctactttcaaaaaaatccacaccaaattattctacccacaaattaaataattgaattactaaagtgggagagagaaataatcctgaaaatcattcaaaccttttgttcacccacgtttctgcccaaccctctcaccctagcttagtttgccatgacctggacccacttggcagccactctggctcatcctcaccctgtgcaaatcttccagccaaccagagacagccgagagagagagattggcgccggctgtgtacgacgcgtgggctcgcgtggcagcgccgaaccgaggcttcacctccacccagctgcgtcgccactcttcacccaccatcccagtgccgatccaaccgagggaggaagctccagctctccctctccacctctcttttgtcgccggccgccaagaagagggacatcgccaaccatcgtcgagctctctccatctctaactcatactcgttccattctcatctcaccatgccgaacaactttagttttgatcccattccatttcatcttctacagcaacgggaacgccgccatgtcatggtcgctctagagcgtgctctgtgcaccgccgcagcgacatcatcgccgttcccgcttatctggaccaagccgggccaagctgtcgcgccagcgttttcgccttgacctcctctccatttcccgtcaagaatctcgaaggatggtgctacgagtgcggagatcggctaccgtcttcttcacctccggttgccgtcgccattgtcgattccgcctcctccggtgagccattgtccgattcttcgcgtatacaccatccctgggacctcactaacccaatgaaaacacatgcatgtcaattcgatgattggatcgagccgttgccgtcttcccggagctctacaccgtcgccggaccatcttcttcaccgctgccgctgtccagactttcccgcgcctcattcaaggttcggtgagcacccttgagccataggattgcattcatgcatttcattcacttagaatcgagcacgaactcaacatgcagtagcagcctaagcacagccgccgctcggactcgccgccggcgttactccgatgtccactgaccgagaaaagtagaggaatggaatcgaaatagcaagatcttcattttgtcttttggtcgcaccctcaaacgagccaccgtttgccgctggcaagcttgagatcgagctcagccatggcttgatctgcttcagctcgaaccagggacctcctcacaagaatttaggttaatatagggtcctttctgcaaaagatcaagacacacagaacagtcataggactgcgggttgatttcctgaaactctaggggccttcttgcatattggcctgggactgacaatccacccctaggaacaaaatctgaaattataaaagaacagtaactaaaacttgtaaaatcatataaaattaaatctagctcattttaagatgattcaaatttctgtgaactcatcaaattgggaaatttgatgctatggaataaaaacttgaattcacagtacaaatttagcctctaaaatttatccaaattaaatcacacattaagcatgcacaaacttataaaatgcatacaaaattcatttcaaataatttcagagcaaacttagtttctacagatccaccaacatgttctctaaaaaaaagtaaaataaaacatctacacattttgcatcaaatgcctctaaaactattatctttaaaaataactagttttatataagctgaactttagaagttcatataaaattcatcttagatccttttttagtaaacccaagttctgtagaatcaccaaaacatatacttccaaattataaaataaaattatatacttactgtatgataaaagcctctaaatgcttatgtaagtaataaccaacatagagcaaccttaaattgtaaaatttgtagaaatttcatctttagtctaaatgaagtgaaccaaatatctatagaaccagcaaacagtggacttcaacatagtagaataaaatatggaaccttctgtacaggttatagctctaaactttaaatttataggaggtactaatcacatagtatcgattgagcaatatgtatatatataaatgtatatagaaatacactctagctataatgaaacccaaataaaacttgttagaccagtgaatgcatagttccatccccttccaccaaaacttagcaaacttaactcatataacaatttctaggttgatgtgttaagtaactaacatagaacatccctaattataaaatgtgtagtaaaataatataaactctaaaattatgaactaagattagattagttaactaaaatactcattttatacatcactagctagatgaggcaagttctggacctaaacctctaaagccatgaacctatataacactatacacctgtaacacgttataacttgtaaaatacataaagaattcatattaactccaaaaattatgaaaccaaatgtgttagtcttagaaaacacatatgttcactcagcaaacataaacttaataaaaatcaccttacaacagcatttcacaatagtacctaaataaatcctatactataacaatgaaacttgtaaaattcataactcctaaataaaaagagataaaatagaaattcttccacctaaattcattttagaccagtacctattcactgtgcacaaataatccattttagagcattttggattttacgcatatttcggtgtttaattgcataacgtgtactttgtagagacgattgcttaaacggtgaagaagtgatttaggtgctgacattttcctgattcaaggcaagtcccacctccctctctttgatcactttgaaccgttttggaggttattgaaaatatttgcaaatcttgcatgtcgattgcacactaataaattaaaattttgttaaacttgttagataaactcctattatttgcattatcaccttaactccacatatatccatattcctcattcctaaccttaggaacaatatgactataccactttatatatgagttttggtgacactaggttactataaagcttagccatgcttagaatggtcttcctagtcattatgggctcattacaaacatgaagattgatttttaaataatctggacagaactttaatacttgtgattttaataaataaaatgatggaaaacatggattttaggtttgggcctcaagtggtgcacatatggtgattagttgtgtaccgattgggggagagtgtgcccaaaccgacctaaggacttcactcaatgccagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatataacggtattgtgccacgtgggtgggttcccgttgtgtccgccaccacggcgttaagtttaaggtgtgggcccaccacttaacggttataggttatataacgtgtatggcttaggatggagtaacatgtatcgtgctggtgtaaggctaaatcatgaattttggtaaagctttgttgcgggtaataaatcgggtacttatgtatcgcgtgccatgcttttgcatgattattatttcgcatcagggtaaagtgtacaaactctgcagagtaaaaactaatcgattagccgtgctcgcggtcatgagcggcgtgtggatatctattgagtatagacttatgtttattcttctaagtgctgaaatttaccttcaaattgtgttgagatttgagaatgatctccttgctgccacggaaggcaatgaggtgcatatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttaataatgtactgactcttgctattgaattaatcttttgcttgcaggttttagtcttagtctttgagtgatgtgggtaatcgactgcttcttctaggatttgaatttaatggggtaaacccctagtcggtgtgcttgtggattgggtagacaagcttccgctattctattatttatttggccggtcggccggtgtatctaaagtagatgtagtttataatcgctttcatcttatttgtgtttgctatgtataaccatgcttgagatgaaagtgtgaatctagtgcacatcctgggaactagattcacatgagtataagttaagaatattttagatgttgtagatctttagccattttgtcaagtctcctaattgtgtaacacatctggtcgctgccttcgagtggtttggcgggcacatctcaggctgaagttgactagcaggctaaaggctcagcaatgtctccaatattcctctctcgaggcgtcggatatttcattttgcttgttgaatgacttgaattatttatttcatctctcaattataatggaaggtctggagagcctacgacacccacatattttggaaaccccctattaagggaatttggtttattttttgttccaccgaaaaatatttcgcctagcgtactcagaatgtttcactatgtatagatctaatgttgcagtgaactgaaatattcttttgctatttgctgaaacattgtttttatataaggtgaaacaacacccgatttaaacgagtgaaacatttttaatctacttagtgaaacataaggctggtcctagggttttggggcccagggcaaaaacttatatggagacccctatatatatacataaactaatatacatatttatatagtcttataaagaggaaaaaaagatagagaaatttaccagatgagatgaattggatttggaggagtgtatgaccttgaaatcagatgaatgaatgaattggaggagtgcagtacaggtggcaggggcggcgagcagagaaggcgaccagcggacgatcgacacacacgagcatggctactggcgagccgcgatgtgctgacttgccatttccgtttgcgagacgccgagaagtcatcgagagcgcaggagcagcgagcggcgtgacgtgatcgaggtggcgcgatgcgagtggtgtgcgtgatgtgatcgaggtacatcgatgggagttagataaagatcgcttcggcttcgctgcaacaggcctgacgatggactaaaatctgttttatgtattgggctattcacttgtctaatttaatataggcccatggcctatggacttaaaattatacagtatatgtactatatgtgtatagggcccctagattttggggtcctcgggcggccgcacggcctgaccccctagggccggccctggtgaaacaattccaatatacctggtggaacatcgtgcgatatttaaaaataattcaataataagctattttgttttgtcggaatatatccatgtgtggtcttgttttgaagatttaattgcaacaaatttaatggtgtaattggatcatgatttggataagtaatttaagagaaaaatcagtttaaattagttttgcatgtattttaacctgcttgcatcgggcgcccgagcaggagtcgtctccgaatttattggggtatttggtttgtttgcaaatataaatttactagcaaaatgcttgtgcttcgctacgggtaaaggaacggttaaattctatgaagtacatcgttaacatgtatataataatgttccaatataggtaaattgtttattgcgctaatgataatcaagatggataaaaatattcctgtttagctcgcatcacgaaagaaaaaattaaattaaaacatattaaattctaatttaatgaaatatatatattttttgaaatattaattacactctttgaaattatagcaaaagtgctcgttgcaactgcaacgggaagtgtatagaccagaaaattgagaaaaagttaagaaaaatctacactaagtaatttattaaaatacaaattttctgaaatatttaatattttaagtaggtaggtgtaaaactaaattaatttacaagtaaagtaagtgtgagaaataaaatgacatggttaagtaagtgtgagaaataaaatgacatggttaaatttaattttattaaattctccatgattagttatgctctttggaattttatttaaattttcagagcttaattgctaattttaataatacaaacatcatttaacatttatttaagtggaaaaagaataaaaatcctcccttttaggtttgggccgaatatggaaaagtttatattaccgcccttttgcctatcctatgtatctggactattctttctccgttgaagttcattttacgtcctcatgcaatcacgcggtccattcggcagcccagtaatgtgggggcccaataggccgacagcccgatgcgggaacagctggagccgtctgatcaaatgaacggtctagattgatcctaacctaaataaatacccaaaacatatccctagaatacattcccccctccctcccgaaactcaaccgagcggcagcggcaccaccctccccctgcgagcggcggcgtcggcggcggtggcgccctcccccacgagcggtggcggcgccgcgccctccccccgcgagcggcggtgtcgtcggcggctcccccaccgagcatcggcggcggtggcgccctccccccgcgagcggcggcggcgcggcctccccccagcgagcggcggcggcggcggcgccctcccacccccctcactctctccacttctgtaacatcctaaaaatttgaccaacaaaaatcaaagttccaaaaatatggaccttcaaaaattttttaaataaattgtatcatgccgattttgttcacctatttcattggattttaatttcggagttcatagatcacgaataaagaatagttaattaggaataaaccctaaaattagattggcaagagaaataattaagatataatttaaaataaagattatgtgaggatagaaataaataaaacattatcgcgaccatatttatatcaattaaatttaaatgtgatggaataagaataaactctaattaaatttgaataaattatatataaaaataaaatatgggtaatgttaatctaggttagagcaacacaaatattgtgtaaacttgatttgtgcaaaaattagaaatattgggacaagatttgaataggaaaaacaaccaaatagaaaaaatagaaaaagttaactgttcattgcgctgtaagtgttcgatcgcgttccctagccctaacccctcctctgccgcacgcgcctggccgccgtcacgtcgccgctgccgcccgccctct

SEQ ID NO: 58440 - DNA, 14990 bp, Oryza sativa
tgccgcgccgcgtcgtcatcgcatcgccgtcagccgtcgcgccgagccccgtgccgcgccgcgccaagccccatgccgcaccgcccgcccgtcgccatcgccgcctgccgcgccacacgccgcccgtcgcgtcgccataaggccactcgccccgctccacgccctataaagcccgacccctcctcttctccaccccacacacatcctctccatctttccccctctccctctccctcttccccacgcgccgccgtcgtcgtgccgccgcgccaccgccacgaagccgccgcgccgtgccgcgacttgcgccgccgtcgccatcgtcgccaccgccgccgctgtcggtaagccgccccctccctcgcgtccaccgccgcctccgcccggggtgggcaaggagccgagagagagagagggagaaaggagccgggagggagagaagagagaaaaaaaagaaagaaaagaaaagagaaaagaaagaaaaggaaaaaggggaaaagaaaaagaaagaaagaggaagaaaataaataggcatttgagtaaaatttagaggtttagaaaatttaaaataattagaatttaatcgtagattaattatagtcgtaaaactgcgaaatttaattatattttggtagcctctatgagtaatcaatttgcggtaggaatttagatttatttaagaactaaaataaatgtgttgaattcttaggaaaattacttaggagacacaaaatgtcttaggttgaggaatagttctatttcgcaaataatatagtggatataacaatcgtctctcgtgctcgcttttcgatttggtctttattggattttatttgaattctaatggaattcaaatcaattcttcgcacgtacttgtagagcccgagggagttgcggatccgagcgaaggtcaagacccgcaagattttgagcaaggcaagtcatcactattccttgaacatgttgatcccaattgcgaaattatttcgtttacaaataaaattgcatgcaatgatgaacatcctacttgtgattatgccatgccttgattattgtttacccttatacgttcgtaaccatatttacgtccatatttacgtatgagaccctagtcaattatgacaattgcttagaaatgctattctagaatcatgcatactcatatttatcaaatgctatatgcttgggcaattacatttgggaaggtaattgagatgtggcatgtggagacatgagcgccacattgccatgatattgatgacatgatctgtgaaaggaaactaaaatgaaacaactgttttcgactggggcggctggaggatttgggtggtgtccggaaaaggctagtgccgtccctggtcaattaaggaccgagtcatgaagttaagcatgaaacgacccccgtacaaccgcacttctcgtatgggtatagacctagcggagtagatagctgagcggaggcagtatccatgcatagtggtttcttgacgtgtgaggcaggggctctacggtagggcagccattggtaggaccgcaaggcgggtgtctaccattgtgtcgccatcggtaggactgccatgtgagaatctaaacataattataacttaatgcatgtgtgagtcttcccttcccgggtgcgccagaactcttctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgtggagcgcgggtaaagtgtacacccactgcagtgtgagtaaaacaaatctattcgaatagccgtgctcgcggttattgagcaccgggacatgtattacacttggctagactctaaattcttaacttgtgtgggatgggatattgcatgatgatttttatgctgttggagccacttcctgagaggagggaaggtggacgtcctcagaaaaccatgacgactcaatggtgggaagctatccttgagatcacaatggatggtgacataaccgtcgttgtttaaatgtgaacactggtactaaaatttgatcagtcaatgctaggtcttaggcttgtgaaaagaattacaaaactggctttgcgcaaggaaccatagccatcctttgaatacccctatcatgtgcattgttgctataatggcttgctgagtacggttggtactcacccttgcaatatataaacttaatcagaggccggagacgaagcttcggaggatccctacgcgtactacgaggagggtgatgaagacgatggcgctcagtaggtcttagttacggtcgttgcctgtggcaatggcgtgccgctgccttaactccgctgccttatctacttctacttttggaatgtattccggaccgctcggtccgatgatctaagactatgcctgtgggcttatgatgtaataattcacactagactttcgtgtatgtgcatttggtatttcagctacaaattcgtgtgtaccagactacttgatccaaggaaatggtactgtttacacgattgattcctgttataaaaacgggggtccacagagctggtatcagagccatacgactgtaggaaaagaccaaaaggcgcccacccccttttctagttggtcaaaggagaaattcccatttagtaatactttcaaaaataaaaacgctatgtttacaaaactctatacgattttcatcttactcttaactattttcttcacaaaacaagttttactcttagctgactttgggtttttcttaaaattagatggcagatcaggattcacccactacctgggagatgggcgtaccccgctcagagggatacgtcattgagctacatcggttgatgaggcgcctacggtaccccagatttccgatctaccgagtgagacagtgtggacccgtttgggaggctcgggttgaggttcatacacgagttccttcagagtcagactacaactttccgacacgccaccgtcgcgacttaccggagaggcctttctccgaattagctctattcaccgagctgagttagcgagtaccgagtttgctcaccacccatttcgagaggagagcaactccgtctgcacagtccaggacacaccttgctgctacaacccgacagtgactcgactgtcccgatgggctgaggcagtagacgacttctacgaggaggctctgttagagatcgacgaccagtagaggcgtgtgggagagttagagagactgaggtgactgacctcacagtgcagcagcttcagctagaggaggagcacctggcttggggcagtgagatagactcactaaaggtacagcttcaggtccacggtgaccagtttcagcagctatccgatcatcacaatgattgccgcgggatgatggatacactcgaggagcagctgagagagagtcaggagcatgtcagccagcttgaggagcagcttcgagcagctacagccagcaccacaggagcttctacttccacagcagtagggcgtgaccgctacttcttcctcaccccgccgtacccaccagcgttccacgctcttttgggagaggttggtatgctggctactgagtcagcaccttacttggtggacccgacagtgacacagccacctgtctcggagattgtgcacactccactgatccctacaccttcgccacagctgggttccagtttggagactccaatccaggtcgactccgagacagaggggaccgacactaagccagagatagagccggacatcactgatctttcagaggatgagactcctgcccaccgcatcacctttgtcggaggccctcgtaccctcagcactgctcgcaagagcacacgacctccgggcaagaagcccaagccagatccagaggccactacttccgagccgtggggactcaggtttgcccgtgccagcgaccaccctctacctgcccaggatcctgcggatggttggatgattagaccggaggactgttgcagcttcgatctcgcttcagatggtttttggatagcatgcgagacacacacacccctacctaaattgacgagtagcttgatgattagttcgatgtatcttttggatgaactttatttggactgcgtatatgtgcagtcggttgcatcatgatttatgtactatctatggaactctgtgatgttatttatcatattattactgttgtgttatgaatgagtttattccaccatgcttgcaaaacaaagttcacaatcaaaacaactcccttaacgggataaaaccaaaagggctagttaggaaaataggatacatacctcatcggcctacacagatggcaagccgacgtagggcgtcaaccagcaatgaagaaactcaagtacccgacctaaccaccctggccagagttatggccactcaaacccaacttctgcaagccattgcaaacaatcaagacaactgcggaggatcgagctttggagagtttatgaggactaagccacccactttcgctacggcagatgagcctatggaggcagaagattggctacgcatcatagagaagaaactgacccttgtccgggtgcgcgaagctgacaaagtgatcttcgcagtaaaccaactggagggaccaactggcgattggtgggatacttacaaggaagctcgggaagaagatgctggagaacccacttggggagaattcactacagcttttcgtgagaacttcgtgcctgctgcggtgatgcgcatgaagaagaataagttcagaaggctgcgacaaggaaacacaatggtgcaagaatatctgaaccggttcactcagttggcctgctacgcaatcggagatctcgcagatgaagaggaaaagatcgacaagttcatagaagggctgaatgatgaattgcgtggacctatgattgggcaagaccatgagagcttccagagcctgatcaacaaagtcattaggctggagaacgatcaaaggactgtagagcacaaccgcaagaggaggcttgctatgaatcgcccacctcagggacctcagcgactcaagggagccacttcgtctgggtggaagccccctattgtggcaaccaaccgtcccgccgcgcctagcaatttcaacaggctggttgcgattcagaaccacacccctacaccaactctggctacccctggagccaagaagaatgtggactgcttcaactgcggggagtatgggcactacgccaacaactgccctcatccacgcaaaactcctgtccgtactggtgctaatgcaatgactattcgtggaactactacccctgctgccggacgaggtctattcaagactccgcaaactaacaggaccgctaccggatttggacgcggacaagtgaaccatgtccaagcggaagaggcccaggaaaatcagggcgtactaatgggtatgttctctatcaattctaccccggtttcataatgtaagtctatattcattaacatctatatgattgtaggcaatgctagaatgacttacattatgaaacagaggaagtacttctattgcataactaagttacttctgttgcatgtaattacttctactacagaaagttacttctattgcatagctaagttacttctattgtatagctaagttacttctacaatttaaatacattacttttaaattaataaaatatttgaatatatccaatatggatcttgcattatcacatattttatgtagagtataatgatgcaaatatatcttgaaaataatacgtgatttaaaatatataagttattaaagagcttaaatctaaatgtaatttatgcatatgataaaagtaacttacatatataataaaagtaatttataacatatatatatatatatatatatatatatatatatatcagaatataatcatgtaagatcttgttgtaaagatttaattgcaacgaacacaacagtataatcggattataaatcagataagtaatttaagagaaacttctctaagaagaaaaaaatacatagatattaagtgtagtagtagcttttttttttgaaagaagagtgtctctttttagtactatccagctagcattctcagtctagctatgtccatcttctctttgtccctttccagtggtccccatttatgcatgtacaacacaatttagaaaggtaacatcggtatcacaggtgtgggatagtgatacacatataatagtgtttatataataatagcgttatgcttggttcatatctcgtatattttcacagcacgaatcttggaggggatcaagtgagatacagaaattgattgtaaccaagcgaaaaatttggcgacagtattttagcagtcggaaatgcgagcatccatgtaaattaatacggatgaacaaatttcattataaataacctaaccagttgaactatgctcgattcgtatgattgcataccaattaactataatatgcaaagtgaaatttataccagtgattagaaaaaggccaggtaacagttggacggggatggtgcgaaagacttctacagaagggagctcgaggcgattatcttctccccggcgatcagccggtggccaaagctcacactgactgacataataatacacacactctcactcatcttaaactaatagagcaaatgacaattgtctatcaaactctaaagcatattgaaacaatgaataactaacccaattatttttgttagagaaaaagttagcattcccctgcttttgatcgactaacaaaattaatcctttctacatggaaataatatatatgttgtgcccagctttttatcgtcaaggattaaaattgccttcgatgcacttcttattccttggtatgcctttcccgtgtccacttaaacttcgtaccaccattgaacctatgaacaccaaattcccaagcacaaggttccccaatacccttggtaacaaggcatgtcaaattgataatctttgccttccacccgacgacgatgaaataaatattcgtagtcaagctccacggtcatcgtatcaagagacggtgaactcgcgaacaatagttgtatgaggcttatttgatcatccaatgatgcaaacttacggatatctaccactcttagattcttcaatgatatcatttggtcttcccaatcctctggctggtgacaaggcagcctgattttaaacaatacaagtcatactgcaataacaccagtacagaaaacaatatatatgttagtcatttcaagtttgattagacggtagaaatcctcttttatagaagattcatataagagctaaatcttacatacccatagtgaataatcaatgtgaaggtattgaatattgttgcacttaacgatgaacttggctagactagctcggtagctcctacggcatgcccgtcgaaaatcgaactcacttttattgtcaaacttgtgacactgggaagttgtggtacatcctttatggtgtcctcgtgacctgcatgccacaatcatattttaatcaaaactatagtgttattgcaaacgagaaaattataggatatctatactttctatatatttggtacccactaaaactaaagctcaacatgcaagcatgccacatcttcactcactagcaattactattctagcctattttaaatctcatacaagcatgacatatcatctacaatattgtattatagagatcaacaagtatgtgtcaaatcatcttcctcacattattttctcaacatttaaactttcatcatttcatcaatattttaacatatactcattcgttaatctcacagcaaagcgcggggtatcacctagttagtactaatatatactaccatgtcgagctacaaatttaacccgtcaaattaatagagaggccattaatgacggttttggtcatgagggccaatcttcaatggggaattttttcagaccgtcatgtgtatatatgatgggtcattggcctccgtcaaagatgcctggttgtgtacttgtgtactagtgatatatatatatgtatagaagcaatgcacataatgaaaacgacgatagttttcttttataagtgggacacggatattacttcatctttttataagagatgcggcgctgattcatggttcatgctgcatatggaagataaattaagagatactatagtgtgtattatgttaccttaatttatctagtatgccgtccgttttacaatataagactttctatcattgtctatatttatatagatgttaatgaatctaaacacatatatgtatagattcattaataactatataaatgtgtgcaatgctagacagttttacattgtgaaacggatggagtagaatataacgttatacaaagaagcatagcaatgtgcgtaccttcgtccacataaatatctagtttcacccctaggtgaaccacggcgttgcagttcttgaggagccagacggcggcggcattagcatcgtactgatcgtcgcctccgccgccgccgaacgacatgagccggagcttcttgatgcgccggacggccgccgcgccgtcgaactccagccgctccgggtccacgaggctctcgcacgagaacacctccagcctcgccgccgagatggccatggcggaggaatcggaatagggcaggcggctgcagtcgccgacgcggctgcagccggagccccggcgcgtccacgtcgagccatcgcaggtcgggcagatgcaccagccggagctcctcgagcgcggcggccgcgtcgaggcgcagtgtggcgacgccgcctacgtgcctgaggctcagcctccgcagccgcgggcagcagggtgacgagagcaagtggccgagccggaggtcgccgccgtcgtcgtcgatgatggcgtgctggagcgtcagctcggtgagggcgcggaacgcgccggcgactgcggcggccgggacactggcggtggcgtatccgagggtcaggctcatcgtctccgctctcgtcgagcgtggcaactcgacgacgacgacctcctcatctgccggcgccgccgcctcgccgtcgtcggtcaccgacgtcgctgctgtgtcggcggcttgcgacctcgcctctcctcttctcggcgttctcgccgccactggcgccaccagcggcaactcgaggatgaagctccccttcacatggcgctcggcgaagcggagccacccgtcgacgcgcgacagcgtgatgtcggcttcatggcgatggtcgtggaagtagtacctcctcaccacgccgtaaatacacaaacagttgtgttcggagctgtacaccagggagatctccatgacatcgacttcgtcgctgccctcgccggcggcggcgcgccgcgcgaggagtgtggcgtccacggcggcgatgagccgccgggcagcgtcacgacgagagacggcgaacttctcctggtcgagctcgccgtgctcatccgcgaaggagcccggcccgacggcgaagaggccagaggcggctgtcaccggtactgtaccaggtccgacaatgcctacggcaagtaatccagtgaagacgcaaccagcaagagaacgcatgcctaatgtaagagtaactgggccggaatgggcttaggtccagaatgtaaacgtgcgagtatataagcacgagtgagcagaggggaaaaggcatcgaacaagtgaacagaaaaactattcctccctaactactgcatcttcccctgctccaagttctctctgttcctccccttcttcctaccccttctctctgttcgaatctgctcctctaatcccaaaactcccaaattcgcaagcagattcgtaacaataggtatcagagccatccatcctggagtacctcgacaaacctagataccattcccgtgcgcaactcaagtcccaagagatggagcagcaattggcggaactcgcggcggccatggcgacaatccagaagcagaataccgccatccaagcttcgatgggatccttggaggaaatcaagcctatggtggtggaactcgcgagctggaagccagcggtggacaaggccatgacggagatgcgggacgacctcggcgacctgcgtcagcaagtggagcggatatcccgcaatccgattctcgccgtcaagccagcggatctgccccctcttctacccacgccgacggtgcctcaaatctcggtgccgaaggaggaggagacggcttccaaaggggcggacgcgagtccagggccgttaggccatggcgttgcaacgatgaatcgggggaaggcgtctggagatgatttctctccaacgtctctcccggccaagggtacgtgtcaatttcagtctccatctcgtgttcctttcgaattcggggagagttcgaattgagtttttgcttcggggttccatgggggtaatgctagagtagattgcccacagtttgaaggagagaaccctagagcctggaaaatgaaatgcgaaacctatttccgagtgagtgggattagcccggatgtgtgggttggggttgctgctttgcaattttcgggaagtgctcttgtgtggttgcaatccaccaatactcatgtggaattgatggggtggaatgatttctctgaggctgtttgtgctaagttcgggagggaggaatttcagagtctcattagacagttcaagaggcttaggcaggagggaaccattcttagttatgtagaaaaattcaatgagcttatgcatcaactctatgctcatcacccgtcctggaattcagtattcttcattactgaattccttgatggactgaaacctgaagttagctcagcagtaattttacatcgtccaaacgatttggatactgctgtggaccttgcttgtttacaggaagaggtgttggaagcgggacgacgggattcgcatcggattgatggaggtttttctcatcggaccggacaacgccctgtggggaatgttgcttttactcctgggcgagctggtgggcgagttgatgacagaactcagcctctggaggatcgagtggcagcactacgtgcttatcgcaaggctaagggattgtgtcacacttgtggggaaaaatggagtagggaacataagtgtgggccaactgtgcagttacatgttgtggaggagttactcgacctgcttgaggaaccggatggggaagccaaatccgctggaactgatgagctaacagaaaaggcttctgaaactgttagcgaagtctgtcagatatctaaagaagctatgctagggactgaatcttctggaactttgaggctgcaaggattaatacaacagtatgagataatgatgcttgtagactctggcagcactcatagctttatatctgaagaaatggcaagcaagataagaggcaatcagaaaactgtgcaagcttttcgagttcgggttgctgatgggggaatactccaatgtaacaaagaaatgcagaattgtctttggctggttcagggtgtttcttttcagaacaacctgaaggtgttacctctcggaagttatgatgtgatacttggaatggattggcttgagcaacacagtcctatgcaaattgattgaagggctaagactctgagattcaaacatgcacaaaaggatgtttgtttgcgaggtgttcgagctgataccagcagctgtacatctctatctgtcaatcaagttcaaggactgattcatcgggaagctgtgatgcaagtggttgagttgtgttctctgatcaatgaaacagataatacagaagtacctcaggctgtcgattagttgttgaaagaatttgtccatgtctttgatgagccaaaaggtttaccaccggccagagtatttgaccattcaattcctttactgccaggagcaaaacctgttaacttgcgaccttattgatataatccagctcaaaaagatgagattgaacggcaagttgcggatatgctccaacagggaatcatacaacccagctctagtcctttttcatcacctgttctgctggtgcttaagaaggaccttacttggcgattctgtattgactaccgccatctcaatgcaattacagtcaagaatcgatatcctttgccaattatcgatgagttgcttgatgaattagcgggatcctgtttattcacgagtttcgatttaagagctggctatcatcagatccggatgcgcccagaagatgagcacaaaacagcgtttaagacgcacaatggacactacgaattcagggttatgtcctacggccttaccagtgccccggctaccttccaagtactgatgaatcagatcttagctccattgcttcgcaaaggagtgctggtgttcacagatgacatcttaatctatagtcaaaatttggatgaccatgtagctttgttgcgacgggtgtttcaattgctaactgatcatcaacttaaggtcaagagaagcaaatgctcgttcgcccgtgcaagtttaccatatcttgggcatgttattagtgcagaaggtgtggccactgactcgaagaatattcaagcggtgcacaactgggcagtaccctgtaatgtgaaggaagtgcgaggatttttgggtcttgcagggtactaccggaagtttgtacactcttttggtattatcagcaggccccttactgatctgctaaagaagaatgtggtgtttgtttggacgtcggagcatcaagcgtcttttgatgccttgaaggaagctctagtttctgctcctgtcctagcactaccggatttctccaaagtttttgaaattgagaccgatgcgtctgataagggtgttggcgctgtgttgatgcaagctggccatccgttagcctttctcagtaaatctttggggcctcgaaatcaagggctgtccacttacgagaaggagtgcttggcgattctcctcgctgtggaacaatagcgctcttacttgcagtttggagagtttataatccgtactgaccagcgcagtttgattcatttggatgatcagagattagtaacaccttggcaacagcgtgctctgaccaaactgcttggtttacaatacagaattgtctataagaagggactggaaaataaagctgccgatgctttgtcacgcaatcagtcaaccgatgtgtttcagctcagtgcggtgtcttcctgcattccagtttggttggcagatgtgcagctgggatatgctcaggatcaagtatcctctcaactgttgactaaactctcgtttaagtcctgaggcgctccctgagtacagattacagaatggcattatctaccataagggaaggatttggttgggtaacaatgtggagttacagactaaagttctgactgcactgcacaacgcagcaattgggggtcattctggtactcaggcaactttcagtcgagtgaataagttatttgcttggcctggactcagaaaagctgtgcgccagtttgtgtcggcttgttccatctgtaaacaggccaaagcagaacgggttcggtacccaggtttcttacagcctcttccagtgcccgagcatgcttggcaaacagtctcgttggatttcattgaaggcttacccagctcatcgggttttgattgtatacttgtggtggtcgacaaattcagtaagtatgctcactttgttgctcttgctcatcccttcacagccttcgacgtggctctggcctacctcaacaatgtctacaagatgcacggattgcctcagcatctgatctctgatcgagatcgtatctttaccagtgcattgtggaaggaactctttcagttggccgacactcaattgcaaatgagctctgcttatcatcctcaaacggacggacagaccgaacgggttaatcagtgcttggaaacctttttgagatgttttgtgcacgcttgcccaaagaggtggtatcgttggcttgctttggcggaattctggtacaatactgcctttcattcggctctggacaaatcaccatttgaggtattatatggtcattctcctcggcattttggtgtgttcgatcgctttgagtgtgctgttccagatttgcaagactggttgaaggaacggaaagtgattaccagtttgccgcgacaacatctgttacgagctcagcaaagtatgaagttacaggctgacaagaaacgttctgatcgtgagtttgcagttggtgactgggtgttcctgaaggcacagccgcatgctcagttctctatgacaggacgttctaatcacaaattggctttccgttattttggcccctttcagatcttggcgcgcattggaagtgtggcttatcgccttcaactaccgacaacttgtgctattcacccagtagtacatgtctcacagctccgtcaggcttcttcaccagctcctgactcgtcgattcaagacctgccagcgttaactgaagatgaagcgctaccagtccaaattcttgctcgtcgtgcagtcaagaaaggcgctggagctgtggaacaactcaagattcgctggtctggtcagacgtccgctgaagcaacctgggaggatggtgctgcactgcgtgcgcgtttccctgaagcaccggcttggggacaagccgtttctgaagaagaggggaatgtcaccggtactgtaccaggtccgacaatgcctacggcaagtaatccagtgaagacgcgaccagcaagagaacgcatgcctaatgtaagagtaactgggccggaatggacttaggtccagaatgtaaacgtgcgagtatataagcacgagtgagcagaggggaaaaggcatcgaacaagtgaacagaaaaactattcctccctaactactgcatcttcccctgctccaagttctctcctctgttcttccccttcttcctaccccttctctctgttcgaatctgctcctctaatcccaaaactcccaaactcgcaagcagattcg

SEQ ID NO: 58441 - DNA, 2357 bp, Oryza sativa
ccctcttgatttctccgctgcatgacataatctactatttacaatcatgagtactctttttgccctttgagccccgcatcggtatagccgatgaggcaactatatgtgggacgttacgccgggctcacttgccaagtcttgttattcctgctgagctagtgtgaaaatatgacttttagaaaaggactgtagcaacgggacatctcgaggtaattcgtaacaaatgcgattgtcaggcttggcagtgcaccgcgtcggacgaggacataaggcccatgggacatgtctcctccctcaggcctataaaaatgccacaatagcctttcccgggctatcgaggagtttccacagccgaccacttagaatgtgacttcgtgtcacttctcggaatagaccacgtatcaaacatcggatgtttggacactaataataaatattaaacgtagactattaatgaaacccatccataatcttgaactaattcgcgagacgaatctattgagcctaattaattcatgattagcctatgtgatgctacagtaaatattctctaattatagattaattaggcttaaaaaatttatctcgcaaattagcttttatttatgtaattaattttgtaagtagtctatatttaatactctaaattagtgtttaaatatagggactaaagttaagtccctgaatccaaacaccaccttagctatgctatagaacacaatacacatggttgttcccaagaagactaacatttgggcccatcttacaacagagccttgaatcagttcccgtgcagctaggccatcagttccacacacccacgagtagaccaagtcaccgtccccaagcaaccctgtgccaccgcctaggttttcgagtgtatcggcttcattgtggttccgtgagtcatgcagcgagagagtgcatggaccttcccgtgggattacaggtcattaaatggagactgtatagagcgatgctatgccttcacaatgaagcaaactggctaaatagagacctttggctagaatgtagatattctttatttcaggtgatattataatatattttttatccatagcaaagcacgaatactcaactagctagtatcgcgtaaaatgtactactggacatgattgttcgattggtgctctgcatgactgcataattcatttcatcgaattaagaatttaacttgtcatatatcccaccaactactggtccatgcttgcatgcaaatccatccaggaaaacaaaggaactattacacaagcaacttgcgtgcaactaaactatagcaagctatagctcacctataaatatcagacgaaaacccacaagcaaaccatcccaaactgacacaagctagagcagtctagaacactgagtgactgattaccaccggctcattcgatttcagacaaaattatggcttccaaggtcgttgcttctttccttgccctttcctctttgctgtcaccgcacacggctgcacacccaactgctctagtgagaaggtcatccctacgccacccgaagcagtgccggcgccattgcaccctggtgggcacagtgatcacgggcgttgcccgatcaacgccctgaagctgagagtgtgcgccaacgtgctaaagggctggtcgatgtgaagattgggtacggccccgatgactgctgctcgttgctgtcagggatcgccgatctcgatgctgccatctgcctttgcaccgccgtgaaggccaatgtgcttggcattagggtcaacctcccagttgatctcggactcatcctcaacaagtgtggcaagacctatccgaccgatttcacctgctaagcggcacagttataatattccagagtttaatttggtgtggttgttcgctattgtggttgttggctattgttccccgtgagtaagtctcttgtcgggtttgcagattgatgtgcggttttatcatccttgaatcactttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattgttatcgagaatatattttattggtttactacgtgtccactttctctcaccatgcatgcataaaaatagatcgatctgcaaatctttatctgatatgatcatatgtctataagctacaaagaggg

SEQ ID NO: 58442 - DNA, 19621 bp, Oryza sativa
aagccatggatgatggtgattgaaacgaaagcttgcatgaagccatgaaatttgttggtgtgaaatacatagagggtcgaatcaagctcgggatacatggtcgaatcggagtctcgatcgatcgatgctaattgcactcccagtagggattcgttctgttattgatagtactagaaagaaacacgcgctacgccgcgtgtgatatgaattgatcaaaatgcacaaagagtctgcttgtccttcatatatagagttgtgcatatatggagtgaaataacctttgaccatcatcacagtgtgcatttatgataatcaggtttttctacataagcactattactctataatgttgaccaaatttgcaaacaaactatactgtagacgaaccatttagagaatacatatacataattttatataggcaacatttatcgaatttaatctaaaatcacaaagaaatcttattattaaaaaaggaatgacataagtattacaaaatactgaagaaccacagtgttagacgtctactggcgcggtgagagaggagcggtggcattttgactggttagcacagaacttagaaccgcgaagattgaccacaatagaatcaatttgtaactattatccttgtgaatatttaattaagagcaaaacacaatgacattccatagcttgtgagtggctaacagtagtacggtccattgttaataaaattattggtaagctaatcatacaatccaaggaacttctcacagaaaaaccaataagtttgataacaatattggctgacgggaataagtagataattaaacagagctaggtagataatgaagcaaggggaaaaggatgtacagtgattgttacaataatatgatattattgcgtggcaaaatgtctctccattgtaagaaaaggtgtgaaaaatgtacatgcaaagaaatccatatgtaggagacctaaagctaccaaaattttggatcacgaaatctccatgtcatggtactaaataaataatccaccatggggcaactgcaaattataagtgccctatcaagcgatcaaaacatatgtggaacattgtgagaaataggcagtaatttgtatgttttatcagaggttgtatagacaaaaatgagagaacaaccacatgcagaattacatatagcattttgtttgggcaaaactggaagtctcaaacaaaacttacctatggatatgttgtaccaatgaatggataactcttgtttcatgttggaaacatgcaaattgggagctctagaattagtttagctattcatcattagctctgcaggcacaaactattgattcccagtaggctatactatcctacaggttcaggaacaccacaataaataaaggattgagcatattactgaaataaaacagaacattagcctaggttcatcactgaaactccaatgcaagcacaaatagtccttgaagggcatgccatgtcaattatgcaaaatgacagacattgctagaaattcatatagcataccttggcagtggattttctataaagcaagaactatttttttaaagaaggaaagcaaggcaatactatgcaaccattggagtaaggagatgatgacagcaaatttcatttacaaagaatgccaatatatatatggccatgtccacaggccaaccgatgctatccacctcctcaccaatgctagtgctattatacttgcagaacgaacacacagagagaaagcagcagtaataaagtgaattgctaattttgtgtaccaatcattcctccactgatctattttgctagtatgcgcattggtttgcgtgtacatcatgagagtagtattaccagcaatcaaccaagaaatataaaaccaataataatatcaaaatgtgcatgttacatcttgtgtgagagagttggcaaatatgacataccatggctaaagcatgccttctccagaccatacaaaaacacatgatacatgtctacctgcagctaatattaacaggttaattccagggataagtgaatttgtaaaaatcgaacaaaaaataatttatgactaacccatcatccgattgagggggatggtattgtggctctgtgagatataaacagctgttgttcataaaaaggagaataaatgtgagaaggagaaaggaggcatagctgctgacctggggaaggagtaatggaggagcacatttgaacagtgaccttggctgggagatagaaatgaccttgaagattttgaggtccgggaggcccaaatccatggcgcatcatcggcgaaacctgacctcctgctgtgcaagcagcaccatcgtcaacaatctttagcctaattagcctaggaacagcggcacatttggcattgagcaacccgcagaatatcaactaattaggctcaattcataggataacaacccaaaagctagtaaatgcaaccagagcagtgaagggtctggggaagaaccaccaccacctcatcctgccactccgtaatcttctgcatgtgctagctgcatgacagaatacataaatcatttcattaggcaccatgtttgctccaagatagaacaaattttcagtgcaaagcgatcctctttggcacacacctatttgcaaaatatcaatcaaagagcactaattatttccccccccccaaaaaaaaagagcactaattatttgctccaaaaactcacctgcagacaatatgatagtattatggtgggctatacaggagaggcaacagagaggacagcttcttctcatcctaatcctcctctacgccatcgccgtacccagtacacagtccaaactcgaaacccacatttaaatcaatgtaattgctcgaaccacacgcccgttgatgaaaggtgaaaacacagggagctaatccacgcacggacgcacctagccgcaggctgcgccagtgacccgtagaactcgatgcgtcgtcaccaagccgaagacctccaagaaactgttgcggagccgcagcaacctcaaatcgctgggacctccagcagcagcagccacagccaaatccctcagctagaggctccaacgacgccgctaggtccccgacctcgaggcgatgttgaaaccgccgttgagcccctccatcaagcgcagccacgaccatacactcgaggggagcactcttagatgacgggtaaaacgacggcgctggaaaggccttggaggaggaggaggagtaggagcaggaggcggaggagcattggcgccgcgccgccgccggtcacagaagggagaaaggagatcccaactgctcctaccacattcttctactggagtggcccctgagcaagaacccgcatcaagtggggcgaagagggagagaagaagaaaagggctatgacgctggcttacctccgtcgtctttgggtagccggatacatcggcgagccagccgatggtcccgaggcggatttggcgccgcacagaccggggcagagatgcggctcgcagcgggcgacggatgcggggtcgcggccgcggccggggtgtgcctcgctccaggcggtggtgtccctcccgactccccttctcctccccagcctcctcttaacggatctggcggctcattgggagttagcggtggtggcagcacggtagaggagaagggagttgcggcggcgacggcgacggcgacggcgacgacgcttgcgagcggaggttggcgtcttggcgccggatccgccggtgaggagaccggggtcaccggatctgacggccccggcctccttactaggagatccgacggctcattgggagggagcggcggcggcagcacggtagagaagagggagctgcggcggcgacggcgcacgcgagcggaggaggcgggcgaaccgacgtgaattctttcgaaataggatcttttaatattttagtttgtaaatagagttttgatggcaaattctcactagtaaacaaatacaaaagattaattcttagaaatgattttcagatatcgattaatattagataaaataacttcctccgggaattatccctaaaggggtttcctttaaatatttagtgattataaatactcataaaacaaatacccaaaaaggggttccaatttatagagacagggtttttaggaaaatgatttattttcacaaatactttcttatttcataatcatggttccttaataaataatattttaattcaaaatagattttattcctagatttccgtccttgtgtcccaagcacaacaaaaacggatagtcagatccaataaacttcggcacgaaggaaattagaaaaagatttttggttattccgaattttgtttccgtatttcaaactcgaaatttttagggtgttacaatagattactctaacccgcccataacaactaaggtggaattaattccacgatctcataacacagtaacacatgagccaaattcaaataggccgatgtcacctaatttaaggtgactaaataaaagggctgccatgccaaaaaaaattatagttcttggacgtgcaaagctgccgaccctgtcaacgtcgattctttgtcctgatctgttgtagtatgttgttgctctctggggtagatatgtgtagatttctcaatatcgtcatcggtgacatcgtcagtctcattgccctctttgctcttaccccacagcatggtgtaaagacttccgaccagcaaaattccacccaagatgctgccaataaaggaagagcggaaaatgaaagtttgtttatttcagagtgtttttagaatattgcacctttgatcagttgacagcaagtacatatgatttaacttacctgccgaggtgaacaatctctccaagaaagaaggatgagcaaaatattgtgaacacgaaacagagtggcgtccaggaggcgaagaacatggggcctctcatctctaggcaccacgtttgcaggtagtaggacactcccgtcaccataacaccctgaagcaaaccaccagtcgtctaatagtcagatgcgtgtgcagaagaccatgccaatagtgaatacgctagtggaagaggatgactgaaaattttatgtacagaacttaccgagtataggatggcaagcaagctgatgtcgaatcttagcttccatttggagaagtcgcgctctgcgaccacggcgacgacaaacgactgcaccgtgctgaacaagcattgagtcaaagtcacaatcattttatctggatattccttttgcaccgctgcctgcacagtcaatagacaaggagtggagacctcgattcatcagcaattgcagatgtggatcgatgcagacaagcatgcaagaacagctcagattttttttaaataactaaatatgcatgcgaacctgaaaaatgatccacaaagaccagcacatgttggcgatcaccataaggaatgtccatttgatccacacacccctcggaactacatttttagagcctgcgtcagaggcgaaggcacggtgatggttgatagggcttatggatgggccggtgaagaaggcgatggtgaagactccagccaggcagagtgctacgctagtgaccttggctatgcctgaagagctcctcagcttcacatactccgtcctggcaagcaacatttcaatcctggtattatatactactccatccattcaaattatgtgtgtcgatatagtgtatatctaaatatgtatatcaaaatttatgattaatgtcaaaacatcttataattaatgttttcacaactaacttgaatctatttatggtacattctcaagttaggctttaatgatgtctcgtttagagcaaaaataatagtgagctataagcaagctatatgcttatgtggaagagaaggataaacaaaagtggggagtgttggctctcatgtaagagctaactgcacacaagctccaagaaacatgcattaaattcataggagagaaaaagaccggatgaaaaaaataaagataaccttatagttaacctattatacatgttagctttcacaatgactaatagtaagtagtgagctctactattaaacttgctcttaagaggtggtggactatgatatcgatgatgataaacctcaaaagcactgccaagaagaaggtgatggctgggagtgagctgtctactgcagatgccaccgttgcagaggtgaacttgaggcttacatggtacagatttaccccaagcgtaatcctgaaaagcaatttccgcaggtaaaccagcagagactaattaaactcttgacatatcatgagtatacaatcgatcgttttttttgttttgtttttgtatcaataaattagagattgcaaagatgagtgcatacccgattaaggcacaaaagaagagctttatgagcaccccaagtgtcatgacctgtcgtgcacttttcctacaaatataatcaaacggacttctatttctcagcaaatcaaacaatatagcaaactaaacgaagtggcgatatatatatatatatatatatatatatatatatatatatatatatatatatatatatatatatatatatatataatttattttgtgctccatggtgcccaattttggtcgttcgttttatttaaaaatttttataattagtatttttagtgttatgatatgataaaacatgaatagtactttatacatgacttatgtttttagttttttttaaaaaaaaataaataagacggacgatcaaagttgtgcacagaaaatcatggttgcacttaagggcctgtttagatcacctggcaaaatttttcaccctgtcacattgaatgtttggacacatgcatggagtattaaatataaatgaataaaataactaattatatagattgcgtgtaaattgcgagacgaatcttttaagcctaattgctctataatttgacaatgtggtgctaagtaaatatttgtaatgacggattaattaggcttacacagtttacaagcgaaatctgtaatttgttttgttattagtctacgtttaatacttcaaatatgtgtccgtatatccgatgtgacacgtcaaaacttttcaccttgaatataaacatagcctaaattggacggagggaatacctttgtagaagagctgcaggcagcaagatgagggagccaactgcttggcgatagaagatgaagatgtaggtgttcattccgtggttgaaagcagccttggatatcacaaacatgccagtgtagatcagttgaacgatgatggcgacaaaataaggcttcatacttgctttcaccatctcgatacaggaatagcaaggcgtgcgtagtgtttgtgggagtgtattatcttcagtgtgcgagagcccccgtttagttcatggcactactcctatgtatttatattaaaaagaagaagcaagcagtatgccgctcagtcatgtgctcaggagatgtaaaacagcagcggtggtcggtagtgtgtgcttggacggttggacccagtaacggcacgccaagtgtaaacgcaagagcacggtaggtgtggacttggactgagtgacggcacgtcgtatggctttgacttggactttaacttttaagcacgccagatccacagataggagacccacttcgagtctgtctaccaacgttcagctcgagaggaccgacgttccgtggccgagcgtgccgcgcagatgcctgtccagggaccaactttgaccttactgtgccggacacgagaacgcacgcaccggagtaggactggagtatggtcaattaagtagaaaacaaatgtatggtcaaagtcgctgggattcgctaattgctacgcgcaagcaaacgaaggctgtgttcgtttggacgttttccccagcgcgctacagtaacacggaaaacggaacggttcattaacacgtgattaattaagtattagctaattttttttcaaaaatggattaatttgatttttttaagcaacttttgtatagaaactttttgcaaaaaaatacaccgtgtagtagtttaaaaagcgtgcgcgggggcaaaacactgtagcgcgacgggaaaacgtccaaacgaacacagccgaaatcacgcgcgttttggatccacgcgttttcacttttcctctttttttttggcctggtttagttgctactaaattttttttctaaaaacattacattaaatcttttgacacatacatagagcattaaatatattaaatatagattaaaaaaactaattgcacaattagaaagaaaaatcgtgagataaatcttttgagcctaaatagtccatggttagccataagtgctacagtaacccacatgtgctaataacggcttaattaggctcaagattcgtctcgttgtttcaaggcgagttataaaattagttgtttcattcgtatccgagaaccccttctgacatccagacaaacatcgatgtgatacccaaaaattttcttttcgtgaactaaacaggccctttgttttcttttccccaccggatccccgcacgcgcacacgccgacgcgcattttctcctctcccgtaactaaccaagtggcggcgcgcattttttcttctcctgtaaggccctatttagtttccaaaacaaaaaaatttccacactgtcacatcgaatgtttggacacatgcatagagtattaaatgtgaaaaaaaccaattacacagattacatgtaaattgcgagacaaatcttttaagcttaattgcgccatgatttgacaatatggttctacagtaaacatttgctaatgacgtattaattaggcttaataaatgttattagattacgtttaatactttatgtgtgtccgtatatccgatgtgacaaccaaacctaaaaattttcctcaactaaacaaggcctatctaaccgagttagtttagaataatgacaataattaaaaaaatattcggtagcgctaatacgcgcgcagcgctagaaatagtacgtttgtccgcttttctcgttttatttctacacacggacctgtcacgcctccttctatttgtcccaagtaaaatattactaccggcttggttggaaatacctaactaaaaaatacgcaagggcttccataaaaaatttcgtctgtcgtccgctttatccacacgagcaattggttccattaattttcgtccgtacgtgtaacgactccgatttgttaccatagacgtggcctgactgaccgttgaatagtcatattgaccctgtttagatcctaccttaaaatttttcaccctgccacatcgaacatttaaacacttgtatgaagtattaaatgtagactaaaaaataactaattgcacagattgcaactaatttgcgagatgaatcttttatgcctaattcctccataatttaataatgtggtgctacagtaaatatttgctaatgatggattaatttggcttaataaattcgtctcgcgatttactgacggattttgtaattagttttttattagtgcccgaacacccaatataacatcctatataaaactcgatgtgacatggcaaaactttactactattgacctaaacatccctattgtgtagcaacacattatggcataaccattgacattctcagttggttagccaatgaaacttgtggccgctatgatgggagttcgattcctatcacccatctgttttgtgctccttatcctctccaaatttttcttttcctctcctaagctgattatattatattttttataaaagtacatccatgtgtttgaaattcatattaaaccagcaatatatgtaattttctaccgtgtttttctacactttgtcacctcctcttattaatattttcgaaaagtatgtccatatgtttgaaactagtattaaaccagtaatacatgtaattccctactgtgattttctatactctatcaccaatgctgcttatcctctcattttttttccttttctctcctaagctgattatattttttaaaagtacattcacatgtttgaaaatttatattaaaccagcaatatatgtaatttcttacagtgtttttctacggtttatcactgtttgagatcgcgactacggtatttgcatggtatagagataatggtaccagggcatatgcaagattgaaataaaagagacagaaacaagaatttttagggtgcgttcgtaagaggcggttgggaactcatttccttcgcacgtcaaacggagcggttcattatcacgtgattaattaagtattagctatttttttttcaaaaatggatcaatatgtttttttaagcaactttcgtatataaactttttgcaaaaaacataccatttagcagtttaaaaagcgtacgcgcggaaaatgagagtggggagctaggaactgggagatctgaacacacccttatataggttcgggccccttatctagcaggtaataggcctactcctgttagtcgaaaccggtgttgctcctttattcatgtaaatcacgcaaatataataattgggataacacatctagctgtcgtcaacttggcggcatgaataaccaacacgtagtcgacgatagggtagataaaattttgtgtgttgaaagaaaatatcgatatatttttttaagtagataagtctaacggaaatgagtgaaatgtgggaatatagtcgtgtgctgatatggaaggaaaatgcgtggagttgaaaaatattgctcccttcataaaaaattaatgtaagatatatttcttttatcatcacaagtctggctctaatgggccgcctggggttgaggctcgtcgcggccttggttacgttcggaggagaacagagcagcagatcgggctcgggcggcgaacgagctctcagtgactcggccagccgtggcttcgtgctgtgcatcgtcgcagcccatcggagatgtgcgtggccttagcttgctgttaacgggtgcctcggcgtcctcgctccaccgaaatcgctgccgccaccatcgtttttcacaagagtgaggaaggagatgggcaaaatgattttctttttagattttttgttgtcggatttttgtctaagtcgggatcaatcgggaacatcttatcagattggctggtcctagcttctcccccgtcggcccagcgctattcccagggcgccgcgctgctgggccgcctcatgtgcggcgcgcgcgctccacttagaagcaggccgcaagtttttggctatactaaaatcagttattattatttttctcttcctgtcattttaagtagtagtattttctatttttaaaaatagcattagtagtcacccctatttaacaaaaccaaataattataggtatacatacaattaatgagtatcaagttgttagtgttttgatcaacaattattttagtacatggagactatatatgatccctctaaaaatatataaaaagagagagaaaaattataaagccgagtgaacagggaaggaaaaaaaaagacagaaacagagcggataaaccaaagcagagcgaattcgcgaactcacattcttcctccctctctcagtcaccggatagaaaaatcagagcagacagaggtggtttttgaatattctgaagatgaagatgaagataaaaattaaatgtttcacacaaaatgaggttgtaattgtttacacccaaatttggcatataaaattaaattaaggaaaattgtcaaaatttggaagtctgccggtttttctctaagaggaccagtctgaccgccgtgtgtcagccgatcagaccacctctagtgggccggttagactggtggtgtgtggccggtctgaccggcagagtccgagccctagtatgtttcatcgggtctcgagttttccttacttgggaaggcatgtttcgggtttcctttggtttctatcccgagttgaacgtggaggagggcctgtagagggcaagaccaatccctatataagagacaaggccggttcattgtaaaaacacaatcaacaatcaatcaataatagaatcgttttttcatattgcttttagttttcttttattttgtccatctttgtcgattttcgctgtaaatcgttcgccgccgctgcgagagtgtgatacctctttgtatgtttgtcctgaaaaccttccataaattagtcatgaaagcgagaaggttatccttttatagtttgctcggaaactagtcgttcgtcgtcatgtaagtaagatattatcttctttactaattagtcatgtaattccacaaaagtgaattaatctcgaaatcagtttcactagccggttttgatttatcgattttgacgactctgttgattacaccctaaattattaggtgatcttatgttgacctaaaaagcgttaacatattttagcaactccgctagggagagaatttcggtcacgcgattagaccgaaatcaatctaatccgctctttgttggctgccgaattaatctattcggcggcgtcggccagccatcagtccgattatctatttatttttatttttgtactccctccgttacagagtataataagttttagagctggacacagttattaagaaaatagataaaaataaatagtggtgggttgtgattagatgagtagtggagataggtgagataagtgaatggtggaggcctagaggattgtgattagttgggaagagaatgttgacgaaaaatttgttatattttaggataaatcttgaggattaaaagttgttatattttgggatgttgggagtatttgtttggtggtgaaatcgtttggcagtactgggaaagcacttctacgcatgctaaccgaggtataaagaagccacgctcaatctgtatgtgcttgtttatctatttggttttttaggtatacacgcaaatcttaccaggaagagtcaagcttccgtgctgaaaatacatcgacgtgtaccggagcgcgacaccactgtatgttaattgcgaggtacaatctacaatcactttgccagtgtcttcaaattatttttcgagtattgtgaattctcatatagatgttgatagacctaatttcaatggatatctgcatcggttaatgattgctcaaataattatttgagatctttgaattatgatgaaaataacatgtcgcagctttaaattttaataattcaagatatccaatatgttcacacaccttttaattgatcggtaattattttggaacctattactacacaataaattttgccgatgaaagacatgcatgggcatatggccatggcagtatgtattatctagttgattctattaattcattacatgccatgccaaataatgggactcacctatggatcgggtggccgattttttctgagaaaaatcgggtgcccacatcatcatgcatgcatacaaaattttctaagcgaactttaaactattttttctcttaagttatttatccaaatcatgatccgattgcactattaaatccattgcaattaaatctttacaacaagaccacacatggatataatccgatgaaaaaatattttgctagaacctatgaaacaacggtttgccaaaaaatcggcgctatttcaccttatataagaaaaataatgtttcagtaaatagcgaaagaatgtttcaattcattgcaatatatacatagtgaaatattatgtgtacactagataaaacatttttgatggaaaaaaaagagacaaattcccttaatggagggttttcataatatatgtgggtgatttgttgcaaaagaatgtttcaattcactgcaacatttgatctatacatagtaaaacatcatgagtacactaggtgaaatatttttgatgaaataaaaaatgagacagattcctttaaaagagggtttccataatatgtgggagattcgttgcaacgaagtgtgtggtggggacacgtggcgtgttgttgtagggacgcgtggcggggcgtgtgggaccgctacgcgaggcgcccgatccgcacgcgcgcgcgttgggcaccgaagcgtcggcattttctcaatcggagttttcttttcatgctaatcgttcatcttgtatagtgtaaaacgcttataattcggcttcatgcgctatgaattatggctagattaatgaaaattcaacaagtatacatacaactccgtctgattttgttgcatatagtacatcacatgaatctccccagactttcggcaattctcatagttcattgccgaaagcacgtgttgagatccccgcattgcatatgtcgtatggagagccctccatatcataaagatagatagaaaaaactgtagagatgtgaaggagaaatcaatgcatatattttaagcaagggtcaaaactaacttttgctcaacaacaaaagccgataaatttagaattatcggctaatgaaatagaggtagctatgtttgatttctctggagacataggagcttttgttttgccagctgaatttcatgtcaaggaagttgacaaggatcaagacgatgtagcacaaaacaacgcagacaaggaggagacgttggatggccataagatggctaagcaagacatcgttcaggtgaagaaatcgtcctccatctccaacacatctgataagtaatattaactggtaatttacttttttttaatcacacagtacaacgcagatactcacaaccacaggcacctcgctgtcgatggttacgtcgcctaccacttaaagcacatcgccgttaaatcctagaaaattcgctcccatggggagtcgaacccaggatcttaggtactactgaggctcttataaccactaggttacatgcccttttgcaactagtaatttacttatttcccaatttgatcataaatttgcaaataattcatgcgttagaaatgtcatcatgaataattctaagggatcaattggcgagattaatatttttgttggaaataataaagtgtttaaattttctatatcatcgttgccaaagtttatgtctacatggtttgcttataatcaatctagagctagagacacaaaactaaaattagaatatattaatgaggttgatgctaataaagtggatagttctaaatcattgaataagggaaatataagcaactgtgtagccgaatgggtagacattaaatctgaatcattcgcttgcttagctttaaaaccgtctccacaaaagtgtcggttaaagaaaaagaagtataattttgattggactatgtgcgatcatatttttgatgatttgctaaaaaaagatttgatcaaattaattgatcactatgtcatgccatcgcttccagatttaaaagaacaaatttattgtaagtggcacaattcgttcaatcattgtactagtgattataatatttttcgtcagaaaatacaatcggctattaatgaaggccgattgcattttgcaacttcaagaaagtcacatgccaaggatgatcgtttggataaaataaattagtctaggtggtctctaataagaagaagtcttcggcacaggtgggaggtagttcaatgaggaagcaaatctaggtaccgaagtctaaaggtcaagaaaagggcttagctgctagcgcacgtctgagtgtagaaacaaccttggttcaaaaggagataattgaacctcgggggcatacacgtgtgcaacaactagaaaatttacatcatgtgagtatgaagcgagaggcatctccgacagagttagtaacaaatcagaattcgccgaagaactctgtgggcaatggtagccaaccgagacactcacatagcttatcaaattagtagaagaaacagttggacaaagtgtagaaaagttgagggagagagtatagcatgggttcctaaaggatgtgttcaagtgcagaatgaaagagatacaaggagaagggagttaagaggtgtgtgccaaatcaaaggttcgcatccaaatatccaatcatcacgaaattttgtcaccatattatttatattcttcaccaatgtcatattaatgccgatgtcatggaatccattcccaggtatgcctttgcgcgccgcctgaaagacatcaacaaaatcaaaaggagacgctaattatatgagaacattcatgttaccgatcacacaaagttgaagcctacacacctttcgccgcgcatacatgagcccaaattaaaaatagaattaggctgcaagctgcatttgtgtacaatctaatgtaagttgcttctcaacatctacatttctgagacctgaccatcctctcctactgaaagccctttggatatatgaacgtcgagtcgacacaaataccacctgttgtgtgtgtgcaatcaatctacaccatcgagaacatcagcttgattgtttggtcaggctttgagaccacaaaatcgccagcatggtaaagtacccagctcccgggctcacccagggagcagagcactgagataatgagtgctgcccaccagaggtggagagctggaagcgaacaggcttcttgtcccaaccatggacatgctcagtgcttcaaactcggcgtccaaatcgcttgtagaactttccgagatgaatcctgaagtataagctgtaggttcccacagggaagctgaaatcgatctttccaaccacttcaaaccaccagatttgctgaaggtatgccacagatgaaatctgcatgaacaaaacaagaaagcgtaggtaaggttggatccagaacatatgacattctcaaccgtaattgagtttgaatagagtagatacattttcagaacgtcattatgagaaccaattacggttcaaactcaattacggttgagaacataactagttaatattaatatgttaactcaattacggttcaaactcaattacgtcatacagccaaacatatcattatgtttcagaactaagagtacattttaatttataactttggctttacaatgttagttaatactcggtggaataaaccacggagaaatatgtactttgtcatgagggaaactggaaagacctttggttcaacactcttataaactttataatactatcttatgttgaatagtttcacattggttgtggaagggcaaatgtcctaagatataattgggggagccccttacctcaatggctagcttttgaggtgggaaagaccctttacgatcctataattggtataagagcctggctagtttaacatctctggcccgatggacacagtgtgtgaagacctgatggaccgtgggtgcttgcggggctcgtatacctgatggaccgtgggcagggcccgtatacagttaagggttgagggacaccaatgtgtgaagggggagattgttgaatagtctcacattggttgtggaagggggagattgttgaatagtcctacattggttgtggaagggtaaaggacctaagatattagtgggggagccccttacctcaatggctagcttttggggtggaaaatgccctttacaatctacatcttatggagctttagaagacaacaaggagcaaggtagattactaaaacaactaccaaaatatcagcattcagatcaaacttttaatttcaaaaccaagttagaggtatgcgtgaacagacacttaactcggtctcggctccaacctccctaaccatcagccctaccttgaccagcaatatccatcccgtaccagagacggacaacagcttgagctcatggagcatgcagatggcctcagccatgcgcttgcggggcatgtcgacagtgacgatggtcgcactgcgaggacaaaaaaactcagtaaaaggcaaacattttcttgagtgaagttactgctgtaaaagaaagtgatggctcaatgatctacagggattagcaagcataaatctctgtttcttgcagagtaaattgtactcctaccaaattcccttatctgattatggattgtctaacatcagaatctaggcctttttttcaccatcctacaatgaactgaaggatggcgcgtcatactacccccaatgaactgaaggaaaaactaagttgtaaaaaaaaaatcaaccacaataatagtctctcaatggtgaatttcaactacaaattttgcatataattataaagctaaaggttgaaagttgcaaactcagggtgatctctatagattatagaacaagacataatgtgtcaccaccatatataagcaaaattgtaagctatgcaaacatgtcactgacctatgtgccaggaatacaagaataacgacaggtcaacagtaaagcaaaaaacagaatctcggttgttagtttcaatgggctttctaccaagtttgtttaagcattacaagaagcaatcaagctgtattaaaaatagtataaatcagtagtgcttcatttggaattcctttgtggtggtgatagtccagaaaagatcatattaagagatattaaaagaaactgatgacaaggttagtttcctttgtattggtaagaacattagtttcctttgtattggtaagcaatgacaatgatggtctgttagcaactactttggaatattggatcatgcatttatgaaaaaggggaaaaaagagaagcatggaaggacaagcaaattgcaaaataaccatctgttcgaagcaccagttattcttgtacatgaatagttacattatgctagatgaattgtattaatatccaactcttacaatagaagtaatatgcatcaaaatttctgtacacacattatttttgaaatttgtgtggaataacgctttcaacacaaatcttccccaaaattaatggctaaatatctactatgtaaaaacataaataaataagtaaaatggaatcctgtaaaaacacacactcatgccatgtccggagtatattctacggaaccctatgaaaacatgaaaggatccattgaatctaaaacaataggaaattattacaacaagtgtacagtgtatcttgcagcttgcctatactgtgcaataccctaattttcgccaagagtaaattatacctacggtgcaacaacttggcaggtggatgcgatatagtgcaagaacttaagaattgaacgtccgagtgtgataacttgacaagtgggtgcgttctagtgcaagaacttgacaattagtattttggtgcatcaacttggctatgcatatgctaggtgagtttttttcacgatgtcaacatgccattacataataatcctacggatattactttataatattgaatataatctttaagaattttttgttatcttcaccttctcaaatatcaaccgaaatataataatttctacatccgatttatttaaaaataaataaatatgcttatacaaatccacgcaagtatattgtcaaaataagtacttaaaaattgaatttatataaaaaaaatgctccaaataattaaaatgtcgcgtaacttaatttattgtatcaaaatcgtaccaaccttgcaagttgttgcatttacacgatcacttataaagtttttatactattgcacttacatttaatgttgttactagaacgcttatttctcaaattaatgcaccaaattacacccatatgccaagttgatgcaccgtgtgtgc

SEQ ID NO: 58443 - DNA, 15049 bp, Oryza sativa
ctttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattgttatcgagaatatattttattggtttactacgtgtccactttctctcaccatgcatgcataaaaatagatcgatctgcaaatctttatctgatatgatcatatgtctataagctacaaagagggtcaatcccggttaggaagggcccaatggagggtccccaaccagctctggattttcagcatggatgacggggactcactagtgccgaagtttagaacaagaactggtatgttcccccaagtccaaaaaaaagggagctgctcaaagcattggcttgatgaattgagcccatgctttgagcggtcccctctgagatcatgctcccctaatccccattatagaagacgaacaacaagaacacaaaatattcacaatcagtatccatcttggtgccagcactgctttgtggccgccactgcggatgtcagacccatcccttgcctcgccgctgcacatcccggcacggacgccatccctcgccttgccattgctgctgccgatggatcccaactacatgtctcaccagtagccacctcagaaatgttgcgtctcctacaatgggcaaacaccatggtcactggtgagcactggaagggcaaaaagaagaggcgttggagtgaggaagaagcatgcatcctaatggcaaaatagtccacaggatggtgaagacgctctgcttaagggtggaattttatccaagcccgttccagtgatggcattttagtgaagctgttttttatgttggtacatatacaaatttctcctgaaatacaaccctcaatcaaaaacaacaaatgtgaaacttagcgtagctagattaccaatccacggcaaagactttagtctagggatgataccctaatcttcgttatcttcaacctcgactcagaatggacgacaaacaacaacaattgggaattgagtacattcgtactcagcgaactactggaatatgtgtaaaatgcaagcttgaaaggaaggttgggtttgtttggcaattcatttattttaaacacttttgaaagttctaagtgtgggttattataaaacataccatctcgattcacccacgagttgcgatccaacaactcaagcaggaaagtcaaattttagttttatgcaacattttcttaaaaggaccttgttttcacttagaggaggggttgaatagtcatttctaaaagttatcacaactttgaagcgcaataataagcaatcggaattttatattcaaatcgaagttgccgatatgaaccggaaagtccgacagctgagagtaaaacaataattatgaaattttagctcaaacaaacaatatgtacatgaatcaaaaggtaacaaacaagatatataagaaagatataaaatcaccaagtagattaattaagcattcaaatatatctaagcacaatatgaacaaggcaataacggacaaaccaagagaggagacacgtgatttatttaccgaagtttggatctaccaatcctacgtctctattgaggggctacaaaggctgggtctctttcaacccattaccttacgtggttacacaaatacactactcgattttactcttgctttcttccaacacagaggtgaaatcgaagcctacacaaccttggatgctcactggcaacgtctagctatctaaaagactttaatatcaaagagtaataaacgcacacaaagctagcttacgaagggaatttgaattcaacatccataagtttttttttcatatcaattacttgagaattgagattttggttcaaaaagattagtttttaattgagatcatggcactagatcctagatacacttaaagaatcaaattattgagcatatgattttcattaaaatagttttaacggttgaacgaaaatcgaggcattgcattacttctggatttatttatgatagtggacacgattgaacgcaaagtacatatgaagaacatttttctaattactagttttgaattttggaattaaatttaataagtgctaaattgaaagtccaagactgctacagcatcatatttattaattttgaatttgtaaacacaacatgcaaagagttcatggtgcatgttttacttaatgcttctcaatacaacatatatgaccacgctaatataagccacgtagccaggtcggccggatacttttggttacgtcaaaactctcttaggataataaattagacagtgtaggtataaattactggtaggtaactttgttgaacaaatactggtgggtaattaatgggctagaccgggatgattaaagagattaatgggcatggtcagcacattatattgtggacatataaatcatattgtctcagcatattggggctgtttatacacatttgttgataaattttctgtcaataatttgacaggtacaaatataatataatcatataacattatatatagtgtatcttgcatttaaatataatgcaagtatatgtaactttaaaaagtcccatggtaacatgctgtttttacaaagtggaggtcaccggatcgaatcacctcacctatgcccgtgctgtatgtttttttcttcctagttgcacaaatcttgaaaaaaattcaatggtttaaaatcatgaaaaaattgtagttacatgattttattataattatatagtatgtttgataaattttaggagaaaatttattgataaatatataacaaaatcgtttcagatttgttcagacttcagaccagtcatgacttgcatgccttatttaaatttccagccagctgatcagcaagtcgcacacgcttggatgcattatatatactcctatttattataactggagggagtatactccctaggacggagaaataatgcatccaaggacggagaaatatatactccctgaagttattaattactccctaggacgaagaaataagctttcttacctgtttggtacagctccaactcctaaatttaactccagaagttgggtctggagtggagttgtggagctgcctaaacccagctctacaactctaattcattttgtgagagaactccactcagcttcactcccaattttggtggagctgaaactgtttggctgagctccagctctaggaggggtggagctagagctggagctgtgccaaacaggcccgtagtgtgcaagtataagtaacagagaataacatccgagacccaagaaactctgaaaaaacaatattatattgatagatccagaaattatgatatcgtgaaaaatgtacaaccgggcatgattgtttgattataattggtgctctgcatgactgcatagctctattcatcgaaataattacggagtaagaatttaacgtgtcatgtctctcgccaacaactactggcaattatcatatctcggtatctcacacatgcatcatgcatgcaactacatatacgaagcgagctcatctataaataccaggcgacaggcgacaccacaagcaaatcatccaaaagcgacgcaagccagagcagcctagaacactgagtcactgagtaccaatagctcactcgatctctcggatataccaatggcttccacggttgtcgctcccatccttgcccttagcctcctcctcttcgccgtcattgtgcgcggctgcacaccaaactgctccggcgagcaggtcgtcccgacgccacccactgcagtgccgacgccattgcaccacggcgggcatggtgagcacgggcgttgcccgatcaacgccctgaagctgagagtgtgcgctaatgtgctcaacaggctggtcgatgtgaagatcgggcatggccccgatgattgctgctcgctgctgtctggaatcgccgatctcgatgccgccgtctgcctctgcactgccgtgaaggccaacgtccttggcattagggtcaaccttcccgtcgatctcagcctaatcctcaacaagtgtggcaagtcctgcccgtctgacttcacctgctgagctgcacatttataatgctcatgagtttattttggtgtgattgttgggtgtcgaggtttgtttgcatgatccctcgtgaataagtctcctttttgtttcagattgatgtgcggttgtatcatccttaaatcactttaatttgattgttgtaagttgatctttttgttgagagaatgcaaatcttcaaaacccattgcattatctatatagatatattgttatgcggaagatattttaatggtttacattttcgctttctctcatccatgagccaaaaaaatagaccaatccatatatctgtatctaagatgatcatgtcctcaaactgtgtcacgcacaccaatatagaccttgcatcagagtttcagggcgttgatctggcttcagggcgttgcccggttatataaaattcgaccggttactgaagctagcccgtagaagaagatggttccgggaataggtgacttgcccggtgtagttagctatgttgtagactgtagaacacatggttgttcctgagtagactaaggttgcgttccgagatggaaattgagaactccaccaacccgcacgcaaaataaagtgatccattagtgtatgattaattaagaattaaccaaaataatcttgaaaatagattaatatggtatttttaaagcaagtttcttatagaacatttttgccaaaaaaaagtatcatttttgcaaaataatatggtatttgcatgaaaaccaaggagtggaggttagaaacgtctgatgccaaacatagactaagagtaggccccatcttacaagaaagcctcaaattaggtcttatgcagccagtccatcagttctgcgcacccacgagaagaccaccaagtcaccatccccgagcagccctatgccacaacctaagttttctggtgtctcggcttcatcatgattacgtaagtacatacaatgaaagggtacacacgcgagattacaagtcaaccttttccggagagggatgcactgacgcagtgaatgtgtaggcaaatttgttgcaggacatgtaaaaagcatataattagctgagggacaccgtaagaccacacatctgccgtagggcaccacaaaaaactcataattagctgctggtctctcatgacattattttattattttcagagaaaatagagagaaacatagattaaagagaagtttgcacatggctcaactaaatgtatgtgaagcacggatacgtcacaaacctcacgtatcagtatcagatacgtacttcgataaagacacatattagatacactccgatacatatccctttttttcataatttcaaaataatacaaaaaaatcgtcatcgggacgtagattcctagcaccaccgccagacacaatgcctcaggttcgttgtcgtcgcgaaccgtcagtgccgtcggacatggcgaccccatctctgacggacacggcacgccagtatctgcacctccataggacacagcatcgccgccaccgccgccagacgaaatggctctaggcccgcggtcgtcgggaaccgtcggcgccattgccgaacatggcgactccatttccaacagatgcagcacgccggtatctcgacctccacggggcgcaacaacgccgccgctggacattgcaacaactccatcttcgccatgctggctgtcggtcgatctccgtcaccggagccttgccggcaaaaccctcgcgccaccagctttgcctcgtcgaggtgactctattcccctagtttcctctttcctttagccaccatatcaagctgccaccgtcacctcccttgccagctagagctgaggttttcccttcgttgttctggcctcctctcaaagtccctctacttgccaccactttcctcggatgcaaagaaaaaatgaacacgttcaatcgctgacgttgccgtctcctgatcatcggagcaccagcgccctcctcttgtttcatggaagaagaaaaaagaatgagtagagaaggagagagaataggaaaaaaatattccctgacaggtggatcctagcatgggagtgaggctcgattgggttcatggggtaaaactatactttcatagttgtttctttctccaattcctctgaatataataaaatagtcccatgggtgtctaacagctaattaccacctttttacagtatactatagcataaacgcgtttttgcggtgtccctagttaattacacttttttggatgtcctgtaacaaattttgcggactatatatatagagggatgttatgccttcgcaacgatacaaactgattaagtagaataccttgactaggatgctgatattattttttaggtgatattataatgtaatttctattcatagaaaagcatgggtactcagctagcttgctagtatcgtgtaaattgtacaactggacatgattgtttgattggtgctgtgcatgactgcatagctctattcatcgaaattaagaattcaacttgcatatctctcgccaactactggcccatgcttgcatgcaaatccatccatgaaaaccaagcaattatcacccatgcatcatgcacgcaactatctataccaagcaagcgtactatagttcagctataaatagcagatgacaccccaagcaaaaatcaacccaaagcgacacgagctagatagcagccaagaacacttattcactgagtaacactagctcattcgatcccagacaccaatggcttccaaggtcatcgctcccttccttgcccttagcctcctcctcttcgccgtcattgtgcagggttgcacacccaactgctccggcgagcaggtcgtcccgactccacccattgcagtcccgacgccatcacaccatggtgggcacggtgagcacggccgttgcccgatcaacaccttgaagctgagagtgtgcgccaacgtgctaaacgggctggtcgatgcgaagatcggacatggcaccgacgattgctgctcgctgctatctgggatcgccgatctcgacgctgccgtctgcctctgcacggccgttaaagcgaatgtgcttggcattagggtgaacctccccgtcgatctcagcatcatgctcaacaagtgcggcaagacctgcccgtccgatttcacttgctgagctgagctgcatgattataatgttctggagtttaatttcgtgtgatttttggttgtcgattgagcctttttttcatgattccgcgtgaataagtcttgtttcttttggcaaattgatgtgcggatctatcatccattaaattactttaattcaattgttgtaagttgatttttttttgagattgtaatatgtaaaacccattatatatattgttatctggagataattgtggcttatatgtttgctatgtcacccacgaaagcatgaaaatagatctgtatttgatatgatgatgtcctcaaattgtgtcacgtataccaatatggaccttgcacctaagcaatggcgacgctgaaattcttgaaatgtaatatgaccgattgaatttagtcaaaatggcccacagtacatgggccaaactatgtactctcgtttaggccaaactatgcaatcccgttggttggattgccattccagcccagcgtgaaggggttactaaaacttagccctgagaataagatggtccacactgcattgcaaccactagatctactataagatcatcctttcctttataaccaaacaaacaacaaggcacataatcataagattatattatattgtatacaccgactaatttatcggtgtattttagaaattcagatccgaaattgcaaactctgctccaatgtgttctgcagtgtgattcaattatctagataattaattagcggaatgaatgtacatttgtaggctagttatttcaagcatttaaattttgtcttcaaatatattctatttagaatattaagaggtatttgcagtgataaaatgtacaagatatctccccatgtcgacaaccccacccaggtgtcagcaagaggataatgaaaggtaatctagattttcccctcccctgaattttcatgaaagaaattactgaagtatttatatatcttggaacagagggagcatgcatgtacttaattttctttatctaatgttatatgatgtgtgtcaactcaactatggtagttaataaatatagaaaaatacatgccggtccttaaacttgagaggtggtgtcacttaggtccgtaaacttaaaaattgcatatttaggtccacgatcttggtttaatgtattacagcaggtccaaacgacatttgactgtgtctgactgctaaggtcattcccaacccaataactaggatggtgtccatagcattaaataagttgccacctaggacaaaaaatgatgttgcaagtgaataaatgaggaaagagaaggaaaccatgtcttgcatgagacatggtttctacacaacatccaagacatagcattaaattgaagtatggaatagtggtgtttgtattggaagagtagtgtttagtactagtttcttgatgatgtggagtttatggaaatcatgtctagtgttatgagttgggactgtcctaacgtggcgcttcatgtagacaccaaatttacatccggccccctccacaacacagagtggcagtaaacttacacttagacccttcgaagtacatcgttgtaatataagcaagcggatggcctcatggtgaagacgaataactgatggagctggccggcgcgattgtctaacacaacaagcggcttggaatggtggaggttcgcttcctcctccgcctcatctccggcgtaggcctcggctgctggacctacgagctgcggagcttcgtcgacggtcacgaagagctcgctgcacagcgggacgcggtcgatgagatggacgctttctacgacagcgccatccgggagctcctcggtaggactgggttctaccccattgccaacgtgctcatcatcaacattatcagctagcttcttcctggagccatgcctctcgtccatgttgggaatagtcccacatccctaatctagagggagttgaaccaacttaaaagtagagggagctcctcacctcttgagctagcttttaggatgtagcaaggctttctcccggttgggccaacgtcttccggtttggggctaacaagtggtatcagggccaatccaacaatctctagtgcttgtgcacactcaaggcggtgtaagcccaaagcccagtggaccgcgggtgtgaggcccgtatgtgcccgtgtgtggggctggtcagtggaccgcgggtgtgaggcctgtatgtgcctgtgtgttggaccggtcagggctaaggggtaccaatgttgtgacgggggagattgttgggaatagtcccacatcccgggtgtgaggcctgtatgtgcctgtgtgttggaccggtcagggctaaggggtaccaatgttgtgacgggggagattgttgggaatagtcccacatccctaatctagggggagttgaaccaactttatgttgtgacgggggagattgttgggaatagtcctacatctctaatctagggggagttgaaccaacttaaaggtggggggagcccctcacctcttgagctaacttttggggtgtagcaaggctttctccccgttgagccaacccccacctcttgagctaacttttggggtgtagcaaggctttctccctgttgagccaacgttttccggttttgggctaacactccaggactgtgtgaggtggtaccgcatgcgcgaggacgtcacggcgtcaaacctctccgggatggggttgcagcgccaggctggtcccgttggacatcgcccaaaggccaaaatgccatgtgtgcgcggttgctgcgaccggtggtagcgctcgtagtctcgacggagtcactggcgccgcactagcacgccggcaaggagaggactatgatgttgttgcagtgcctattccgatgcggcagcacggccgtgctgctcagcagcgacgatcaccgttgtcgcgccaagatggaactccgtcgcctggtgcgcgccaccaccgcggcactggcaagcgacgatgcttactcctgcatctgcagcaagaggatgacgacggactcctcggtgccagcatcaacaaggccctctccaagaccgcccttcgcgcattcgctgccaacctgcagcgtcttctgcacttgcatacacatgttgaatggcctaagtgaaagtttaccactattttgtgttgcggagggggtggatgtaaatttggtgtctacgtggagtgccacgttggcggtcagatacagtcaaatgtcatttggacctgttgtgatacattaaaccaagatcgtggacataaatatgtaatttttcaagtttatttacctaagtgacattagctctcaagtttaaggaccgaccatatactttactctaactagcatggtggcccgcgcagattgtgcggctagtatcattatattttctatcatataatagcatatatgttcttattatattattcaaatatattaaaatgacaacataattttaaattttgcaataactttacaaaactactaatgtgtaatattcatattgtattttatatacgtgttagttattaattatttttaatatcaaattttagttatttgtaaattatatatattcctatatggactgtagactcgtcttttaatatttctttttttttaatttcgaattttctataaattgtatttctatatagactctatactcttcttccaacattatttatttttatttctgaatttttattatttctaattgtatttctatgtgaactctaaactcatatttcaatattctttaatttttaatttcgaatttcctatattgactttaaattcttcttcccatgtttttcttaatttcaaattttagttatttgtaaattgtatttttatacgggctctaaactctaattttaattttattatatttatttcaaattttagttagttttaaattcctatatggactttatactctacttctaatgttccttatttttaattctgaatttcagttatttcctaattgtatttctatatggactctatactctacttctaattctaatgttccttatttttaattctgaatttcagttatttcctaattgtatttctatatggactctatactctacttctaatgttccttatttttaattctgaattttagttatttcctaattgtatttatatatggactccatactctgcttctaatattccttatttttattttcaaatttcagttatttcctaattgtatttttatatggactccatgctcctcttctaatattccctattatttaattccgaatttcagttatttctaaattgtatttccatatgaactctgcattttctttttctccgattaatgtgagaatttctaggccatgagagcgaacgtggaggctcactctaaacttatctttcaatattatttatttttaatttcgaatttcagttacttctaaattgtattcctatattgactttaaactcttttaataatataatagctacttctagtattccttacttttaattccgaatttctattattttctaattttatttctatatggactctatactctacttctaataatccttatttttaattccaaatttcagctatttcctaattgtatttctatatgtactctatactctacttctaatattccttatttttaattccgaatttcagctatttcctaattgtatttctatatggagtctatcctctacttctaatattccttatttttaattccgaatttcagctatttcctaattatatttctatatgtactcttgtctcgtcttctaatattccttattttttaatttcgaatttcagttatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacataaaggctcctttttctattcgtttaataatataatagataaatataaggtgcttgatctacgacttagctgaatttaattactttgggccaatcaattaagctttttttttccaagaattgaattaacttcgggaaggaagaggttaggaacttctcccagcacatgtcaaacggggtgactaattatgtattaattaactaaaataaattttaaaactagattaatataattttttaaaacaactttatttgctatcgaaatgttttgaaaaaaacacatcgtgcttacgaacatatataccaaccggaataaacatatatacatagacagcaaagaaaaccgaactctttgttgaaaaagacaataatagtcgatcgatggagcgattgatattgcgtaaaatgaactaccggacttgattgttggcttgctgctctgcacgtacgaatgcatggcggctaaaattaattaatcaatttagcaactagctatatatgtgcctatgtcctccatggaaaaatcgtatcgtacttgtcgcaagcaactagcccattccgcagcaaatccaaatcttccatccggggacaaaccagtgcgtgcagatacatcgtgcatgcatgcaactagcagccactaacacaaacctgtctatttgtaacggctcaagtatcatctgtaacagctcgcccatccgtaacaaacaaaagatacggatgaagaaaccatcttttatcccgattaacaaaagatcacgggtgaagaaaccatcttttatcccgatttgtaacctcatatagttccaggatgcaaaccgggatcaagcatccggaactaaagatgacgatctttaatcccagttaaaatacactggtggagaaactatttgtagtcccggttcgtaaccccctttaatcccagttgtccaatcgggactacgaatccgggactaaatatagctatctttagtcccgagtaaaataaccaggactaaagatcggtgtaccattttttttatttgcatggcgctgttttctgcatggtatatatatctatatgtatatacatatatatatctacatgtatgtatatatatgtatgtatatacatatatatatatatgtatgtgtatatatatatatatatatatgtgcatatgtgtatatgtataaatacatatattacacacatatgtataatttaaagtacttaacattttatgtgcatatatgttaccaaaatatatattaacactaaagtaaatgtgtacatatataaatatatatatacatgcatatatagtacaattcatttgcttgctagctatagctacgatttcgacgccggtgttatgtcagaagaggaaggaccgacgttatggattgtcgatccgtcatagtagaattcaccatcaggattgaggacttcttcgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcaagctctcgtgtggtgcatatttggtttgataggtagtgggcatactcgcatacgttgtagccgcataagtaagttccctggtcctgctttgcacactacatgagaaacgatgagagatttaatatactctttatattaactgtaattagagattcaatataatataattttgtatcatgcatgtactcactggaaaatgaaacctccgtccaattttttctttccaagtcccgcggaccaattgacggaaccgatcccaagccctacatatgcagttgtaagctatgattaattaattattacccgagatcaacataatagcaatagaatccccgcgactttggaatagatggcattatattacctgtctatcagttggaagaccttgtcaaaaatcttctcctctttattcattgagtcgtacacagtgactctgcatgcgtgagatgagatatatatgaaaatatacatgctatatgtatgggaacgaaatttgttcgaacgacaataaatactcactctgctgcgttaggagatggatgagattgtcctctgtgtctttctcgtacttgtcgatcatttcggtgttgattttccgagggtcgatgaacccagtatcgtaaaacccccgccatcgggccctgtgaatctccattctacaatgataaaatgaaattattattgtttacatatatgcaaggagctagttattgtacgaaacaaatcgaactcaaagatacttacaaaatccatgcgctcagaagagagacgtcaagggcgtccagatggtacagatcgaagacatccttgaaatggatccagagaacatcttctccttgcaagaagtcggggtttctgatcctcgctccgaacatctctttacccttggcgttcatttccatgtaccattcatggaatttgtacatctgtgtcgggggactgcagctgctcaggcgtgacaagcggtttaccgagttcaaacttgtatgccacttccgccttcgggattggtgcgattcccaatcagctgatccatagttagaccggtgtctgaaatgaaat

SEQ ID NO: 58444 - DNA, 49005 bp, Oryza sativa
cactccgattccgcgcgggcctaccactacgctcgcccgtgacccacccatcgccgctccgtatacctgccaccggcctccctcacttaagaagagaatagacaagagagaaaagaaaagacaagaagaagaaaagagaaggaaaaaaaaagtgcaactgacatgtgggccccacgtattttttttaaaagttttgctgactaggatgccacatcaacaaatccacccatatatactgccataggaccttgagtgcacggtttgtgtgagttcagaggtatacatttctgattttgtggttaagggacctcaaaaaatatggctgttaagttgagggacctctggtgaacttattccggacatatatgtccagatccatagtactataatatgtcacatcccgtactagtttgctatattttgtgatggatgatgtatttgagagatagatcatatcggccgatgatgtatgaacgccgatgggcaccatagtcccttttatggacgaagctagtagctgatactctccttttagattatttatcattctaggattggacttaagtcaagtatttccacgcctatatataacgtgtttatatgactaggtcccaccctaactcagctggattgactgcagtcaactcgccacctgagctgaaaccaggcacaatactatcctggatctcgggtacttcgctattgtaaattgatgaacacgttatattagtattacagttcaaaaattaaagtacgcgattcaaacacgacatcaaggcaagaaatctaaagtaaccttatttcataacaaaatttggcccaattactcgcttggggcaataagctagaccaacaaactaggaagaagaaaatcagacaacagtattgcaaacagcttccaccacctcttatgctgtagcatgcttgtaaagtaaagacaaatctagggttgatccagccttcatgctctattaggatacaaatctacatgctccgctaagatatgttggttactttcatgtccgatcgcttaaacgttgtttttttttaccaaggcgccgaaggagcttcagaaaacatactaaatacaatgcaatcagagacctcatttgtgccaatcaaacaatacaagtgaactcttcatctaaataaatccttatccataaccaaaaatcatcttctttcatgatccaaagaagatgggcttaccaaggtagtgaagtattcatcatcctcgactaactcaaaaccttctcatagtgtgtaaatgaattccctaacgtagaaaaatctcccaaataacatgtcacaaaggtatggtaggtgtggcttaacaagggttaattagatttatgccattacaaatttcacgattaaaatataccatcactattcacatatttgtaaccatgcaatcacaatttcacagttatttgatacataccactacttaccctttcatcttatttttcaaaagttttagaccaaaatgcccatgtcttcttccttcatcccctcctctctctcctgttcatctcatctgttcagatctagcctagccttaaccgatgcgcatccttgccggcggcggagatagtttgggcggcgccctcaccgacgttaaggaccaccacagcaacgagcgccttcaacgcatgttctagcaggagttcgacacgcatgttgtggaagaatatacgctcttttgtttttttcatttttattcataacgttcttggttttcttcatcatcaattgagaaggttacgcaaaaaaaaaagagatacaaaattcatgtgtgcgcacgtgatgaataatttatgctatgtcattgttacatgcatgtttcggtaaaacatacaacaaataaattctcttttatttgaaagaactagtcggtcgggatattatttcagcttaagaaacacaacgttgtccctcaaattgtcgcacaagcaggatgaccgttgcttgtgctatctcggggtcagatctgagacaaggaagaatatgaacaggagagagaggagaaaaggtgatgagggaagaagaagggcaatttgatccaaaaattaaaaaaaaaatagatgaaagggtaagtagtggcatgtatcaactaactatgaaattgtgatggcatggatataaatatgtaaatagtaatggtatatttcaaaaccatgaaagttgcaatggcacgggtttaaatattacattcactagttgtaagttaagcatggaacagtcacatgtctcagcatctgccactaagaaagtttgtctcaacatctgccactatgaaagttcgttgttaaggacagtccatctataaactttaatttttcgaatttatgtatctaaacatttacaattcttcttattcttaatccatacatacggcagggtatgacctatacgaacaataagacgaccaatcaagaaaaccatagttaaaaactaattttttaacttttaatttgttgggttggacgacaagttcggttatataatgctgaattataaaattaaaattctaccattgaacattctaataggaaatgatgacaatgtcattaataaaagtgagcaaattcaatcatttttatatttgcttttcaatgagatatatcctaaatggcaatatcctaacattgcggagttcatcactctgatgcgcaagacacaacgtaagctcaaatgttatatatatttaataaatcacttttaaaatttaagaatgagagcctatgcatcgttggaaattctaccattaaacattcaaaggaaatgatgacaaggttgttcatagtagtgagcaaatgtaattatttttatatttgcttttcaatgagatgtatcctaaatggcaagatcctaaccttgcggagtttatcactctaatgcgcaagatataacataagttcaaatgttatatatatttaataaataactttttaatatttgagaatgagaccctatccgtcattgaaaggggtggtggcagtgaatgtctttcttttgaagtggtaaaagtttacatatacatatatcaatagctaaacgttttatatgtattgcaggattgatcagttgctttcatttctcttatcgcctctaaatatatatcttatagaaaattataactcaaacatatagaaaaggcatctaaaggatattattttttctagataatatagttcattgcatgttgcgtttttttgttacaactatataggatatatagttctagttgatgcggcttaatatatgttgagttttatagtaatgactatattaagtgcgttataaatgcaaatgacatatcaatgattatgatcaaaacataagaaagatctaaatattattattttctatattatgactcactgcatattgagctttcgattataactatataaataggatatatcgataatactcacaatagcacatcatatcttcaaagcaggttgtggagaacaatcctatttatatttctataaaagtgtacggatgtgtgccaagtggaaaatatccaaatcccccctcccccctccttaaaaaatctactttagagtttttaatgctcatgagttatatccctatttagatacttttttatcctggtaaagggatttcttctaggacctctttaaggaatacctaccttttttccttcaccatgtctagaatcatcctagagaaataatattgacaattcaacatatctctgaacctttcctcttgcttgccttactttgagactttgagtagtctgcatgctctggactattgaatagatcaatgtggaaagtggcgagacggggaagcggcggcggtgtggatacggggtcctgcggcggcggtgaggtggggaggtggcggcgaggtggatctggcgtcccacgcggagctgccatcgcgtggcagcctctgcaccagcgcagcagctgaggacagccagtggcggccatgagcagaggtggaccctcgtcgtcgtctgctcgtggtgtatggctcatggcagcaggtttgaggaggacggttggccatctcctttgatgctggccaggcaaccccctctctgtggacatccttccctcctcagtggggagctccataggtggatggaggtagtggcttgacgacatgggatggcttaggtcaccgaagcggcgtggcccaactccgggctctccttggccggattcgacaaggaggctggtgggtagcagagtggaggagacctaagacaacacatagggaagttggtggcggggtagagaatgctggcggcgggcagggacgtctcccttgatgtcggtcgggtgtcgtctcgacttgtggagcatctcccgttctctatgggatgttctataggtaggtgggggtaacggtatgtcaataggggaaggcttgggctgccgaagctacatcgtccattaccgggctttttgccggattcggagctgaggtcggtggatggcagagcgaaggaagctagctcagcgttgcgggggagtgacaactggtaaaaggcgctggcggtgaggcgaagtggccagtcttgatgtcggtcggcggtgaggagccggaccggtacggcggaggacacacgctaccgaataccaatgttgggctggtggtattagatctggcaggcgacagaccacagaaacggggtgaagaggatcccaggcgaaagcctagcctagcgcttgattgggctggcagtagctacgcctttggacgcggtaaccctcttgagggtgttgccgaggtaccctccttcctcgacgggggtctctaggtgaaaaccgtgtccaatttctttggacggatgatgactgcgtcttttggcatcgcaaccttcatgggggcgttgtttttttggactatcattctatggtgttgctgtaagcctggcggcgaccggcatgcatagcggtggtcggtccgtcgttcggccctcctctctatagcttgtgtttgtgcggttggcgtgtggtgtcggggcgtgtgctttggtgcactttctttctcgagagctagctgttgatgaaaaactttgttgagactttttttcttctatctttataacatttggatgacttccttcactcaccccgacaaaaaaaacatggatatgtatatcctatagaatttctggcttcaggttttttttaacgaatttcaggcttcagccgtgctccaagtcatcgtatgaagtatgaaacttcagccatcatttaacagttaacatttttgtgccaaatattaactatatctctatctctactattataaaaattaaagatgtttttgccataattttgatacgttatctgtatttgaatcggttttaattttgtgtttcgactttaatctatatatagaaaaaaaataagtccgactcaaaaaaggttaaaaaaaagaaaggaaaaacgtccaaattaacgagcgataaaaaaaagcttccatctatctattatattatattattaaaacagccttgaaaggaggcaccacgttcgctgtgggggctagaaattcccacattaatcgaagaaaaagagaaaaatctacaccgttagatcgtagtggatctaaattataacggtatagattgatagctatatatatgtagtacaattgtagtttttaaattataataagttgtggatgaaatatagcaatctactactcatatttggaatcaggcatattagaatcggctttttttctttgatgaaaccgttaaggagtaggattaggattgcagccgcacgaattttttcttttctttaatgaaaccgttacggggtagaattgcagctgcccaggagccaagtgccgaccggcccttcatactctgtctggctgcacggctcttgtgcttagaattctagatttactgtgaaaagcataggctcatggtaaactgacacacgaaccccatatgagattaattaattttcagaaaaaaataaaatctgaaattagcaaaaaaaggaaaagaagagtttgagtagaaatacaatttaaaaataactaaaattcgaaattaaaattatgcaatattggaagaagagtctatataaaaacccaatacgaaaatattaaaattcagaataaaacaatagaaattataaaaaaaagaaaagaagagttcaagtaggaatacaatttaaaattaactgaaattcggaattaaatataagcaatattgaaataagagtacatataagaacccaataatactaattaagattcggaatgaaaaatagaataaaatccaaaattggacaaattaaaaagagagttcaagcaggaatacaatacgatattagttaaatttcgaaataaaaaataaaataaactctgaaattataaaaattaaaataagatttaaactaggatacaatttataaataattaaaattggtgataaaaaaataaagaccatctaaaacacatgacgggattaattgagtaacaggcctataaaatagtagagcggtggcggttgatgggatatctaaaatctattaataaaacactaaatagaatgataacgggcatgtcatgaagcaaccggtacaggcggttggtgggacttcggaaagtaaaaaaaaacaatgataaccatatttgatttttaaaatctcaatgataataaaaaggagaggcggcgggagggtcgtacaggagtacaatggcagagcggacgatggttggtgggacttctagaaagtaaaaaaatgaattccaacgataattatgttcgatttttagaatcccaatggtaataaagagtaggcagcggacgggtcgtagaggagtatagtggcagcgtttgacgagatttctaaaaattataaaaaatggaatccaacgagacaataaattataaaaactataaggtccaaatttaaaaggttcgggcttctgaaaagtaaaaaaaataatgataaaatctcagtgagagtaaagaagggaggcagcgggcgagccgtattggagtacagtgacaaagtcgctgacgttttggtggaacttccaaaaagtaaaaaaaaagaacctaaacgataattatgtttgatttttaaaataccaatgacaataaagagaagaggtagtggatgggccgtagaggagtataatggcaacgtttgatgggacttttacaaattataaaaacgaaacccggcgggacaataaactctaaaaactatatgatccaatttttaaatgttccaagaagaattaatagaaacagtggtagatcgaggaagcaaataaagaaagatatgacataattaaggggtatcaactggcgtgtgacttttaaaaactataaaattaaaaacacaatgatgataaggtttggtccaacgagataattatttaataaattttaagtaaaattatattaaaaatatataattttgtatgggtgctagccgcgcaattgcgcgggtcacccagctagttgtcagtaaaaaaaagaaaaaaacatctcgtcgtaaaaaaaatagtccgactccagtagagaaagggaaaaaaatctcccagtaaaataaacaaaaaaaagtcggtttggtttttttgcaccggtattttttccccttttttctttgcacgcaaaagagttttttatgcgcacacggtaagtcttttggttttttgtccggctttttttaatccgatctgttcatcgcgtgcctctcgggcacttttggttttttttcgtcaatcttttttgtcgctggttttttctcctgtgcactttttgtttttctcatccggttttttaatcccatctgtttgccgcacgcctccctaggtgaaccctagcgccgcgccgccgccatatcgatcatgcattttctcctccaatttgattacaaaatcgattccccactcctctctcatcatttctccatgattttccctttgattcagtgccagatttaatctctgttttaccgttgccgatgatgacggcaatcttccccggtcatttttatcccgagttttacgctctgatcttggggaagacagaaagagtagatcgagtggatcaaaaaccctcgaccaatttgactggtcgagaaagattctgccagatttgatggggatatttgctctggctaccgtacgggcacgggattatcttcgggaggttgaagatggtaatcatcttcccagacacgggactatctttgggaggttgaagatggtaatcatatttgggaggtgaaagatggtagtcatattcgggatgttgaagatggtagtcggctgtgtgagttgggtttacggctctacttatggctgggtcgaagagaagcagaccaaatggagagaggtagcggactagcctagggctgaaaaggaaggaaggctttcggacgaaaatccaggaaatattttcattaacttttttaattataatctacagcgatcccaatattaagatttttattaactttttcaattatagtgtatgttgatcataatatttcaatttattgctcagctcttaatatatcactgaaaaaacgtctttacccattgcaacgcacgggtattttttttattttttctagtcaattattatgtctactactcttggtaaataatccctatctaccttctattgtgttgctaagccacctataacattttggttgctaaacaacttctactacgggaggtttgggcctaggcccgttttccctttttttggtgggggcacttctttttcttgacaggcaatgtggaccttatggaccaaatgggtgttgcgttttttttaaaaaaaaaaacttgctttctaattcatcccaaattcatatgcataaaagcttcaaacaaatatatagttcatgggtaattttatcatctttgagaaagtactgaaaggtatcacattttctaatgtaaaatttggtacatctagatacaaaatatcttgatgcaccaaaaattttaatataaaatttaggtacctcgaggtatttttctcaagtactataaaattgctatgtttctatatcaatttttttatacggtaagtttctaggtagatagttcacgtagaaagtttctatgcctaggtgggtttgtctttcttttcttttattgaacttgccttttgaacttattttaaattaacgttcataaaattctctactgcggatatttctatgtagaaacttttgagtcaataagaaggaacacatcccgaagtggaaaaaaggaccttaaggccctggtcgattaatcccaaaggaaaagggatgagagaggatttattccacatatattatgatgtggaattattctcatttaatctcctccaaacaagatctagggactaaactttaattcatgtcacatcagatgtttgaacattaatttagactattaaacatagactatttacaaaactaattgcataaataagagcttatctacgaaacaaattttttaagcctaattaatccataataagggaatgcctactggcatcacatagactaatcatggattaattagattcaatatattcgtctcgtgaattagtccaaggttatggaataggttttgtcattattctacgtttaatatttctaattagtgtccaaacatccgatgtgacaggaaaaaaaaaatttttagccccatcaaaactcgcccaagagaaaacgaacgtggactcgatgcacgtgtggagtgaacctgtcggaatgcgtttttgcgtggactgaaaacgcacccacgctcacccgcaccattagacgcgcacccccaacaattcacatcatggctcgcttgtccatgcccatacacgttgaaagccaccagctcgtccaccgtggcaatatcctctaaaattgctcaacgtgaacttgccacaggtgaggtgagcatgcgcgcgccacggccgcggcggtggccggccgacggcgacacgttgtgctagatgaggtggtgcatgacatccacggcttcaacagttcaacttccggagttgaactgtgcaaaaaatccgactcaggaatgcaggattgtccaagcacacacaaacaatctccaaaaatccaaatgaatcggtcgcatttcaactaattaaggctgcgtctagttggatccaaagtttggattttgattaaaattggagatgacgtgactgaaaagttatgtgtgtatggcaggttgatgtgatggaaaatgactgaagtttagatccaaacacagcctaaactgttttgacttgaattttcgacgagtgtcctgcatgcacatgcgtgaacacctcagttggagttgggtcactccgattgaaccagcaattggggccaagtggccaacgttgattgcatcagtgggcacacgatgacttcgttgcttctactgtgcagcgagtgatatatatgcgcgtgatatatatgcgcgcgtgcggctgacttccttgcttctactgtgcagcgagtgaattagagcagctagaatagtagactatataagagcaggtacaatagcaggctataagccagctgcaaacatattttaagtagataaatgatgagagagaagggcagctggctacagatttgtagccagctgcagcacggattccaagacgcagtgtgtatgacaggtgggaccaactattaatagtgtagtatgtaactattgtatgaatgagctattagattggctacagataaattggagctagtagttggctatactattgaacttgctctaagccaactataaacacatatcgaggagagatgaaagaaaagaagaaaaacagcagctataagcacggactacaagaaataatgtgtgtatgacaggtgagaccatgtattaatagtgtagtatacgtttatggataactattgtacagattgctaattaagtcgactatagttgatttgaagctagtaattggctatactattaaacttgctcttaagctgcagctgagctttgtcactgtcgcgcatcttagccgcacgccggaattccaaacgagttgcagccacgcgcgtgcgacaatacattgcgatctcgtcgtcgccattgtcgatcgatcagccagagaggtggccgatagttggctgtgaaacagtgaaagttgcagcaattctggaagctagctgctgcagagagtcaatcggagagaagacgacagaatagtcgacggttgagaagaacgttcagaaaagttgcttccatctatcttttcctgcgaagaaatgaaaatctgatgtggaaattagttagcagctataatatcgtcacgtgcacatgagtggccagagtccatcgtttgtcctatatgaagtcaaccgttgtcaaattttgaatttcaaattttatttcgaagttaattaacttggtgtcctttttaccgttggtttttaatcactggaaatatatactccctccatttttgtaaagaaaatcattttggacagcgacacgatctccaaaatgcaactttgactccttctttctataaaaatattattgaaaagtgatatatgtatacttttatgaaaatatttttcaatacaaatctattcatataatttttacattttcaaactcaacaacttaagagttattcataatttatattcccaatgtttgacttaaacactgtcctaaacaatttcctttacgagtacggagggagtatattgtaaaagttttaactacaatttttttattgctaataaattgtttttgtttataatctcatcttatagccaacaaatgaggcccgaggatataagctgtcagctgtcatcacgatcttttctcttatatatgttgttaactgccgataagattgactcgtcacaccatggtgcatggtgatctacaggaaagaagttatcagggaaaacttgattgtcattttgtcagagttccagtcaaactcaaagctacgagcattctgccatttcgagtcttggaaaggcacaggttagtgtatctactcgcattttggaaagtggcaagaaaaatatttcaaagatctagaagagagttactccgtaccttcaaaagatgatctagaaacgagccagtgatcagtgttggaagaaagaaaaatgacatactataataatcttataattgaaaaagaaactcgaatgatgttcaatactaataaactaatgatatttttaatcaataaaacaacgaaatactattaacattattcactttaaaaaataatcaaaaacaaattccatccggttattgttttaccgatagtacgtgtgaacattttgttttctttttagaaaatagattaaaccggcctctattcaaaatagatatacacaacgaacgtgcgaacaatttagcgaatattcagtagtccttcagagagaattgtcagaggtacgaactgcttaatggtgatcgaatcgacaaataatggattaaagacaatcaataaagcgcgccattccctaaaaaagaaaagacgagaactagcatgtaagagcatgcccaacagctacccaagaaccctccagcgcgcgtgagacaaaaaccagatgattgggaatgaaatatcgcttcttggaagtggggatcgatatatacggagaagggaacgagatattttgggagcagtcatagtgaatctgttggattcaatttttgaccaaaaatcctaaaatttcaggatagggaatgaaaaagggaagctattggtaatgctctaagtacgttcaaatcagctatattaattcatatgatgtacaagggatatatactcaccaataacattttccacacgatatgtagtctagttaattattattaactctgtctcaaaatataagagatttggtccgtataattagttaagagatgaggttgtattttacagatagtacgcgtgaacattttgggagaaaatgttattattctaccgagagtacgtgtgaacattttttgggacaatttagtttcagagagaattttcataggtacgagttgtttgatggtgattgactcgatgaataatcgattaaagacaagaactagcagataagtacgtagcacaaatcagcgtacgcataaggtgttgtttcttatacacttgcacagctcgaatataaacgattaaatccatacatcttagcactctaattaattgctgatacgatgttccaaaaaagaaaaagaaattgcagatatgattatgtgtagctttcgtcgttgaataatcaacacaaactagtccaaaggcaatcttacgtacgtcacaggggttcatggtcagtggtcagagaagactatgtagctttgactaatttactccaattatgctgctccttgttctctgttctcactttgcttacatcggcaaaatgctaacccacacgtaattaacaatttaacatgcttgctgtgtcaatcaaaattttactacttgtgaaagccgtacaattagtgtgtcattctcctgtatatattatggccattgatgggttaggttagaacagaaatagattatatacaaattaaacactgcatttgtgtttgttttccaggtaaccattaattttctagaaattaacgttgtaaaatttatgtttttaatcagccatgagaaatactttcatagcatccatatattgtgaaaaaatatgaatttatagatactgacagtcaaaattaaaaatgtttgacgaaatacaaaactaaaattacaagcaatttataaagcggagagtcctttttctttctataatagtatcaaatcttacagtataaaatgtagttttcacggatttatgtattcctacctaaaaacatgaatgagatgaggattattggtgaggagcagtcaatgcaccaaatcagccgccacatagttaagtattaccactaccagttgtagtgctatatgtagctttccagttgcctgattttactggagaactaaaatatttttagaggcagtcttggactccgacaggatgcttaatcatcgagatcaagacatgatggaccggtacacaatgttagaactaattaatcatgcatttcgtgttaaattagtgcacatgggtcgatcaggatcagtattagccgccgtagattagtacactctttacctaccgtcttggaagtatgtccctgctactccctcttggaagtacgtttttatgtcaatataaaaataacaacattcatactaccaaaatattttcagtgtcagttttaatgaaatgatttggtattgtagatattaccaaatttttctataaatttaatcaaacttaagaattttttactatgagaaaacatcaaatcgtcaagcgagtagaagactattagctgagtggacaggggaatcgaacctctggtatgtccgacatcccggatagaacaaaaaagactattagctcatttctgatactaagcactaatttatttccattttccttttctttttgttggtttatggtattccggttggatttggatcagattcttcatctagaaacagcagtgttgagagatttgacttggagagtcttggtcaaacttagtgcgttgcaaagtcttcatcctccctaccaatccaaggatggctgcacatctggactttcaaagcatttccgtacacacacataatgcaagatcccgatccacctaatgtaagaggacagtacgtaagaggatccggttccgttacaaacagggcgtgaattcaaccgagaattatcactgctataatcgattacattatggatctgtttagttggtgaaataaaaatattttagtgtcacattggatgtttgaccggatgttggaaggagttttcgaacacgaatgaaaaaactaatttcataactcgcctggaaaccgtgaaacgaatattttgagcataattaagccgtcattagcatatgtaggttactgtagcacttatggctaatcatggactaattaggctcaaaagattcgtctcgtgatttacatgcaaactgtacaattagtttttctttttatctatatttaatgctccatgcatgtgtcaaaagattcaatgtgatgtttttatgaaaagtttttagggaactaatcaaggcctatatttacaaattactacctccgtcccaaaataagtgtagccgtggatatccgtgcccaacgtttgatcgtccgtcttatttaaaaattttttgaaaaatttgaaaatatttagtcacacataaagtattattcatgttttatcatctaatagcaataaaaatactaatcataaaaaatttttaaataaaacaaatggtcaaacgttaaacgtgaatattataaaactgcacttattttgagacggagggagtacatgtcctgatggcaggatggcaacatatggacgacgagcaacatcacgtatcagcgtcgcgtgtcaccgcgggcagagcatatatgcttgtgatgcccatcgacggatgattgacagactcatcaagatggacacagaaaccagaaaaagaaaaattccccccgaatcgcctgaattttacaggaaaacagttcgtttcctttttaaaaatcgtgaaaaaggaatactagtgaaaaaggagaactgcatatggcgcacacaacacgagggaatacgcttctgcaggagagaatacgctttccagtccagctctcccatcatcacgctgaacaagctaccggccgccggccggcggttggtcaggcggtggccgccgtcagtctggtccggccaagtgtccatgattctgcaacgcgagaatgcaagccagctgtggcgtcgcctcgcgacagacagacaggccgaccggccggagaattattccctggcgcctgaagcctccaacgcattcggacgataatctgttcttattgtttgtcttatgcttatacttatgcatataaaccaaaattttaattttagaattttaattttaaatttgatttttgtttttcatcgtattttattttacaatgtttttttctcttaaatattcttttatttatttgttaataagcgattcggataagtatatgaataagcgaaacaatggagcttctagatggcgtgactggtcgtgcatgtcttcttcaaaagttgtacagtgttccatccgtcctaaaatatagttaattctaaaattcaaattttaccacaaatataacaatctaagataaacaaaaatattttttcactaaactgcccacacaagcatactacctattggttttattatagtcttgatctacacctaacacctcaccatcccaaaaagacgaacaaatctctctatccgtctccttaatatatgtctaatgtcttcctttaaaattgctacattttaaaatgaaggtaataatacaacaacttgtaaatataaatttagataagtagttctctaaacatatagatgtagctatagaaatacttatattttgggatgaatggagtagcatataaactttgaattttgagagttgattttatgattcttttttcatcataggatattttctacttaattttcaattgataatgacacaaatataaacattttatccttatatcattttttatccgtttatgttgctatggctgggtcatagcaggcatgattgatttatattatagtatggattattattacagattatctacttaaatatagtgtcaattcaaaattataaaaaataaatttaaaaaataaatcaaaataaattatctaagcaatatcaagttcttttaaacatgaaacaaataattcaacttaataatatgtcgaataaactaaaaagaacatgaagttttggtcgctgataatggaaactattttaatcccgcgagctcgagggatgttctcattaattttaaaaatgtcgaaaaagttacgaaaatttctcaaaaagtttaacagcactcatacaacatatatattccaccctagaaaaatcttatgtccaaaatcgactcgcacatttagatataaaagaagacaaattcagtgtataaataatagtgtattattatttacgcgaagtgagtatagctcaactggttaggttccttgtggtggaaccaaaccacctaggttcaaatcctagatttcacacgggtgctcgcatttatggctaattattctttcagtggtaggcgacgtacccgtcgacagcgaggcgcttgtggtgacttcgtcaatctcaagatatgccggcctagtctttcagaggtgctcataggggtagggtgtgcgtgtgtgcgttcataggggtgagtgtgcgcacgttgtgagcgcttgtgtttgtactgtgtttcaaaaaaatagtgtattatttacacacgaatttgtatcttttttctcagtgtgttggtcgaatttgattttgattttttttaactgatagatgtcactatactctatttttctcgttattttttctaaatctttttagaactatttatattagattttaaaaaagatacacgataggacatcaactcggattggttatagaattccattcctcgctgacaggtcagccagagttgaggccatggccattgttgagcagcaggagaattttctgatggcttatttggtttagaggaatttgaactcataggaatggaaaaaagagagaaataggaagatatgcacatatcaatctatatgaatttttccaaaaggtttgagtcgatgaaaattcccctatgttatctttttacaacttggagggaaagaaattttattttgatttttctatacctcatccctacaaatctaatgacatttgtagaaattaattcttaggaatccaaattatttatttttcctttaaacccaataagccctgaatttgtacggagctgaactgagctcctgtgttccatcaatcgggtttatgctgtcgcaccggagtaccggacacgcacattcttcagatcaaagcctcctcaaactttccaagattcttcttgttttcccttaaaataaaaaacctttccaagattctcggtgacgaaagacggttcaatcttgataaagcttccgttcgaccatcacacacagcctaactgaaactgtaggtctgtagctaccgtcctgatgccctttcctttcctcgtatggtaagttttccacaagcttttcacgcattggattcataattccagtgtaatccggttttgttccgtgaaatccaaacttttcggaccaggtcgaaaacacgaatcactcggtttttttaggctaagttcaaaaaaaatcaaactagattttaaatctccaacggaatttttctgtattttatcggttttttcgacgggtttcgtaaaatccgatgatatcgctcgtgaacggatttcgatccggtatcaagaatgtgaacttcggcgtcatgatcggtccggcgttcagctcactggccaccgccgtcgacgcgactccatggccgcgccatgggcgatgatgctttcctcttctccctctctatttttaggctttggaaggcaaagtgtgtgcaaagttgaggttgatccgggcgtgacgtgcgtgccatggcatgaccaaaaaccacatccagtcacgtggctcaaaatgcacggttttttgcaggcagcatgtgagcgtgtctgccggcgctcttttgctgtgtccaaatcctaacgacacagccacccgcgctcgtgtgcaaacttagtttttgattcctccccaaagtttgttgccttagctacaataataaatatccagaaagcacgaattatgttctaccaataccattaccaatatctactacggatattggtaataacacccttgaatattaataagctacttttttcgtttcagattataagttgtttcgactttcatcaaagttaaattatttcaagtttgattaagtttatatttttaacccaaaacaaatatattataaaaatacattcaattattaatttaataaaattaattgttatgataaatattattatatttatctaccaactcagttaaactcgaaatagtttgattttgaccaaagtgaaaaacgacttacaatctaaaatagatggaatattagtcctttatgatttttctactaagtagctcggtggtctctactggtagagctgatcactgtactattttccaaaagtataatagtactccctccgtttcaaaatgtttgacaccattgactttttagtatgtgtttgaccattcgtcttattcaaaaaatttaagtaattatttattctttttatattatttgatttattgttaaatatactttcatgtacacatataattttacatatttaacaaatttttttaataagacgaacggtcaaatatgtgctaaaaagtcaacggtgtcaaatattttaaaacggagggagtattttttttagaagctagagtccaagcgtttaaggctctcgccgagcagtccatctcccacttgtgcggtgtgttgacgaaattcactgacaggggagcatggggtgtgtgcttatataaacacggacactcgatttagctaatagctagctggagctcgatcctgaagagcagtatcagtgctcagctcactgttcatcatcaccctcacctcttctctctccctcccttaccttcctccatagacgactgcagctagctcgatcggagatcgaggccatgtccatggcggcggagagggtggaggctgccggcggcggcgacgacgactacacgcaggacggcacggtggacctccatggcaacccggtgctccggtccaagcgcggtggctggaaggcatgcggcttcgtcgtcggtaaggattgaagacgatgaactctctctcgtgcatccggttggattcagcatatatgcatgcagtgatctaattaatcctttcagcttgattaatctgtcatgaacaattcatggcagggtttctcctttctttcatgggttggcatatggtttaattacttgcaaattgattgatattcttggttagaaactagacatatcgaggcttgtgtttgatttgtttatatgccacgagcgtttgaacattttcctcatctgctcacccctcaccgcatgcggcgggtgcaggatttgggagatttgttttgataggatcgatgattgtttgttattttgtccggccaatcgccatggttttcattagctgccattttgtactcctgccatagtctttggtactactatttttataatctccctacctcgtgtctcagacaaaatatcctccttggtattataacctctacggtatctctcaaggacgtaagagtagagtacttcgtcatgcctgataaccttttttcacgaatacgcaaaaggtttgtgtttctttgttccaagaaggtagagaccaccatgtgcaatactagttgttaactggtcgcttgatcgcatcgttttctgtgaagtcagagtcaacatatcacagtgtatctgctcaaagtctctcacatggatagtaacatgtgctacagtatttctgtacttgcgccactttcctgtagaaatggttcttcagtgattgtgtatacatgtactgtactgactaatcagtcagagcatacggttcaagtggtcaacgctgacaagaagcaggacaaaatcaaaaacactatagtacaaggttttccctacctccttttcttttttaagggcctattcggattggagaaatttcacgggatttttgaaggaactgaactgttgttacctgtgaaaatcttgtaaaatcgaaggagccctaagatttctcctacatcttctgaatttctgatagataacaatacaagtacatggtgtgccaatcactgaagactgaagatgatatgtatgggcagtgtgtagctagcacagtaggaaaatgtcaaaaagttcagtatgttcaggaccactgaatttatcctactaggaacaggcgtgcatgattttctgaatttctgatagatacaccagcggtggctatgaactgaagaagctggatagaaacttcactgttgcaatatgcagtgctaatttaatacagtactacttctaatcctcccaaactttggagtgatcttttcatagattaggaaaaggtgtagttaaccaacttgaacatggactgccgttttgtctgaagtgttggttcgattcagacccagctgaaaaacaatttaaggcaggagtgagttagtttggattcctacggttaattactagcagttgatccaataacagtttgcgtcatcagagatgcaatttagactgaatctgacagggaaaaagcctaagaaattgtttggtgatggctgccctgtcctgtctgcttggagcgacaaataggagttggaaattgacctttgtgttaatcaacggtttagggtagggacccagctgatccctactatatgattgcttggaaagaggcgttttgttccagcccggttggaatctgtatctcatcgcattatttgttcatgacaagaaagaatgattatgttagtggctgtcaccttccaatgatcacaacacttattagctcgttgtaaatgtgctatcttctctgtcatagaggattcttgttttactttgacaaataacaaaagaagtacatgttcattgaaactggtttgcatgaacaacttgtccaaactgcaaaatgttttttttctaaataaaagagaagagttaaaacataggatgctctgttgcatggttgtgtggtggttatggtttggttagaaatgcagagaccatgagtcctgtggctcatgagagagaatggtacctcggtaaaaaatggttggttgatctccatgcatatattttcccaaccatacataaatctggtccttaattagttaactaaggttgtgtttttccccttttccccccaacagcccaacttaccttcctcttttttcccacgcacgtttttcaaacggctaaacgatatattttttaaaaaagttttctataggaaagttgctttaaaaaaatcatattaacctatttttctaaaacaataactaatacttaattaattatacaccaataagtcattctgttctacgtgcacgagggattagtcccaacggccactgccaaacacagcctaagaattcatgtgttccaaacagaatgtactgttactactgtataccatgttttaaagtgaattattgttgtgctgataatgaaaaaaaatgcagtgtacgaggtgttcgagagaatggcgtactacgggatatcgtcgaacctggtgctgtacctgacgacgaagctgcaccaggggactgtgtcgtcggcgaacaacgtcaccaactgggttggcaccatctggatgaccccgatcctcggcgcctacatcgccgacgcgcaccttggccgctaccgcaccttcatgatcgcctccctcatctacctcatcgtaagtccctcacctactccatctccctccatctacagcagagcacgagaatcttggaacagatcaaatgaactataccctctgtgctaaaatataaacatttttagcatcgtggcaagtcatacatttctaactttgatgattattaatagcaaaaaattgatgattaatagcaaaaaaaatataaaaaatcaatcatgtaaaattgatcttaccattaaacaaactattataatatatgtaactatttttatttaaaacatcttacttttatatatattgttggtcaaatagcatctcggatactgtgacaggatctaaaattacttatattttttaggacgcggggagtagaaatcaaaagctagaaaataaattagaaaccagaacttaaaaaatctattggacttttagattttcaaaagttagttacccaccagctgcttggattgctctcgtgttgaaaaatgcagtccctgtctgaagactgtacgaccatctagctgctctagcccacaaaaatcaagatgggctttagctcgaagcccacaaagtccagtgaaaaaacaaattgcaagcccaaatccagcacgactaattcaaaccaaatctgtagatttttgttaccaaatttgatcgatagattccgaatttttgaacgtcgctcgtctcgtctcgtctcgtgcaggggatgagcctgctgacgctggcggtgtcggtgccgtcgctgaagccgcccaagtgcggcgccggcacggcggacccgggctgctcggagaaggcgtcgagcctccagctgggcgtcttcttcctcgcgctctacatcctcgccgtcggcaccggcggcaccaagcccaacatctccaccatcggcgccgaccagttcgacgaccaccacccgcgggagcgccgccataagctctccttcttcaactggtggatgttcagcatcttcttcggcaccctcttcgccaacaccgtcctcgtctacctccaggacaacgtcggctggaccgtcggctacgcgctccccaccctcggcctcgccgtctccatcgccatcttcaccgccggcacgccgttctaccgccacaagcccacctccggcagcagcttcgccaggatggccagggtcatcgtcgccgccatccgcaagctcgccgtcgcgctgcccgacgacgcgagggagctccacgagcttgatgatgagtactacgccaagaagaagaccacgccgctgccgtacacgccgtacctgaagatcctgagcaaggcggcggtgaagacgagcacgacgtcgaggtggtcgctgagcacggtgacgcaggtggaggagacgaagcagatactcaagatgctgcccgtgctggcggtcacgttcgtgccggcggcgatgatggcgcaggtgaacacgctgttcgtgaagcagggcacgacgctggaccgccgcgtcggcggcgggggcttcgagatcccgccggctagcctgcaggcgttcgtgaccatctcgatgttggtgtccgtcgtgctgtacgaccgcgtgttcatgccgctcatggcgcgggcgaccgggaacccgcggggcatcacgctgctgcagcggatgggcgtggggctcgtcatccacatcgccatcatggggatcgcctccgtgacggagcggcacaggctcgccgtggcgcgggagcacggcatcgcggacagcaagggcaccaccatcccgctcaccatcttcgtgctcctcccgcagttcgtgctcatgggcgtcgccgacgcgttcctggaggtggccaagatcgagttcttctacgaccaggcgcccgaggggatgaagagcctgggcacgtcgtacgccatgaccagcctcggcgtcggcaacttcctcagcagcctgctgctgtcgacggtggcgcacgtcacgcgccgccatggcggcggcggcgggtggatccagaacaacctcaacgcgtcgcggctcgaccactactacgccttcttcgccgtcctcaactgcgtcaacctcgtcttcttcttcctcgtctgccgcctctacgtctacaacgccgaggtgtcccgcgtcgtcgacgtcggcggcagaggcggcggcgaaggcggcgaggtgctcaggcccaaggaggtggccatggtggacacaaatctatagaaaatgtatcgatcgatgatcaaatataccatgaaattaatatcaccttcagaaatgctaacaacagcggcttcagcttattttcagaacagtgaacatatggatgcactctgaccagaaaaaaaaacgaaatttttgtgcaatttcaaggcgaattgtgcagatgtcgaacagagcatttgttcatggctccttattgcaacagaattgtcgaacacacaaggtttttcatggacatatatacaacagagaacgtctagaatataaccttcatcgttaattcattctaaactagcaaattacccatacaaaattccatgctttatatatatatatatatgaggcaaagctattgccctctttaaaaaaaacatacaaaatggaaccgctttgtcgtgttcttagcaggcaacagtttttctttctaacatgtgggaagcacgggacgaagaggaggaggacgactcttcttttattgtactcgctctgtttcatcatattataagtcgttaacgttgattttttttcctagtcaaatttaaagattaactaagattatagaaaaatataatagtattttcaacacaaaacaaatatactattaaaatatattcaatattagatttaataaaactaatataatattttagatgtagcaaaattttctataaacttggtcaaatttaataaagtttgaccaggaaaaaaatctaacgaattataatatgaaacgggatgagcagtagtagtagagataagagagaccaaacgtaagaaaggaacgagctttctcagaattttggttgtgactttgccagagttcaatcaatcgtaacgttaacagacaggacggcattattagatttcttgggtggttcaaagtaggtaaagattcatgcaaactcttgatctgcaaatcctctatttttatttcaggggatgatgaatggtgctaatacaaatcatacgcaactatatctattataaaaacatgactaaatctcctataccacataatacatggatttgttaacagattcgaaattgctaaacgccctgttgtcctcatttcagagtctcaacaatcgtattttcttgatttattaaatccaaaaattaaaatatactccctttataaaaaaaactaatctcaatgtccagattcaaatatagaattgagttttttttctttttcacagagggagtaacaaataaaaaaaatactgatatgtacatgttctctgtagtctcgattataacctaacaatgtcagtattgtaattatttagaacataatataatacacagattgatgtagtagtttgatttgaaaagaaccccaggatttggtttagagtttagacaggattttgatagagttcctagaattttttttatttttaattttttttattaaaagttttacaaaaataattttccattttgaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaacgaaagagagagagaggggagggcagcagaaggggagtggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgatttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttcaacggtcgtggcccctcgttatatttgtgtcggtacaagagaaagatataaatgtttcaatgcaaaccgaagatgtagagggtcctatcaatgcaggggatgttgttggaccatcgatgcaaaatgaagaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggtagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacaacagtgttgttggtaacattggctttgaaccaaaatcaattattaggcacatcgagaacaaattcaagtacaccataagctatgcaaaggcctagagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgatgcaaagagcctttttctcattgggtgcttgcataaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagttgtgcgtatgaggcccaacgtttgccttatacatgatcgtcatgcgggtatgttgcggactattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacgcaagcgtactttagggatcgatacaagaaaattggtctgtccatggccgataacaacatagtgtttggcaacgtagtgacaaagtacatggaagataaaatcaaaaaggcaaggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaaacaatctttcatacatggagtgaggagatatatgggttcgggatctcaggatcttacacaacgctgagtgcccaagttttttacattacagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgaacatttattacttatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccatccacgcacgtcgcgcgagtggttgcgtgtcgacctccgtcacgttccttggtacgcgtatgttcacatttcaactcaactttgctttgtgttgtactcatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgctggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcggttgggtgatgttcactagcacccacgggcacgttgtggacttccggctggtccactacgcacggtccatcgcggatgctcagccacaggacgtgccgcagtggagctggggttctgccgtgctagcagccacataccgtgccctctgtgaggcgtgcacgaagactgacgcgggagtgatcatcgctggctgccctatgttgcttcagctttgggcagccgagaagtttgccataggtcgaccagtggtggacagcgcaccctacggggttggtcgcagcgcgcagtggccagaggactgtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcagttgtttccgggcaacgtgcagccgaccgtcctccctgccgaccactcgtgagttcggattgttcatttctaaatttttatgataattactacatcgagccatataatttacctctcttcacaggttgactcgacggggacagctagcaggcgcactttgggctccacgtgtacagcagtacgttgatgactgggtgttagctacagaggaggtgatcaacgagctcttcccacacacggaggagaactaccatgactaccttcgctggtaccttcctcgcactcgtgcgcgtgtgaccttcactccagacgccccagagccgcacgttgccgttgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttatgtacgaaaacatcagcccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcaagctccgcaggggcgttcgccacctcttcgggcgcgttcgccagctcttcctctcacggagcgtcgatccctcgcccacacggtactttactttttattaatactattaaatacctgtatgaaactgatggtccttgtccagcagaatttgcagccgggatcttcggtactggggcctcttcgtctcacgccggtaagactggtcctactagccagttctacgacgacgacttgcacggtgcacaccaccacgacgtactaggctcctctcagcttggaggagctccagaggcgcacactcaggagcagccagaggtcacacctgtacaggcaagacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtcttgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatcttattgagttcacatatattgcagtgaaaacgacgctatataattgacaatctgaaggcaacctcttcatatcttctttcccactagcacacaacacacaaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccataatggatgtacataggaggatgtaaggaaatgtcaattcgtacaatggattgacacagtcagagttacttcaagtggcgggctgataacgcaacctgaaccgaccatacagttcattcatgtttggatggagtacgaacgttgggtggaaattgcaagcttagactggaggaccaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacatagtcagaaacacaagtagagtatcaacgattgaaggaccacgagaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctacaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattattttttgtaaaacttttaataaaaaaaattaaaaataaaaaaaattcgagttcctacaagctcgcaccaaattcggcccatagaaagaacaaaaaaaaaaaaccccaaaaaagaagcccacagagaagaacaaaaataacccgtctcccccacgtccccaccccccacacgacgcgccctaaaatatccccaaaccctccaaatctccgccccccacctcccctccccgacgccgaaatcccccaaattccacccccgcctcctcctcctcctcgcgtcgcgagagaatccgaggcgcgcgagcgagaggaaggagagaaggtgagagcagcggcggagggaggagatggagtcggatcaggggaagctgttcatcggcggcatctcgtgggagaccaccgaggagaagctccgcgaccacttcgccgcctacggcgacgtctcccaggccgccgtcatgcgcgacaagctcaccggccgcccccgcggcttcggcttcgtcgtcttctccgacccttcctccgtcgacgccgccctcgtcgacccccacaccctcgacggccgcacggtatcccctctcaaaccctagcgaatattcgcgttggattccctcctctcaaggttcggttcggttcggtttcgtaggttgatgtgaagcgggcgctctcgcgggaggagcagcaggccgcgaaggcggcgaaccctagcgcgggggggaggcacgcctccggtgggggcggtggtgggggaggcgccggtggtggtggtggtggcggcggtggtgacgccggcggtgcgcggacgaagaagatcttcgtcggcgggctgccctccaacctgacggaggacgagttccggcagtacttccagacctacggggtcgtcaccgacgtcgtcgtcatgtacgaccagaacacgcagcggccgagggggttcgggttcatcaccttcgacgcggaggacgccgttgaccgcgtgctgcacaagaccttccatgacctgagcgggaagatggtggaggtgaagcgcgccctgcccagggaggccaaccctggctccggcagtggtggccgttccatgggaggcggcggtgggggttaccagagtaacaatgggccgaactccaattctgggggctatgatagcagaggtgacgctagcaggtatggtcaggcgcagcagggtagtggtggttatcccggttatggtgctggaggatatggtgctggtacggttggttatggatatgggcatgctaaccctggaactgcgtatgggaattatggggctggaggatttggaggtgttcctgctgggtatggtgggcattatggcaatccaaatgcgcctggttcaggttaccagggtggtcctccaggagcaaacagaggaccatggggtggtcaagctccgtctggttatggcactgggagttatggtggcaatgcaggctatgctgcttggaacaactcttctgctggaggtaatgcacccactagtcaggccgctggtgcaggcacaggctatgggagccagggctatggatatggtggatatggaggagatgcatcgtatggtaatcatggtggatatgggggttatggaggaaggggagatggtgctggcaatccagctgctggcggtggatctgggtatggtgctggctatggaagcgggaatggcggttctggttatccaaatgcttgggctgatccttcacaaggtggagggtttggggcttcagtcaatggagtgtctgaaggccaatcaaattatggcagtggttatggtggtgtgcaacctagggttgctcagtaaatgaggccattagagcatctatgagatgaaccagcaaaattgggcagtctatgtatgttgtgttaccctggcccctctgattgcttttggcctcttgaagatctcccatttgctggttaaatcagtatttctccgggttggaatgcttgaaccttttgcggcttactactagaatgtagtcaataactagcttctagctatactatggagtagctgtatcttgcgtaatgctttatttaagtttagccttatctgtcggtgtgctttgtcatgagtggaatttcagttgcttcgtctctagtttaaagctagagtagcttcactacttatggacaacaaactatctagttgtacctttattctacagaatcatatgtttgtggttgacagtagtatttatgctggattgtgctttacctgaatctgaaatgttctatctttggttgtttctctgtggtgtgctctagctcaccttgcagttaaggtgctgttgcgtattattccattaatattgattgtaacagatgacaatcctcaaacttctatgcagtgatagaggtgttttatactgtagctgcttctagcagtaagttcaggtgtagtgcaagtgcttttcatgtcattggaatgatatatcattaaagtatgtggtcgagctatgagtatgtttctgatatttggtatgtagatggataaacaagcatagtagaggcaaacaattagcccctacctgaagcaataagagcatattagcagcaagttggtagcgccaatttctaaggtagtatagatacagagaagtctgtgatactacttgatgaatgaaatacaggtagaaaccatagagtagaatactccaggcatttggcaagcaaaataatcatccttcctcgtacatttcctttctgtacaggttggatgcgatgccatttccttttagagcatgtccaagtggggccttttgaatcaactgcctggctgcctgagaaatggcagagacatcgactgattttgcttgatgggctgacgatttccaatcttgaagcatttgacacagaaagcaagcatcttgtttttaagcgcttcattttctgaaggatcttgtgctgtgcaacaagatggtggtatgtggaatcatgtttcactttcagttttatttggaaaagaaaagcattttcaccatggtacttgtaccaggaaagttgttcaagatgctatctgtcctcattttccgttcaatttagtaaatggtatattatagttgaaagaaagcattaccagctaccataggaagtattatgttttcattcaaaatcttgtcaattttggccagagttccatccccaatgtacagatcgacaatggtgaattactatcagtttagtaaataataataaattagaaggtttttcaaaagaataattccatgatctaatgtatgtttttacctttttagatacgcatatttgctagtaaaactagtgatgaaagttgtgtcatggagatctaggaaaagaacaacacttgtatacctagaggtgatgcattttttgaaaatctgttttactggcttaacaaatttagtcactaataaaactagtgatgaaagttgtgtcatggattagtgcacaagttttgcaaacagaatttggcttaaacaaacagtttggatgagtaattccttaactttttccccttatttactaaattgatgagcatgatttaagttgtacttacagtcttgcacactggcatgatgttttacaagtttttggaagtactggaaacctaggatccaatatcctagtttgagaaaacaacactcatattgcttgttcctgttaataagcctgggtagcatgttcatcgctcagctatgccttgctcggttgctattgttggatggatagaagtggaaaaaaggggggggagggaatcagtctatgattatatacttgtatggttcaatgtagattaaaatccaaggctttgacttaaggttcctacacttatgtacttcattgcaaatttaactgtgcatatagtacattactagccaaggtagtcaatactcaatagtattatatatttcttcatattgaataaggctcgcttcatagcttaacatatatgtaccacaattttattgtccactacattatatagtacataatcacaattgcttaccacttgctgtttcttgactattaaactatttagattaaaatgaccaatattttctaccttcttttgcaaatcagtttcattacagcacttctgttaaactaaaggtatactatagggtagatttaaggttatgtagttctgttttggcgttttgtttgaaccagttggattagtattatgaatccacatccttagtttattttattgcagaacacaaatagttgcatggcttatgcctgttggagttaataggtgttaaggtaaaacatgtaagtaaaaaaggttctccaggacttgcaatgatgcacctgtacactggatcaatctgatggaccagtatctgactttagaaatgacaataaccacactgatttaggagactcaagagtcaagatatttactgggtggagagagaaaacattagtgttagatttaacggctaagctttgtgtttgcatttaaccatttgtaaatgtgaaagcaatactatttttgacagaaaaatacaattttgattagtgtatctcgcacggttaacttgattaagatctaaaatactgcaacttcatttgtactaaccattagatgatttagttgctcagtgcctgtttgggacttcatgtgatataataacataatataaccagatcggcttatatattaaccttggagctcaatcactaagtcttcttctgtattatgacatggatatttggaaatgaccaagtgcaattcgatttacatgttctatttatgctatttcttggtgttgctttaaaacaaccatttaagtaatagctatgagaaataaattagtgccacttatttttcatgattttcaatatattttttgctttgttgctgtcaaatctcttagtaaacctgataaagatataaaattagaaatttgactgcagatgccatatatagtggatagctttattaccacactggtgccaagcaaaccaagtcatagtcagccaaacatctttgatatgtttttactcgagtatctgaaataaccaaacattttggagatatgttatcatcattctattgacctctttgcataccttgtttgcatggtatcaatgcaatggaatatgccttcgaggactttgctgaaagatcacctgcaagtacatcaaaaatcaagagatgattctggccgccatgtattatgaccacagtgactcgtgctcatccaatattcttcgtttctcgtatcttaatggaaaccctcacagtagcgttgccaccttatatcgaaggacaagttgtttgaagttggctaccaattggtgccctactttaccaattgtcagatggaagggttgagcgtacattaatctggagatgcttatcgagtttgttgcatgacaagtcaatatattctattgatgtggccaatatttgcacgatatgatttcttggcaagttttagtaacattttaactcattcttccagacaatagtgcaaatcgccgaactctctattttacttgttttgttgtcatggatgaaaggtttgcaagactttgttccagaggtgacgtttcctgtgagccttttacatagcattttctttttttacagaaccgtaattgacaaatttgcctaggttaccattgttcatgtacagcgattgaataggaagctcaccgttgtgttaattgaacaatccagtatctccagtttatcatgttaaatcatgtaatctctgcaattacatctatgcttagtaatacatatttcttcatacatacgctggcaatgttgaaactttataaactaacccagttagtgcaatatttgactgatggcattgaccataagctataaagtctgcccatctgtgaatgtatccacatttgcccttcatctacttcatgtttttctctggttattaaccatgttttgattacatatgaggatcaagccatcgttaactcataaataaattacaaattaatcggttagttagtacagtacttcatttgttttagattataattgtttcagattataagtcgttttgactttggtcaaagttaaactattttaagtttaactaagtttgtaaacaaacatagtactcattaaattatttatatttttataatatatttgttttgggttgaaaattttactttttttttttacaaacttgatcaaacttggatcagttttactttgatcaaagataaaacgaccaagggagcataagctagcctgataaaacacgagctggaattcaatggttgagctgcaagcccggcaccgaaatagttgagctccatttgggctcccctttttgggccgcttctgtcgtggtcgccgcgcgtctcctgcctcctcgacgtcgcccgctgcgcgcgcgctcgctccgtcgtcgccacggccgcccggaacggcggcgagatggggcgccaccagcgttcgggctccctctcggtgacctcctccgcgacgccctcgtccgacgccaccgagctcgacttcgccgccgccgccgacgtcggctgcccgttcggacgcgtcgacgcgctcggccccgtcgagctccgcgagaccgcctacgagatcttcttcatgtcctgccgctcctcctccggcgggaacaccgccggcgcagcagaggtgtcgtcgccggtggccgggccgaggggcggcggcggcagccgcgtcaagaaggcgctggggctcaaggcgaggcggctgtcgtcgtcgtcggcggcgatggtggcgcagccgatgatggtgcgcacgctgagccagacgtcggggccggcgtccccggggcgtgggcggcggccgatgacgtcggcggagatcatgcggcagcagatgcgcgtgaccgagcagagcgacgcgcggctgcggcggacgctgatgcgcgccgtcgtcgggcaggtcggcaggaggcccgacaccatcgtcctccccctcgagctcctccggcaactgaagccggcggagttcgccgacggcgaggagtaccaccagtggcagttccgccaggtgaagctcctcgaggccggcctcatcctccacccttccctccccctcgaccgcctcaactccgccgtgctccgcttccgcgaggtgatgcgtgccaccgagatccgcgccatcgacaccgccaagagctccgacgccatgcgcaccctcaccagcgccgtccacgccctcgcctggcgctccggcgtcggcagcggcggcggcgacgcctgccattgggccgacggctacccgctcaacgtcctcctctacgcctcgctcctccacgccatcttcgaccaccgcgactgcaccgtcgtgctcgacgaggtcgacgagctcctcgacctcatcaggaagacgtggccgacgctgggcgtcaccaggcccgtgcacaacgtgtgcctcgcgtgggcgttcttccagcagtacgtcgtcaccggccaggtcgagccggagctcgccgccgccgcgctcgccgtgctcgccgacgtcgcagccgacgccagggggacccgcgacgcggtgtacggcaaggcgctcctcggcgcgctcggcgccatgcaggagtggtccgagaagcggctgctggactaccacgacagctacgagaagggcatcggcggcgcccccaccgaggtcatggagatcctcctctccatctcgctcgccgccggcaagatcatcgccgaccgtgatgccgccgccgacgccgacgacgccgccaatttcgccggtgaccgcgtcgactactacatcaggtgttcgatgaagaacgccttcaccaaggtgaagttcttgggttcagaatcacaatttgtgttgcatcaattcatgttcgttttgattccagattctcgagagcggaatgggcgacggcgacggcgagccgggggtggtgctgacgcagctggcgagggacacggaggagctcgccgtcgtggagcggcggagcttcagcccggtgctgaggcggtggcacccggcgccggtggccgtcgcggcggtcaccctgcacggctgctacggcgtcgtgctgaggcagtacctcggcaaggtgaccatcctcacggaggagctcgtccgcgtgctccagtcggcgagcaggatggagaaggccatggcgcagatgacggcggaggacgccgccgactgccgcgacgaccgggccaaggccatcgtcggcgacatggagccctacgaggtggattccgtcgttatgggcttgctcaaggtgtggatggacgacaggttcaagatcaccatggactgcctcgccagagccaaagaaaccgaggtaatttcgtcgaacaccttgatgacgtccaacttgaaaaatcatttttcatacttaccattgatttgcaacaaaacgtgttagagctggataccaaaatccaaagatgaaccttttgccgggtcagcgatggagatgatgaagctggctaagtataccgtcgaagagttctccgagatcccggcgagcgcgaaagacgaggtggtgcaagacctcgtcgacggcctcgaggcgatcttccaagagtacatctccttcgtcgcctcgtgcggtgagacacatccactcacgtgacaagaagtcaacgataacagagtatcatatttgtagtgttcagatcaaacttacacgtctctgaatcataggggccaagcagaattacctcccaccgttgccaccattgacgaggtgcaaccaggactcgggcttcttcaagctgtggaggaagacggtgctgccgtcgtgccaagcgccggagggcggcccacgcggcgtcggcgttggcggcggctcgcaccacgtcccgcggccgtcgatcagccgcggcacgcagcgcctctacgtccgcctcaacacgctcgagtacgtcctcacgcacctccacgccatcgacaagtcgctcgtcgccgcgccgtcgccacgcttcgacggcgcgcgcgccgcggcgaagtcggcgatcgcccgcgtcgccgaggtggcggcgttccgcctcgtgttcctcgactcgcgccactccttctaccacggcctctacctccgcggcgtcgccgacacgcggatcaggccggcgctgcgcgcgctgaagcagaacctgacgttcctggtgtcggtgctcgccgacagggcgcagccagtggcggtgcgggaggtgatgagggcgtcgttcgaggcgttcctgatggtgctcctcgccggcggcggcgaccggagcttcgcgaggggggaccacgccatggtggaggaggacttccggagcctgaggcgcgcgttctgcacgtgcggcgaggggctcgtgccggaggaggtggtggcgcgcgaggccgaggcggcggagcgcgtcgtggagctcatggcgcggccgacggacgccctcatcgacgcgttcggcgtcgccacgtccgagtccatcgtcgccgccgtggggcgcggcggcgacgacggcgacggcggctacggcggcgtgacgccggtgccgccgacgtcgaggcggtgggacgccgccgacgcgaacacgatcctccgcgtgctctgccaccgcgacgacgaggccgccagccagtttctgaagcgcacgttccagctcgccaagcgacgatgatcatgcaaaaaaagcttcgcgtcgtcccgtctccaagctcagcaatggcgcagccgcgcagtgtatccatcggagttgaagaagacggtagctacacgccatacagctctagatttttgcgatctttgcagtcggaattaaacctcataatctctcgaacgaactgtaaacccaacacaaatacgaatatgtaaaattttctggcacggatctgaaagtttcaatattggtgtcattcctatgtagttacattcgaaagttttctagcgaaaaagcttacgataattttgttcagtcctccctccgtttctaaatatttgacgctattgacttttttaaatatgtttgaccgttcattttatttaaaaaatttaagtaattaataatttttttcctataatttgattcattgttaaatatacttatatgtatacatatagttttacatatttcacataagtttttgaataaggcgaacggtcaaacatgtgcttaaaaagtcaacgatgtcaaatatttagaaacggagagagtaatttcctacaacgcccactcgctccccatccacagtccccaccctcccactccacctcgctatgctctccgctgtatccgccctcgacgccgtcttcgctccacgcgccaccaccttcgcctaccacggctgccgtccgctacctccgctccatctccaatgcgtcctggttcttccacgtcgcgatcccacgccagccctttggcccttgccacgtccgccgcctcctcaccgccatctctcgtaaggttgtcgatggccgtccggaggcgaggaggcctttgaggggggacatggaggtcggcggcgagcgcgcatggagagggaggaggcaggctcgcccgctccgccccgccccacccagcagcgtgtagtgaggagaaatttttttaattattttctagcgtaactgaaatgtgggcctcatgttttttatcaaattgccaagtcaatgcctcatgggatgaataactattcaaaggagccacgtagatgccacatcagccaaaaactgtaactggcacgtgggccctcatgttttttattgaattggcacgttagcgccacgtcaacaccgcatatgacaaaaacctaatcaaaggagccatatatgcgtcacattagccaaaattggtgataataccacgaaaggatctcgtttgtactggttttataagtttgggatgtattgtatttggttttacagttaaatgacgattttgtaattcggtgttaaaagatgcgatagagagatctccggtgtactttctccattatcataagacgagatcttttgggacgctcatggcccagagttcttagcccgtgatgatgaagcctctgcctccggatgcttcgatcggcttctcggcccgccgcccctggtctcgtcgtcgtgccgctcgagacggactgcatgctccgccggccctagaattccctcctcctgaggtcgtcgccgcgccggcacggcgagccggcgagcgcggccacgggttcctaccggcgccgccgccgtccaccgtgagtttcttcactactgaaacaattccgtactagagtgtaaacaatgccgataaatttaggtatagatgtgtttgcaaattctgcattcgtcaaggcagctacaggattactgctactgaaaaaaactctgcattttggtattttattgcatgctatcttctttatggaattatggatatgtcacgtatatgagactgcataacaattactggtgggtttctttgttggcacagaatgctgccattcattaccagtgttttgataataggagatgagatgagatagttcagtaaatttttttagataatgggaatttataaaacctggcttctacaccaactggggtgtatacagccacagaatatccaagcaaacaagcttagttcatacacacaagttcacaaacaaaagaagcacaaaggctcaagcaccttacataaaactaaaagagcacaaagactccctacgcctttcaaagtgaaaagaccttccaaacaaactaaaaaccacattcctcctttaaccgctttctcatgttccatccatctttaccaaagaagtgcatgacagatgtctctaacagtttgcatccttccttcatcacatcgcgctcatcttctttaagcagcaaggaccattgtcgagcccaatacgtccccctgaaaataacctgcaagtaagagttaaaattggagccattgaagaccacatcatttctagaaatccacattgcccacaacaacgtcgcaatccctgtaaagatttggtactttagcctagactgtaaaccctttagccaaatcccaaacatattagcaacattgttaggcggatttatcccaaatgttataaaaagggtactccaaacaaatctagccacatgacaatcaaagaagagatgttgtatcgtttcattgtggttacaaaaacaacacttagtgctgcccttccaatttctttttgctagattgtccttcgtgagaatcactcccttctttaaataccagaggaagattttgtttttcaaaggaattctaagcttccaaattaaatccttcattggtactatattctcatacataatcattttatacatggaactaaccgaaaatatttcggttttgttaactttccaaataagcttgtctctatggtttgagagcctaacaagaaccactttagccactaggttaaaccatgcaaccaaattctcccccaccaaagcaactcaacatttaacggcactttatctataacatccgcaacaatagcattcttattccttacaagattgtataaattagggtacaacttttcgaaaggaaaatcaccaatccagcaatcctcccaaaatcttatttgagaaccatcccccaccttaaaggcaccgcctttaaaaaagacatccctcaccaccattagcccagcccagaaatgtgaatctccagggcatttctcgacttgtgtgatggtttttttttgtcaagtatttattcctaagaatgtcctgccaaaccccttcttcattgatgagtttgtacaaccatttgctaagcaagcatttgttttatatctctaagttctgtatacccaagccaccacattcctttggtttgcacaatacactccatcttactaacctatacttattatgttcatcacattgccagaaaaatctagatctataatagtctagctttttgagaatacccttagggatctcattaaggacagtaaatagctaagctgaaccatagcagatcaaactactctgatgctacatctgttcttggagattgaacatctgtttcttgtaccattacatggttccatggaacatatggcacatccctgaataacttattctgcattgacaggcaaccagagcatcaaacacgagcaacagggcagaaccaatgacgaattgcagtcgagcaccatgtctccgcattcgtgctcactccatccctccagcgcgtgaacgattccagcgatacgccatgcgctcatgaccctccttggtagccaattctgccaaataagctcaaaattctgtacttaagaccattctgtaaagctctttcagagtacgttgcagctcaacagtttattaattacctcacatgaatgcatgttgtgcagagttttaggaacaaccattgcaggagtcgtccagtaggtgcagcagttgttgcgtatcattctcggtggaaactgtgagtatgggatgaagtgtgctcctttctgtgtcctgaattgttccgtagcatcttagattttccccaattaaccaaacctgaagaaattttgagagcaacctgttatgccactggttgatcattaggcataagttctcttaatccgcatatggcactccctgttaatttatcaagagaaagtaagaattctgttgtccctgttttggaaaatgaaagattgttggccacattttctggcattttcgacttagtaaatgatagccctgcttgtttgtcattatgacctgcacacgaagggcggtttgtatcattttgacgtactgaaatttcaatcacatgcagaaaatggcaacaagtagtttttagctaagaaatttccatgtgccgaaaatgtttctgaatttcttgagtatagatgaatactgtgaattatactactatgtaaatactgttcgtagttacttttttttttactgcatgttaagaccaaacagcaagttcatatacactattgtaagtccttggtacttatggagttattgtacagt

SEQ ID NO: 58445 - DNA, 9243 bp, Oryza sativa
ggcagagagagcgaaccaagaaacagaagaagaacctctctccgcctttcttcagttactggtcatgtctgaaaatatttaatcagtttgagagcaatgttcttggcgagagagagttacatgagcacgtgcattttttttctgatatagcaatttcgaaaacaaaagaagaactggaaggagaagaactgaaccttttcttgagcttcttaactgcagcattttgctaatctgaaccaatgccaaaaggaaaagaacatctccacctttcttcagttaccggtcatgtctgaaaacatttaatcagtttgagagcagcgttcttggcgagactcgagagagagctacatgagcacttgcatatttttctgatagtaatttcgaaaacaaaagaagaactggaaggagaagaactgaaccttttcttgagcttcttaactgcagcactttgctaatctgaaccaatgccaaaaggaaaagaacaggaaggcaattacagatcgtagttccacacccttatgtaaaaatgaactgatgaaatgcagcatatcccgtaacaatgaaggcatgaaaaatagagagcgtaccaaattttggtgaggatgcaagctacgatagatatacaaaatgcaaaaatgaccggaattgctgaagcagcacatgaaggaagatatcaatgccccaacagtaacaaataagataatagtcataaaattgtggaagaattactttttcttgacttgaaacctggtgattagaaagatacatttcagctcaaagttttacttatataagatgtaatttcagactatcaaatcaatgtttgagtactgaaaatgcatgtgtttgtaatttggcagaagcgttctacctctctcgaggccgtgttacgtgttaatatagatgagaaaagccctcatcgtggcgtgtacaaactgggacaatcagagatagaatatatcttgtgaaataagaaagaaaatagaaaccgattctatctcctatcaatatatgctattattgcatgcacaaactcttctaacactcccccctcaatcataacttatctaagttaagattgtgcctaaaatttctaagctgctgaactgaaagcggcttagcgaaaccatcagccacttgatctcctgaagatataaacttgattaccagttgttttctagcaactctttctctgacaaaatgataatccacttctatatgtttagtcctggcatgaaaaacatgattaactgacaaatacgttgcaccaagattatcacaccatagacatgctgtcataggtgcattaatcccaatttccttaagtaaagtttgtatccacataacttctgcagttgcattagcaactgccttatattctgcttctgtacttgatctcgagactgttgcttgtttcctagcactccaagacactaaattggatcccagaaacacacctccagttgaccttctatcatccacagatcctgcccaatcagcaattaaaaataacttaccaacatagatgaagaccggtttattttcaaacctagatcaactgaaaattttatatatctcaatatcctctttactgccatccaatgttcaacagttggactatgcaaaaactgacagattttattcactgaaaaagaaatatcgggtctagtcaatgtgagatactggaaagctccaactatacttctatatttagttgcatcactttcaccaagaacagtaccactatgagctgacaatttttctgaggtagagataggagtattgactggcttacaattcaacatacctgccttttttaataaatccgtggcatacttttcttgctttaagagtataccatcatccactgtactcacctctatacccagaaaataatgaagatttcctagatccttgagtgcaaattcttgcctcaaatctgtcagcaatgcagttactgctccttctgtagaactagcaataattatatcatcaacatagataagcacaaagactgtaacatctcccttgctataaaagaataacaaagactgtaacatctcccttgctataaaagaataatgaagtatcagccttagatgccttaaaaccaagattacacaactttgtgcttaaccttgaataccaagcacgaggagcctgtttcaatccataaatagccttatctaacttgcaaacatagctaggcttactcttatcttcatatccagatggttgtctcatataaacttcctcttccaaataaccatgaagaaaagcattttgtacatcaagctgacgaagacaccaacctctagatacaacgatagataaaatagttctaatagttgctgctttaacaactggactaaacatatcctcataatcaattccatatcgttgtttaaatcctttagctactaagcgagccttatagcgatccaaacttccatcagacttccttttaattttataaacccatttgcagtctataatatttttgtcactactaggcggaacaagatgccaagttttattatctagaagagcagtaaactcagcatccatagcatgtttccaattattatcagctaaagcttcagctagattatttggctctccagtcatagctaaaaaagaatatcgaacagttccatcggtatataccttttctttccttgtacctcgttgcaaccgagtcattggacgctgtaccatctgctgctgctgctctgcgccatcattgccatcattgccgtgctgctgtacactatgctgtgcctgcgagtgctgctgcgcactatgctgtgccgacgatgtggcagtcggcgggccttcttgctccctgtgacgcagctgcagagctagcaccatcatgtgcagtagaactgtcctcatctgcatggtactgtacaagagagtcattattaaattttacatcattaggctgaataactgatgcatgatcaggatcttctgtgccgtctggatcttctgcattttcttcaaaaacctctgtattccctgaagcaatattctccatatttcctgaattatcattcaagtgctcatgctgatctgtaacatgctcagacacaccattagaacgttcaggagtattaagcatgtgatcattactatatccaaccccattaggaatcaaagaagaaggtaaaagtaagatttctgatctcaatctagctccagcattagaatgcaatttagagaaaggaaagacattctcatcaaagacaacatcccttgaaatataaactctgccagtagatacatcgaggcacttaaaacctttatgtatattgctataaccaagaaaaacgcattgttttgagcgaaactcaagcttgcgcttattgtaaggacgaagatttggccaacaagcacaaccaaacgttctcaaagcagagtaattaggtttttgatcaaggagccgttctaaaggggcggagtattgaataactttgctaggaaggcgatttatgagatatgttgctgctaggaaagcctcatcccagaactttagcggcactgaggcatgagctaggagagctaacccaacctctacaatgtgtctatgcttgcgttctgcggaaccattttgttggtgagcgtagggacaagagacatgatgtgaaataccaatcttggtaaagaaggagtgtaatttctcatactctcctccccagtcagtttgcatagaaataatctttcggttaaacagcctttcaacacgctgctgaaactcatgaaacttggaaaacacctcagacttgttctttaagagataaatccaagtaaatttactgaaatcatctatgaaactgacataatacttcctactctcaacagacacaggagcaggtccccacacatctgaaaacacaagctctaaaggatgacttgacacactagaggacttgggatagggaagctgatgacccttggcctgttgacaggcatcacacactcctaattcattaatctctcctaaacatgggagtttattattgctaataatcttttgaacaatagctagagatgggtgacccagacgactgtgctacctcgaataggtaggcttgacgactccgaggacttgcttggatgaggaaaacgaagatgttggcaaagggtacaatccattgcggcatggccatctaagaagaagattcctcgtgacctgatccttgatagcaaagaaacgtgagtgaacttcaacaaaagcgttattatcaacagctaggcgatgagcagatatgagattctttttaacttttcgaacatggaggatatttttgagatgaatattgcggacaggggtatgaataatagaatgaccaacatgcttaatatccatacctgcaccgctcgccgtatgaatttgttccttgccattgtacttttcatgagtcgtcaatttttccagcttgcctgtgatatgatctgtagctcccgtgtccatgtaccaatttgtatctacaccataggatgccacagcagctattctggagtctggaacaaaattttcaacgtacctgtgccaacaatcggccaccacatgaccggtttttccacagagttggcagatggggcgtggtctgttgctgaagccacgtgcgcctccgtttcctcggccccgaccgccgcgatcgccacggccgccgccaccgcgcccgcgagatacgttagcgatattgttgttgaagccggtgttgttgttgaagtttgtggagattatgggtatcccatatctacacggcgacggtattcgaactgggtacaagatacctaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccgtatataaggggggtccggagcgcctctaggggcagatgttgatttttcccgaatcatacaattaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggtcctttttccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctacttcaagaccatctcacccgagtcggcttcaaaccactcggccgagatcgcatcttctccaacgataccagatcaagatgatggggcttacccaccggtcctgatgaagctccccgacgatttagcggccgtcttcaccacgacagcgccttcatcccgtaggcctaggcggaagtcggcttcaacaccgatttcgcctagcttcagggaagtcggcgtcatcctccaaccactcggcacggtttcgacggaccagctggatgactacaacagctctcccaccgtcgactcacgtcctactgacatcgtggagtacgacgaatttagttctcgatacaacgacttcaacgacttcgacgacttcgacggaagcctagatgacaactacacccctctctactttggcgttttcatggccaataatgagacggaggagcaacgccaagcccgggagaccgaagaacgacgccgactggaggaggagcatcaagcacaagaacaagaacggctacggcgcgagcagcaggaccgtgagcggacagcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaatcagacgaagaccatgattgcggcaacggtcccagttaactccgaaagcgtccacacgccgactggcagccgggtcccccacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcgccgcgacgacgaccttgacggagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatctaccggtggctttagcagattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcactgacgacgtcatcatcgccgcattcaccaaagggattcgccacgaagaattggtcggcaaatttgggcgcaaacctcccagaacagtcaagctcatgtttgaaaaagccaacgagtacgccaaagctgaagacgccgtcaccgcatcaaagcagtcgggcccagttggaagccgaaaaatacgccggctacgggaggaggtggaagtaacaatcataaggaccgcaagcgtaagcctgaggaacttgttgcaaccgctactcactcttctcgacagcgttcgcgcgtcaacaccttcgacaagatcatgaactcccaatgcccgcatcatccaaattccaaccacgtggccaaagaatgcttcatctacaagcagttcgcggagcagtacaccaagtctacccggaagaactccgacaaggaacaaagcacgtcaaggaagaaggacgacggcgacaccccggctggatttcaagaccaccgcaaggagctcaaccatatctttggcggccccctggcttatgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggtactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattacactgacctcaacaagtctgccctaaagatcccttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgatacgtcaccatgccgttcggactaaaaaacgcaggggcaacttatcaacgcatgattcagagatgcttctcaacacagatcggccgcaacgttgaagcctatgtggatgatgtagtcgtcaagaccaagcaaaaggatgacctgatcttggatctagaagaaaccttcgcgagcatccgcgccttcaggatgaaattgaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtga

SEQ ID NO: 58446 - DNA, 3863 bp, Oryza sativa
atcctgctgcgttaggagatggatgagattgtcctctgtgtctttctcgtacttgtcgatcatttcggtgttgattttccgagggtcgatgaacccagtatcgtaaaacccccgccatcgggccctgtgaatctccattctacaatgataaaatgaaattattattgtttacatatatgcaaggagctagttattgtacgaaacaaatcgaactcaaagatacttacaaaatccatgcgctcagaagagagacgtcaagggcgtccagatggtacagatcgaagacatccttgaaatggatccagagaacatcttctccttgcaagaagtcggggtttctgatcctcgctccgaacatctctttacccttggcgttcatttccatgtaccattcatggaatttgtacatctgtgtcggtagggactgcagctgctcaggcgtgacaagcggtttaccgagttcaaacttgtatgccacttccgccttcgggattggtgcgattcccaatcagctgatccatagttagaccggtgtctgaaatgaaatccgttatgccaaaatcttcacctgtcaccaagggctcgacctcttggtttggttgttctccaagctgagggactggtttggacttcttgtgataggctttctgaagtgttcggtcatagtccgatagctttaaggcctccttgtttgttgtggacattcccttgaagaagtttttcacgctcgggtcaatagttatcttcttttcaggactccgaggcttgagttgcctctttacttctcctgccacataagcatcaagctcctcttgactgcaatcgtacggcggctccctgtttttggtggcgtcaactttcgccttcttcgttgcccttgtgcgggcatgcggtggagcttagcgagaccttgtcttgggaggtgcaggcggacacggtggagatggaggaggcggaggagccagaggagatggtgcaggaggagctggcggaggagccggaggagatggtgcaggaggagctggcggaggaaccggaggagatggtgcaggaggagatggcggagccggaggagattgtgcatgagacgccgcttgtcgccaagggaggatgatgtactgcttgcgccatagtataatggcgtggcttgtgtctcgtagatgcgtctcaccgtctcctcctgggtagtccaactcgagatcctcgtacgcggcttccaccagctcaacctcgaccctcgagtatcctgctggaatcgacctgcagtggtaagtccctgaaatgtccgttgggatggctatttccgacgccaccttcacgtgatgagaggttatctattagtaatcaacctaagcagaaccttgcggaatgtacaagtcaaaaatcataaaactacgagcataccttgattgataagttcttgaagggaatatgcagctcacatggtgtccgctgagtgatgtcatcaacggggcaagtggtttcatcctgggtttgcatggcgtccatgctctgtgatcctacctgccccgttgaggcgcaactgctacgattgcctgatgggctaaccattgcaggaggaatgtacggctggggattctgggaccgatgtgcggccatgcattcatccaccttccttgccacctcctcttgcatgctgagctcgtagctcgataccctgtactcaagatttgcaatcttcgcctcgatatctctcttactcctcatccaactcctgtacgtgtggatgtcctccttgaatctaatcttccagggaatcacgcctttccctcgtgttcgtcctggatgctcgggagtctgtagggcgagtgacagctcgtccttctctctgtcgtgtcggaatgtgccctgagaagaggcttccactgcgtccgttagttgactggtagcctcgcatatcagatcgctaaagacaagggagccatcaactgggttaagcgttccaccgtgagcatagtaccagaacatcgatcgattcgcccatttagcggtggccggttcgatactcctctcaatcaatcttgcctccatctcctcccacttcggcattgcgacgctatagccgcctgaccctaagtggtgatggtacttcttcttggcggcattttctttgtttctaaccatcatcggttgcccttgttactctgtcttgtaagcaacgaactcgtcccaatgatcccttagctttgggaatacgtcgaagttcggtgttagtcccttcaggatgtatttcttgtagagatatcccttgaagctctggaactattctgccattttcttaagagtccactgtttcactatgttctccgtacccgcagggagcgtgaacgtctcgagcattgtggtccacatcatctctttctctgattccgggacaaagctgtcattatccccgcgtgcccttgttctacgccagtacaccatgctgacaggcacgttatccctcacaacccaaccgctgtggcgtacaaaattcttggctgcttctgccggggcactaggtcaaccgtcttcgtccacctcagttatgatgtgccgaccctctatcttcttcacggcacctcgttgtccgcgtgccctcttctgtccagcggagggatgacttccactagcctcctcctcctcattcccctccgcatccctctccccgttcccctcctcattcaagtactggtttggaacctcgttcccctcttcttcgatccaatactggctgcttccctctgcgattatatcatatagtatctgttcctcattgcgatcagccatctgttcgtacaagaaatatttgctaagtctataggtcatatttgctaagcgtaatattaaaactctactaatcttatattaaatctctaataatcttatattaaaattgtaataatcatatatgctaagtctaacaatcttatattaaatctctactaaacttatattaaaattgtaataatcatatatgctaagtctaacaatcttatattaaatctctactaatcttatattaaaattgtaataatctatatgctaagtctaacaatcttatactaaatctttactaatcttatattaaaattgtaataatcatatatgctaagtctaacaatcttatattaaatctctattaatcttatattaaaattgtaataatcatatgtgctaagtctaacaatcttatattaaatctctactaatcttatattaaaattgtaataatcatatatgctaagtctaacaatcttatattaaatctctactaatcttatattaaaattgtaataatcatatatgctaagtctaacaatcttatattaaatctctaatacaatatgataagtctaataatctaataatctctaatactcacatttgctaagtctaataatctaataatctctgacactcacatttgctaagtctaatacaatatgctaagtctatcacgaatctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgtt

SEQ ID NO: 58447 - DNA, 5904 bp, Oryza sativa
cctgcattgacgacaatatgatggcatatcgacaagaggtacgcaagttggaagacaagttcgatggactcgagcttagtcacgttcttcgacacaacaatgaagccgccgacaggcttgccaactttggatccaagcgtgaggcggcgccctctgatgttttcgtcgaacacctttatacgccgacggtacctcacaaagataccgctcaagttgcgggcactcatgatatcgctatggttgaagccgactggcgagagcccttcatacgatttttaacttctcaagagctccctcaagataaagatgaagccgagcggatttcaaggcggagcaaactttatgttatgcatgaagctgagttatacaagaaaagcccttcaggaattttgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttatacgcacctcttcgtggccattgacaaattttccaagtggatcgaagctaagcctgttgtcacgattacagcagataatgctcgagatttcttcatcaacatcgtgcatagatttggagtgcccaatcggataatcactgataatggcacacaattcaccggcggagttttcaaagacttttgtgaagattttggaataaagatttgttatgcctcagtagcgcacccaatgagcaatggacaggtggagagggccaacggcatgatacttcaggggattaaagctcgagtttttgaccggcttaaaccctatgccggcaaatgggtgtcacagttaccatcagtactttggtctttgcgtactacccccagtcgggccacaggccagtcaccttttttccttgtctacggggcagaagcaatgttgccgagtgaagtcgagttcgaatctttgcgcttccgtaatttccgtgaagaacgctatgaagaagaccgagtggacgacttgcaccgactggaagaggcccgcgaagcagctttgattcagtcagctcggtatttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcactgtatttccctatttttgactgtcaaacatcaagttttttccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggctggaggtcgttgttgcgaaattgctccacaacatcactcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgtcatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggctgagtccctttgcgcagccagctctgtcttgtctctctccagggcttcaatttgctccgccatctgttccaccctggcggcttgcgctgtttgaaatccagatggttgaggatgcaattatgacagcataaatcaatggaatggatctggatgattaccttttgatgaaccacttagttcgaagtttgcatcctggagctgggcgattcggtcccttaactctttctctgtctttttggcgcactccttggcctcatgcagctggtccctaactgcttctagggttcccaaatgaggaaccagcttttccaaagttgtagtcttggcctcattgcgaagatggattctctgcatgatggatcgtggttcagttctgctaaaaagaaaataaagttaccgaaggccgtcactcggaagacttacatttacaatacgagtggcttctccgagcgctttcttcagctggcacacttcttcatcttctttttgacggtttatgactatgccggcggcttgtgagttctcgtcctaccatttgatcaagataggaggacgagagtcgtcggtcgcctttatgcgagggatttcttctccgtcatcacctgacggtcctgatgtgtttccaagtcattagacggatacactgaggttatttaaatcgccattgtttgagaagacaactaacctgaagatgtacctagctgagcgtgaggtgatctttgttctttacctgaagacccagctatcgagtcattaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggatcggccctatcgcccgaagcatgggcaccagtcggctggctttcagtggtcggctggttttcaacagtcggctcggggtccttggatatattttgctctgtcatgccaggatcggggtcttttccagatggatctatatcagatggtttcctgcagagtgttctttcagtatttagcattatcttcatcggaaaacatgccgaagcggaaatcataccgagagatctaatacctggaagatgttctgatctttggcattgcacggccagctagttttttcctgggcatggtgcgctttgggggtttattaggcgagcccttatccccagatttatcatcgtcgccttcatcatcatcaagtaccagctttctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacagtttgagggtttctgatacatacctgtggaggcggattgaatgcattatatggcacaactggcagttgatgagagtagctgactacaattgcatttgagaagattttatacatcctctccttcatgattttgaaatccagggaatctggttcttcacggttaggatcatgtttgccgtcgaactcgaatgctgtgcgggatctttccttgattggcgccagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccggggagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgtcgcttggatatcggatttttcagttaagggtatcggaggtgctaatgggcctaggcctgaacagtactttagcccaatacttttaacagcgtggcccattgtgttccttagggacttaggcatattttgctttggcgatattatgcacacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggttaactaggaatgacttgtttttattatagtcatctccttggcgtgttatatgcctgttttcatggtaaatagtcatggcctaggctattcgacttattattaccatgatctttataatacttgatgggtaatctttagagtttttatattcggatgcctgtcgagtgtgttcattcgtgaaccttttagagtgtaaaccactcggatttcttttattgcggctaaaaagcagtcggctagcatgcctatttaggcgccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgggaaggctacgatggtcgactgcaaaggactcgggggctactgtggagattatgggtatcccatatctacacggcgacggtattcgaactgggtacaagatacctaatgtagatagaatatcttatctgtatctcgggtttgtttcttaacttgtgtatcaaggaaacaccctagacttagtcggttacaa

SEQ ID NO: 58448 - DNA, 1729 bp, Oryza sativa
gcctcgccgccgctaccgctcttccacccttcctcgctgccgccgcccatctgccctgctgttgacggccgttatcgatcagtctcgaccatcaatactaccaaaataggagaaaactagtgatgcttgcaatgcattaaaatgttagagtaataatattccactagtattaggtttactaacattttgcagagaatgacaataaagtgaaggagaatcgacgtcaacacaaacgataaatcaatcggacgatgtcgacaatcagacttatgtatgaatggccaagaactcagaattgacatgatgaattgggccaaaattcacaagtctgcggagtggagcaataaaggaggccaccagccgaaattgggctagattgggccagccacaggttcggccgaaccaatcctggagccgttggatccaggttttggcgtggacgtccaggattgcatcccaatgacggttggaggacacttcggacaattccccttccacaaccgtcataactacctctatataaggacttcaccttctcacttcactcacacacctgttgacgatgaaatttggttagcccgaagtcataatcggcttagagtcagtatcggcttccgcatctcggaattagccgatgagaattatcaagtcgctaatagccggattcttgctatattcggttaaggaaattaatctattaaaggaagtttatctagaagagaccgagttcaaggaggatgcggcatggcaagttatctattaattaggaatagtttgttagtttccttttatctctaggaaagtatgtttagtgtccgataaggactatgtgttttccttttgtctttaagaaagtttctttcttgtcctacaaggaagagtatctacccatgggtataaatatgtacacccggggtcattgtaatctatcttcacgatcaatacaattcggcgcatctctagccatctttttgactgccaataagggtttcatcggggtttcagccgataagttatctggacgttgtatcggcttataaggatttcatatatatataagttgaatttagccgatgacaacaaaggtttcactgtttaatctaatctgtggattttatgacatcggacctccagccgatgtatgctttaaccttcggattgatgcttatttatcatatcattgctagccgattggtttatactagattatattgttattttattacatcatcatcagccgattgcctttatatcattatctacattggacatatagccgattgcttaaaccctatcgctaccggctggtatcggcatcggctatgatcggctatcggctggaactactccatcagtttgtcagccgatcggctgttttgtctattatttgcatatcttgtcagttgcaggatcaaactgactggcacgcccacatctcatcaacctttcgacctgcattggagctaagcagatctcccaggccggtgtgttcaattttttcgtcaacacgaattggcacgcctagtgggaccacgaattttatatccacatatctgaagaagaagtcaatgccaagattgtggtcacggtggagaatttaacggaggaacaataatatcggctcggggggcaagcgtatcagtttcagcatggtggagcacatcagtatcagctcatgaaagccgattacaagatagagaaagaagggaatttcgaagcatgacttctc

SEQ ID NO: 58449 - DNA, 10438 bp, Oryza sativa
cgatgttttggcttcgtacggcggtccgccgtatgttcaaagtgcttgcctttcttccgtactaggtggtttgctgcaaggaatcgacgatgacccatgtacacaaccttcctacagtgcttaagatacgtactttctgtttcatccatacagtgagtgcaagccttgtaccccttgttggactgcccggataggttgctaagtgtaggccaatcgttgatggttatgaacagcagcgctcgtaggttaaactcctcctgtttgtcatcgtcccacacggggacaccttccttctttcacaacagtttaagatcttcgaccagtggttttaggtacacattgatgtcgttaccaggttgcttggggccttgaataataatcggcatcattatgtacttcctcttcatgcatagccaaggggggaggttgtagatacacatcgtaacgggccaagtgctatggccgctgctcatctgtccgaaaggattcatgccatccgtacttaaaccaaaccgtatgtttcgtgcgtcctttccaaagtgtttaaattttctgtcgatgtttcgccactgcgaaccattggcggcgtgtctcagcatcctgtcctgttgacgctcttcagcgtgccaaccaaacaccttagccgtggtattatagggaaataccacatcaccttagcaggaattctcttcttcgttagctgcccgtcaacttctcctggatcatctcatctaatcttgtatcgtagtgctttacaaacagggcatgcttctaggttctcgtactcctcaccgcgatataggatacaatcattcggacatgcgtgaatcttctgaacttccagtcctagagggcagactatcttcttagcctcgtacattgtctcgggcaacttgtttccctccggaagaatgttcttgatgagtttcaataaatcgccaaattccttgtcactaataccattttttgccttccattacaagaactctagagtggtatccaactttttgtgcccctgctcgcaacctgggtacaacgacgatctgtggtcctctaacatcttgtccaatttatgggcccccttttaactttcgcagtcctccttggcgtcctgcaacatctgaccaagatcattcgcaacgtcattaccatcagcatccctttcctcctcgcccgtttgatttccttcgaatccagcgtactgaccgaagtccggaatattgtcgttttccacttcatcttcttccatttcaaccccttgctctccatgagatgtccaacaaatatagcttggcatgaaccccgactcaaacaagtggaaatgaatagtcctggatgtagaatactccttctgattcttacacttattgcatggacaacaaataaaacccttatgcctgttagcttcggccactctcaaaaaataatgcacgccgtcaataaactctttggaccgccggtcagcgtacatccattgccaatccatctacatgaaatgaaaacaaatcgtacacaaataattattcgtacaataatgacagccatacaataatgataaaatcattacaaactctgtcaacagtcataaaataatgacatatcattattcatacaaaaattataaaatattacatcaaataattcttatttactatttctaaagttttaaactaatattaatttgttgtagttcttttaattttcattttagtttgttttctattatttaagattaactttcactattttttccttctcaactattttataaaacctttcaaataaactaaatttctatatattctttctttcccatacaaattttctctctcatcaacttacaacaaaattttggagacaaaaaagtgtacaaaacatagctccaaatgtaatatgacaaaaaaaacattagaggatgaagttgctaaccttttagccacctccgatttgtatataatcaccaaaataaattcactcgaaattttggcatgacctcttctcttttttgaagaaattttgaagcttgctcgggctggaggaggaagaaaaggggtgggactttagtcccggttggtgttatgaaccggggctaaagatcgccgggatctttagtcccggttggtaacaccaaccggtactaaagttatgatctttagtcccggttggtgttacaaactgggactaaagatcccggggggcctgacaagccctgatagcatttgaaccgggactaaagaggttggtgttaccaaccgggactaaagatcaaatatgcccgttaccctttttaaccgggactaaagatcatctttagtcccggtttttattgtaaccgggactattgtggaattcggccgaccgacgaaagatggtttctccaccactgatactatatggcctacctgtatatggcctacctgtatatcaaaactcaaaagtggactacattgcctaaatgtcgtggtcgtggtcgtgggtgttacggaatattatctcccagggagataaagatcctttcttgtgaaccaatctgaatcggagtagagataaggtctatctcatcctaagacccctatatatacaggggcagggtgtgacatatgaggttggcttgtactcagaagagatctataatgaagagagagctccaccctatatctgtgttcattgtctatttctgcaatgtttttaagggtaaagggatgggcgcgggtgttctacatcatctcacgcctctactgctatgggagtaacaggaaacggatccggtgatccgctaataggcgcgttggtttacaacacgttatcaacagctctccgttcactggtttgttgctccaatctgttattattattagattggattttaatgattgattaatctcttgatattttcgttgtttgcatgcactaccgcgagaggtgctaccgacgtgatactggtcggtcatcgcgttgcgctatgctaagaggagttgccgtccgtggtcggcggacgtccgtggtcggcggacgtggttggaggacggcgttccagccctgcaagacgcgagccgtgcgcgcctgccttcgccgtgggcgtcgattctcgccgtcgtctgcgagacttcacgtcaatccagtcggcaaaccccacaactgcatgctcgtgcgccgctgggcgatcagccgatcaccctgtgactcgcgtccgccttcacgtacggcgttggcagcccgcgtgttaccgtgccggcagtgccgcacgtagcggcatgcaggatcgatctatatgcatgccacgcatgaacgatcccatccatgccacgcatggcctgagtcggacgggcctgcaccaagcgggcaagcggccaacatgcatgatgcatgcactagtgagcagcctagcatgcatatgctagggtttgattgcatatcgttacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttgttgccgctggagttaatgctgaagtgaggcgccgccgccgttgacctcccatcgacgctgccgtcgagccgtggtgggaggatgatgggtcattggttgcctactatcggattaatctccgccgagacgatatggccggatgcaatttgtttgctgttgttggggtctcagttgctgtaacgccccgacattcgttagccataaacacagctaattcacaccgaggtgttatgcattacctgtgatatagtaccagtcccaggatacactagcttttacacgcagaataactgtggaatcaaagaaaactgttttattacatcactgggtagtagtccttacataagttgccaccatggacaggtccatagatgagcaacacaacattacagaaaaccataaaagcgacgacgcagaagcgaacagcgcggagaactaagcgactagcgaatagcgcggagaactaagcgactaagcgactatgcactaggcaaagaacctaggcaactaacttattccacaggcgagctttggggctaggcacgaaacatctagaagtctgttgacggttcttaaatcataatatctgaccgtcattacctacatataatgaaataaaacatggtatccaacttagtggtaggtattattactaatcatttccactagtgttggtgaaatatgtgtatgcaggtattttgagaagaaaacacatccgtcaagcaacaaactgcacctccgcgcattcaggatacatttacacggattggaggccccataagtcaagtaaacaactccaaatgggcccaactatcatgccaataggctgagggtctcaaaattagtgtccacgataaaaaatgggccgaacggagccgtctcgagttcggcccgaacactttttgtggccgttgatcgtgagattcgatgtggatggccctgatctcttcctaatgatggttggagggtagtttggtcgtttcccatacctgtaaccgtcatatggaggctataaatagagctcctctcattcattcacaacacacaactttgagctgaattacaagaggctcttttgtatcttttctacattagaataaggtagagagtgagggcaagctctggaggagtgcccggaagtttggcgctcatccgacttctacctcgacgagtgtagcttcctaggaggaattctggaggagtaccggagctgtcggtacactctgctccgggttcggagaaccttcttctattaagtaagcattcgtgttcctttcttatgttatttaattatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacggttgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccttctctggtagtatcggtgaaaacccatacctctatcttcgggatcttgagctagtgtgtttgtgcctatccatcgtaggcatgacacatgaaactctaaagtggaagttgtttcctttttctcttagagataaagcgaagcaatggtacactatgtctgtcaagaaattccacggtgaatgggaggagcttaagtgcaatttctgccttactttctttccattaacccgtgtaatcaatcttcgattagacatcctttctttccgacagaatgagaaggaatctctcggtgcagcctgggccaggttctcattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatacactatagattattataaggggcaagggtgagtacttaacgtactcagcaagccaggggaaagaatgacatgtcggtttaacaaggaggctaggcttttatttgcgaaagctgcttttttggcaaagtgatttatttcacaaaactcctaatgagtgagtcaagttttagttgtcgggaggaggctcacgcctcgacccatttcacaagttgctttgcaacaacttgtcacgattaacgaacaacaattaatttgtttcttctattagcttcttctcactttcacaacaacacatagtccacacagacatctcagcacaacaacgccatcaaggccctaacaacacctcggtgtcggacgacaccccaggtcacatagacccgttgctaaccacccaggttagccgtctgccacacaggcggactctggaaacgttacccttcccaataaccacttcttcacaaacatttgtcaaacaaatctacgctatgagaaacaccttacacttgcccttgaccgtgggcacggctgttcgaacagttcattaatctctgcagaggttgcacgctttacccacacgagacgaaactgacatcgtttacccgtcggcaatgaaagttcgtgataaggcctttccaaagctaacccatgaaaatcgcatgccacctagttgggctaagatccatagccgagtatcaggcaatgatagccgtcatccactcaggaaatactgaggatgcctcctactcctactggtaccacgccacaatagaagcaaaaagacacccatgatgggcaaaaatgtgtaacacttcgtctcctcatcctcggcatcccacaaccattggcacaccaactcccatgtgataacaatttacttagccagaggcatcccataaatacccgtgtggtcgcactgtaacgtgtttggatggatttcccaaaggaattggtccttaacgacaatacgtagccaaaccacaaaggcatgactccgcatcatcaccactttcacaacacattttatttcacaactactcagtacaacgtaccggatttttaaacatgtatttggaataacccaagtttcccacatggcaaaacctcggtaatcgtataacaataccggcacaaatatttgtggagctatcaaatgtatggaatcatcaacctatgaaatataagtacgactactaggttggtccattggttgaataaacaatccgaggcctaacatgttaatcgtgtaaactaaataatgcatttttgcaaacaatgtatcattgaaaatataggggtaatgtgatcaaagaggcttgccttgcacagggtgcgggtcttctccctcgaaagcggcgtccgaagcttcctcgtacttaggctctaaacgtggaaacaaagctaattaagaaaagccaataaatctagctcaaatcagagaaacaatagtggcactgtgtagatttcaattttagaaaaatttaggaacttgaacggggtcaatcggagttacggttgattttctacgaatttctaaagaataaaagaattttctggaataacaatttttggacggtaagggaatattccgttggaatattccgttagctgggacggcagaagaggggacccacctatcggcgatggatgggaggaaggatgcgcgggcccggcttgtcagtgggggatggaggtaaaaggggcatggggtcagcctgtcagcggctcggctccgccttcttcttcctcctctgctcttttgctcggctcggtctgggatggcgacgcaccgcggcagcgagtcccggctcagcgaccggcggtcggggaggcggcggcgaactccagcgaggcaccgccggcaacggcggcgctaggaggcgcggcgcagcggctctaggcggcggtacatagagtgaaatcgtgagaaagagatagaagagagagatggtgatggtgtggggagaaggagctcgggctgcttccccttttataggcgggcgacgaggtggcgagctggcagtctaggcgcggagctccgggcgtagacggctagcagctagggcgggatttcgagacggatgagatggtgaggcgacggcgatgcgacgacatggcgtcatgcgctggtggcaatgcgacggcgaaacgaccgcgacgcgacatgaagtgacgcgcggagagcgggaacggctgcgagacgtggatgacgtatggccgacgacgactagggccgggatttggggcggtagggatagagaggggtgacgcatgcagtggtggcaatggaacgcgagagagagggagagatgcagccacgtcttagcggataagctccttcgcgtcgaagtaaacgagaacggataagcaagggcgattggataagagaatgactcagcctagggttaggggtgacgaagggtgaggtcgcggccgttatctgttggcgtcgacgcaacagcgaagggaaggcgacgcgatggatggagttaaaggcgacgggacggggtgacacgaggcaacgtggctccgtgtctcccggaaagaaaccggagcgaggtcgggcttggcgcgacgcggatttggcgcggcgcgggtgccggctcggtgcgggggtggtgtggcgcgggtgttggcacgacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcggtgagttcggctcgcggcgtcatgaggatgcgcgggttgacgcggagcttcgtcgtgtgccacccagacgtcggcgcaccatatggccacacggagtgatgt

SEQ ID NO: 58450 - DNA, 12172 bp, Oryza sativa
  unsure (1)..(12172): unsure at all n locations
ggagagatgcagccacgtcttagcggataagtcccttcgcgtcgaagtaacggagacgggataagcaagggcgattggataagagaatgactcagcctagggttaggggtgacgaagggtgaggtcgcggccgttatctgttggcgtcgacgcacaagcgaaggaaaggcgacgcgatggatggagttaaaggcgacgggacggggtgacacgagcaaacgtggctccgtgtctcccggaaagaaaccggagcgaggtcgggcttggcgcgacgcggatttggcgcggcgcgggtgccggctcggtgcgggggtggtgtggcncgggtgttggcacnacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcgttgagttcgcctcgccgccgtcatgaggatgcgcgggttgacgcggagctccgtcgtgtgccaccgagccgccgccgcaccatattgccacacgggagtgatgtcgtcgccgccgtcctgccaatcaggtagtggacgggtcatcgatgacctcctcgccgtgtgccgccctaactcccttcaaagtcgacagacgacggcctccgacgctgccgccgtgctcgaggggccggtgcaccgggcggtggacaccgttgcagacaatgaatgggaaaggggaaacccaaattccccccttctcttgctcggtcatttaggcttaccagttgggccggtctacctccgcctgaccgaataaagcccaacagtaacgagacagcccaaacaaattaataaaaataataaacttggaaatcctcatgggcctagagtttcggaaattcggcccattaggcattttgggctacactgtgcttgctagcccaaataagatcatggcctgaacggtaattcggcccgattaatttcggtttattgacaacttgcgtttaagcccccagagtgctgggtttttacgctatagttcactgtttaatggaattttacagtttgaaccttataattaacaagagattatattaattttatttgtgtggctatgtcttgttgcttaggccctgtatagtttggttttgcatgtgggtctccggactcgtaaataaccatgtaatggtgttttttaagcattgctttgcttttaaaattgatgcaattccaactaaataatctggagatggttttctaggttatgatgcttccataaattgtgttcatatagtgtagaattcaacccttggaagcattatgatgggtttattttcctgcatttatgtgtgatggttttctatgtggtataaatattgggaatataatgccaaataagaccaagtaaataatagaaaatcacttaatgcatggaaattctaggaaattaaatatccatggctatggataagaccactctttactgatacactcctccatacataaatggtgatatcgatgtgtctacaagatggagtcacgtatacttgttgttgagatccatgcttttgccgaattcactgcgcatatcatctacttgcgtgctgcgttctctgagaactgcatgaaacgatttggatgatagtgtgggtgatttcatgtaaaggccttcaatgactattgtatggctttgggcattaatatagatcactctatccctatgatcacactcaagaatgggattctgagtcattgaaatgtgtggaataagacaatgtgtttgggattcattgtgcctttcccctactggcttaacatctcaatcagagtatggtcggactacggtcgacattttgctttcccaatggttgagagcacgcttttctgatttggagataaatgattatacctcaattctctagcaacgtggagttgcgaggttcaatagtttgagatatttttcactcggtctagtgaaagatgtaaagtgttttccaggtggtggaatgacactgttcgtatggttgcccttggtgtgcacatatcttctcactattatttggaacctgatgtcttgcgaggacaccggaaaattggatgcaaatctagtggaataagcccgagggtagatgctgtgaataggcatgattcccactccactatagcgccaacagctaaacttgggtgttgacccagtcttggtcctcgcatggatctagcgctaatgaccacctttggttgatgccgatggttggtggtgtctgtctaataagttgttctgacaacgggagttgtattgctagtttagagcatgtcctaggagaacattggtcgactatactgttgccaagcagtttatcttttgcttagtttggaactttgtattagatcaatatttctcagataaatagcgttcttggtctttcctgttctattctaaagcttatcttcatgctggaattgataaaatgctttagtttagaataacaattagtgtatgatccgaggagttacaaccacttacacagttcagcgtaactgtatttcaaacaaatgttggctatgcactattgcgttttatcgcgctctcgtagttgatgactactccctggttgtgttggttgatcacccatgggttgatgaccatgcttgtcgcacactggcgtttttcgcgtgtggacatgtgcgagtcatgcaaaggttcgtcgtgttgcatgcgttgagcttgttatgccaacgacggttgcaccgacacattctactatttttgtggatatgtctgaatataatggttttattgtgaatattaccattgttggaggtattgattatctcccaatggctatgtctaggggatattagcaaatgtggtttgataattcgctcgtgcatcatacctaatacatgctgcttaactataacccaattctagagtttggtatgagtaattggggtcaaacttgggcattaaacaaactggacattaacccaactctgcaccacaaaaatctgcttggcagcgtaggctagtggccgtgcatttttgctatcatactccttgtcgagcgcatcggaatgcgttttgccaccataggttgccttcttaagcatatgacatgggatgtctaatgcacgtcgatccggaatcgattgtgagtttgaatggcacaaggtgagcattaatccatggagattgcatatggctaaagtatttgcatgttggttgcatatacatttggtagcaatagtggtttttgcagacttgtatatcctaactaggaggttgaggataacccttcggaggaaggaagaacactgtagtcatgccactgtattggtatatatccaggctcactttaatgcaaaaatctctccgattaaagtgcataatatttcccaaatatatcgccaccgtagcatacattcatgggagaacatttgtgatcgaggtgaaattcctaaatcctatgccacgatatggggattggtagtatgctattgtaagatatctcggcattagggggagagaattgcccattttggaatgcatgtacatttctttgagtgaacgcactaaatgagctgaatttgtatgtttagttcatactcctggttgcttggtgcacggagtttttgccaacaaaatcatatgaggaacaactggatagttgttaaaaagagtaatgctcccaattatggtaaatgtggatagacccgggaataatatcgtatccatataagacttatggaatttgatcatgttatgtgaggacgcctgctaacacgatccgtgggccttagtcagagcataagagttctcaccggatgtgagcatactcctctgattctcctagtggagaattcaccttcggaaggtgatatacctcataatgatgttcgtcgtggagacgacattcctagcaattcgcacatattatggtgctaggaatatggaacaaccatggatcgatcgttttgggaaatgacgaagatctggttaaatgtgtaagtgggaataaatgtgtcgcctcttgctaatgattctctgtgagagaacccggatctggaaaaagtccatggcatgagcatgcgatgctcaaatcgggtcaaatggaaatgcaattgaggctgaaccgaatcactaagtaaaagtcgcgaatgttgttcggatttttagggtcattattgagataatgaggtggtgatgtgcaatggttcaagtaggtccttgatgagacctctcccacgtaagttgaatgttccgctaaataaaggtattggcaaaatggcatgaaattaaatatgcagttaacggatttaggaaatccgtgaggtcttgaatagactccgtagtgaagttgcagcatgtaaatctcgtaccaatgggtattctgataagagtaccatttcccgttgggagaaaatctcattgatggatttttctctgaggggagacctcattgatgaatttttctctgagatacaaaataattagtaagtctgaacacaccatattgtataatcccttggagggattaagacccatttatgacccggtaagattgcgatgaggaacctgctaaggtatacttagtgttgttggctatgtgttatctcccatagtgcttaaattttcagactagctagttactctgatagttacaacatatctttggaaggcttgtagttgatcttgtggatctccaattgttgttgacatcgtcagagaaagttgcaatgatcaagagatgtgtttgcttggcacgtggcctaccgatgaataatgcggtcgagagatgtgtttgcaatatggggcgagatgttgccacaggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaactttgccaataaatggtataattgaaaatgacaacaatctgaaaagcaccttcttgtaacctgaaagaagggagtacaagacaatacaccatgtacctatagtacgtatatagcatatgaaacgatcaaatgcctatatattgttgcttatcctattgctaccatatgatgcatcaatcaaacaaacaatactacgctttcaggttaaatatttctctcacacttcatttgattactcgtttgttgatctcaaataatatattggatcatacctgtctaacaaatttgccggtcaattcaggtctttgaccaatgggtttcaatttccatccggtgaacgacagcgactggttgatcagggcggcgatgctgctgagcttcaccctgcaggtgatcctcgtctttgtcgcgcccacgcgcaagcgctcctgccacccgcttccccacctcgccgtctggtccagctacctcgtcgccggctgggtcgccgtcgtcggcctcggcctcctcctcaacagcctcagcatcagcggcagcaacaatgggtcctcctccatcttcgccttctggacgccattcctgctgctccacctcggcggccccgacaccatcaccgcctactccctcgatgacaacgagctctggctgcgccacctcgccggcatgctgttcgtggtcttcgccgcattggtcgtcttcttcagctccgtcacgagcaaccccatggtcacggccaccgtcctcgtcttcgtcgccggcgtcatcaagtacggcgagagaatctactcgctctactccggaagcgtgagaggtttccgcgacaagatgctcggcgagcctaatcctggccccaactatgccaagctcatgacggagttcgagtccaagaagaacgccggcctgatggtcgagatcatcgtcgtcgacggcgagcacaaggaggcgctggagcaggcggaggtgatgaagaacggcaggaagagcgtggagacgatggcgtacgagctcttcgccatgttccgggtgctcttcgtcaacctcgtcctcagctacaaggagcggaggatcagccaggcctacttcctcgacctcggcgacgtgatgacggccgccgcggcgttcgaggtggtcgaggtggagctcggcttcctctacgacatggcgtacaccaaggcggccgtgtcgagcaccaggagaggctgcctcctccgcttcgtcgccacggcgtgcctcgtcgtcgccgtcgtcctcttcgtgctcatggacaaggccggcgtccgccacgtcgaccgcggcgtcacctacgtgctgctgcttggtggggtggcgatcgacgtggccgggtacctcatgctcctctcctccgaccggacgctggcattcctcgacggcaagccgaagctagcttggcttgcacgggtggccagggccgtgcggctgccgacgaggcggtggtcggagcggatcacgaagatgaacctcatcaggtacagcctaagcaagcccgaggaggacgccgcccgccggtgctggtgctgcaggtgcacgacgatcccgcgcgtcgtgcgctgcctcgcctgggtagccgacatggtgggcgtgagggagatcttggacgacttcttcttcatccggcacgagccggtgagctgcaggaagatcaaggattccaacaaggggaagaagtccatcgacgtcctcaactacgtgttcgatgggctcaggaagacggccaacgaagtaaggtactccggcggcaacgagatggaggaggtctgcgactaccgcggcggcgaggggataatcaatgagctcgtcggcgacatccagctgatggagctcaacgtgaacgacgtcgtgcgcgaaagcgtgagaagggagttcgacgagtgcctgctgctgtggcacgtcgccacggacctgtgctcccaccgccgccgcgaaatggaagtgccacggaacggcgacatccagagcttgatgtccatcagcgagaccctgtcggagtacatgctgtacctcctcgccaggcgggccggagatgctgcccgcagcgacggcgacggccgccgtcatcgggctgctccggtaccgcgacacgcgcgccgaggcacgccgcctcttccggtcggcggcggcgtgggaccccacccaccacgacgcccagaggatgctgctcgaggtgaacacgtccaagaagccggcggttgtgaagggcgacgagagcaagtcggtgctgttcgacgcctgcatcctggccaaggcgctgctgcagctgggggacgacaccatgtggagggtggtggccggagtgtggagggagatgctcgtccacgcggctggcaggtgccatgggagcacgcacgttcggcagctcagccgcggcggcgagcttatcagcatggtctggttcctcatggcgcacatggggatcggcgacatgtacaggacccaggtgggggacgccaacgctaagctcgtcgtccttgaccagtagacatgcatgcctgctgccgcatatattttaatactccctctatttcaattcgtagcaacttaaaataggattagatccattttaggactacaaatctcgacatatatttattcagattcgtagtcccagatctaatcacattataagtagttatatattaggctagagagagtacatcacttacaagtgaccttccgcgaggcagcttgattcgttcttgttgtcttaggttttttttttttggtgtgtccattgaggatcaagtagatgatggcgactatgtgggttgttactaccatctggattgggaagattgattgatggcagttgaagtcgttcaactgtgttaaccgattgtaccgaaatttttacaatttggctcttttaaaaaactagttaaaaaataagccttttgctcagcgccaaccttaatggtgttgtgataaaacatctcagcggcataaccattggcgctgagatcttattcaaggtggcatgatttcgccatgtaatcaggcctcagtgccaatttagttggcgcggacctcttgacattttaaataaaaaaaaggccatgtataaacctcaacgctgctagcctggtggtggagcccttgctttgcatctggcaggtttcacattcaaatccctagttctactttttatttcctacctgccctcctatttttctttttaagaatttggaatgagcagatttgatgatttaaattattgcatttgtcttagtaaaatatttagcttaatatctactacgaatttacaacaaaacatgtgttttcttttaaaaaaaatggagaacaaaaacctaaaatggtaaatattatataagtgaatttcaattttcaatttcaaaaataaaatggattttgaaaccatgcaattttttaataaaaaaacttaagcagaaagatgataaattgagcactgggtaagtgagaaaaaaataggaggctatggggttcgaaccttgaacatggatgaagcagcaaagtggacttacaactgagctgtacccttaaatctaaatactatagtttgattctgtatacttatatagttcatcccactaagtttagttaatactatttctatcttctctcattaagccacatcaccctaattatttttagcatttgaatgatagatttatagttcaaattgtctcttctttcttctctcataaaactatacaatctcaattatttttagactcaaaattcataagtatcaaaatttattttagtttcaataatcatatcacatcttatttgtacatattaggcaccttaatttcccgtagcaacgcgacgaggtattcatatagttatctatatattcatacactaaggtcgtgccatctcaggtagaatgttagcaccaatggtaaacatctcagcgccatcatggttggcgttgagtaaacggctcatttttgcaattagctttttatacgagttattattgcaataaattttttaaaaggatcaaattgtcaaaatttcggctgattgtgagtgcatcactttggttgtttttggtgtgtggtaggtgcatttgatgctaccggcaagcatttgatgaaccgattgtgagtacaatggcgaagattacaaggtgaaaagattgatccattcatcgagattcgacaacaccgcactcgtatgtcatcctcttattagaggtgttatttcaggttttggatgaaaatctagatctatcttcatatagcaacagcaatacaacacactcatcaaatccttgttgaacacctagagtgagtgatgtgaaccattcctactatggataaaactattgttcacatcatggattaacaaaaagacataaagatcaattcgtccaagtgctgaaatccgattcggccacctgctatattgctgacttcaaactgtcaccaaatgtgcatatacgagctccgtttttggcccgtgagtacttgtcaagtcatcttttcaacagatctagcctcatctccaaattcatttctgtcggctgcaatcacagaaacaatgtgttgcatcacctataatgggtctatgggcttgtaacttcatctggacctagcccaggtggggctctcatgtggggtgcgccgcaacatggtggagcatgaccctatggaccccttggtcgtcctcccacctccttaaataggtaggtaccccttcagagtttcttgagttttgttgattagatttagcaacttgctacttgtttgtagcgcacgtgttggataaaccgtttgtctgtttgtttttggaaccccgccatattgttatttcagagtaaaaccttcatatctatttgttcttccaattcggtgtgtgttctacttgttcttacttgtttttcgattgcttataggatgagtgccctcgtgaccgggttgacgcgcaccgcaagatcgcggcgaccactagagacagtattgttgacggtcgttatagaccaatttcgaccatcaatacttctagaaataatggagacctagcaattcttgcatgcatttttatttagaaataatctggttccacttgtacttggtaaagtaattgtatataggagatcacttcataaatggaggagaaacgatggaaattcaccgatcaatcaatcagagcctgacatgtggtagacatatggatggatgggcccacaaacccattaaaacatttgtaaatgggcccaaccaacatgccactggccaagtatccatcaaacaacgtccaagaggaaggactgggccaggaggcctgccaaaggtcggccgaccccggcctggctccgttggcccatgcccaaaccaatgacggttgtaaccgatttgccaatggcagttgtaccggaattaacgcccacaaccgtcattctcaaccactattccaatacacaccaagaaagattcaagaagaagaagctctcttagtttactcactttgctctagtgctagtagagttagaattagaatagtctccttagttcttcaagtgtaacatcctgaaaattcctgacattaaaaatcactaaaattttgaactttttaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggcccgatctataatagagtttctcactagaatatataattaatatttgaaacaccttatcaagctcctcatagcatgaaaatcactcatataa

SEQ ID NO: 58451 - DNA, 69439 bp, Oryza sativa
  unsure (1)..(69439): unsure at all n locations
tagtgcctatgaatggggctatacctaagacgggtgccttctttgtcgctgctctccgcctcctcgtcggagtctacatttggtaaccttgacgtcctccatcacctctcgtccctaagccagtgtaacactctaaaaattcaactaataaactgtggaccatagttgacgactgtcgaaaacttttattaaattgcatcataccgatggtacacctctcatttattgtagttattattggtgccaaccaaattaattcatggagtcctcaaaaccaaatcaaactatataaaataattaaaggaattaagttttgatttgattaataaaattaaatagatataagggagaagtgtaaacttataaaataaatatggtagaaccaaagcatctagaataaagttcatgaaagatattcctaattacttaattaaatcaactttgaaattaccattttaccctcctatttttttcctttttcctttccccgtttcttttaggcaaaatttgatacaggacaatcaaaaatcgtgtaattggctgagagacaccaaaaaatgtgacactgccgatggacactacaaaagttgtgtaattagttataggacaccgaagggattattttataattttcgggctaaaagaggggagagaaatttcgaattgacgggaatgtcccctctactccttcctcatggccgccatcaagcgctcccaggccaccttccacttctaccactaggccaccaccgcccagactcccgccgccgtcaaggtcgtcagccgcgtctttgccgaggccggattccgtagcggggacatcaagctcaccatcctccgcccggctccatccatgccgctcctcggccgcctccccacgcgcacccgcccacagcctcgccgacgagtatgcctccttggcacccttcaccgccacctccgccaccacatcaccgccgccgccgtcgtccttcttcactgtctgaaagccctgcacggcgccgccgacgttcagcatgttggcgaggccgatgggcacgaagctgatccgccgctccaacaagagctcgtaggtgaacggctcgagggtgagctcgaaggactcgttgcggcggagcagctgaagcttctgtgcctccacgaagtagacggtgaagcagtcgacaccgtcgccgttgccgccaccgcttccgtgcctccacgaagtaggcggtgaagcagtcgacgccgtcgcctttgccgccgccgccatgcctccactcggacttgtgcctgtatagctcgttaattcatcttctcctctctccttcacatttgtttctaggtagcttacttgctctaagcgatgataaattagtaatattcaattatccaccaaatgagcaattaattaccacatgactactgatatacaaacacagtccatctccttggtattcactattacataaaagcacttatgtgccgcttgggaaccgatcataggtaccggatatcccaaccggcactcagcaagtggcacagatgactttagtttggccatttgttgcattaattttgacaaacccatctagtagtcacatgcatgcaaagagattaattattacctccatatcaaagtacatgtcactcttaagtatgatttatcccatcacatttcatttaaatttctctctattctacccccaactaccactacactcctaaccatgtacttcctccgtcccactcactaaggcgcacacatattttaaattttaactctttaaatatttgatctgcaaatactttattataaattaaattttatttgatgaaaattatattattggattgtcatctatatttacttttatatgattatgattttgttgttacaaacattataatatatgagaaatttaaagtcaaagattagttttgaagagtgcatcaggtttgaccgtgtcttagtgagtgggagagaaggagtatcatttaaggatagtataattttttcttaaactttaatctatgctaaactgctaagttattcagaatgacggatgaattatctgagagacagatcgatgttgaaccatcctgtcaccttctgctagcttttgcaacagtagttaattactactccctccatcctataatataataagttttaaagttagacacggttactaggtagaagtgaatggtggagggttgtaattggattagtagtaaaggtaggtgggaaaaatgaacgatggagagttgtgattggttgagaagagaatattggtagagaagttgttatattttaggataaatcctgagagctaaaagttgttatattttggaacggatggactacttcattatagcccatagttagactgatgattgactaattgttagagcaaggtcaatagtatagccagctaaaagctataaaaataaccacatcagcaaattatagttagtgctaatagctagtgcatacaatagagatctactatcttctattgctacacagttcccatcaaccatgaacaaatgcattcggtagaatgaggtgaccccacccagcttcttgcgttgccatagcgtgcagccaacagcacttaaatgctttgccttggatagagtgagcagctagcgactaattagtcgcctgtttaatctctctcaccacctttttcacctccagctaagcatcaacgctgacatggtcatcctatcgccagcatctaccgtcttactgtacctgctctaagtacatgtgtgacagctcaggcatgtctcccgttctgctggacacgcatgattcagctgaagaaaaaaattgatataattggagcttttcctgctatcataccacgcttgcagttatgagctcgctaatccgagtacaactcgcagcatattctacacacgcaatatatctatctattatattattaaagaaatagaaaaagaagcttccacgttcactctcatggcttagaaattctcacattaatcggagaaaaaaaaaagcagagtccatatagaaatacaatttagaaaatagctgaaattcgaaattaaaaaaataaggaatattagaacataatagagtctatacaggaatttaaaactaactaaaatttggaataaacataataaaattaaaagtagagtttagagtccgtataaaaatacaatttacaaataactaaaattcaaaattaataaaaacatgggaagaagagtttaaagtcaatataggaatacaatttaaaagtaactcaaattcgaaattaaaaattaaagaatattgaaagatgagtttagagtccacatagaaatacaattagaaataataaaaattcataaataaaaataaataatattggaagaagagcgtagagtctatatagaaatataatttataaaaaattcggaattaaaaaatattaaaatacgagtctagagtccatatagaaatatatataatttacaaataactaaaatttgatattaaaaataattaataactaacacgtatataaaatacaatatgaatattactacacattagtagttttgtaaagttattgcaaaatttaaaattatgttgtcattttaatatatttgaataatataatgagaaaacatatatgctattatatgagagaaaatataatgatgctaaccgcgcaatctgtgtaggccaccatgctagtttataagtataacaacaacaataatagtccttgcacccacatgatggtgactagttagattaagcaaagtcttcttaaaacaaagaatgagtagtgataaaccaaataaatcgatcaataagacataaatgaccaagttggctgttaattaaacaaacatcatcacgtacgtactccccgtgaactcgtagtaggtataccggacggaacatgagtcagccattctattagatctgtcctcggaagatggaatccatgcaaaaaaaaaaaattcaccgacctgcacagccggagacgatcagctcgatatatcgatcgtgtcttcctccgtgtgtctgctcgctacgtacgcctctgccatgaaagaaccgactgcccgcatggccggcgtcgtccaccgtttcctcctcctcctcctcttcgtggcggccgccgtcatgccagcatcaaccaatgccgcagcgtcgtcgcagaccgacgcgctgctggcatggaaggccagcctgaccgacgtggccgcgctgtccgcctggacgcgcgccgcgccggtctgcggctggcgtggcgtggcctgcgacgccgccggcctcgtcgcgaggctgcggctcccgagcttgggcctccgcggcggcctcgatgagctcgacttcgcggcgctcccggcgctcaccgaactcgacctcaacgggaataacttcaccggcgccatcccggccagcatctcgcggttggtatccctcgcgtcgcttgacctcggcaacaacgggttcgtcggctccatcccgtcgcagatcggcgacctctccggcctcgtcgagctccgcctctacaacaacaacttcgtcggcaacatcccgcaccagctcagctggctccccaagattacccacttcgacctagggaataattggctgaccaacccggattatcgcaagttctcgacgatgcccaccgtcaagttcctgtcgctctttgccaactccctcaacggcagcttcccggagttcttcctcaggagcagcagcatcacctacctcgacctgtcgctgaacaatttctctgggtcaataccagacttgctgccagagaagctcccgaatctgacgcacctcaacttgtccatcaatgcgttctccggccgaattccggactcgctcaggaggttgacgaagctctagcatctgcgaattgagtacaacaatcccaccggtggcatccccaagttcctcgggtcgatggggcagttgagagttcttgtacttggcaacaacccgctcggcggtccgatcccgccggttcttggccagctccagatgctggaggagctccaagtaatggccgccgagcttgtttcaactctgccattgcagttggccgatcttatgaatctctctgtcctgaaccttgcctataacaagctctccggtaacttgccgctggcattcgcccggctgcaggcaatgagggtgttcagaatctcatccaacaatctcacgggtgatatcccgagctcgaattcttcggtgtggacagcaacatgttcactggaaatatcccaccagagcttggtaaggcaaggaaactgaatatgctgtccatgtacgacaatagattatccggcagcattcctccggcattggggagcttgacaagcttgaagtatcttgatctgtcagcgaataatctgacaggaggcattccatatgagttgggtcatctcagcaatttgcaattcctcaatcttagccataactccatttcggggccaattatgggaaatttgggaaacaatttcaagctgcagggagttggttcatcagggaattcctccaattgcagctctggctcagcattctgcaggctgctctccctcgagaatctagacctttcaaacaacaagctcactggtaagctgcccgactgctggtggaacctgcagaatctgcagttcatggacctctcccacaacgacttctcaggtgaaatctctgcactcgggacaagctacaattgttctcttcattcggtatatcttgctggcaacggtttcactggagtttttccatcaactttagagggatgtaagacactggtctccttagattttgggaataacaagttcttcggtaatattcctccttggattgggaaaggatttccttcgatgaggattcttatccttaaatcaaacaacttcactggtgaaattccttcggagttgtcgcagctttctcaacttcaactactagacatgagcaacaatggtctgacaggatcgattcccagatcttttagtaacctcacttccatgaagaataaaaaacttaatatctcctcaggaattattacaatggcttagttccgatgaaagaattgatacaatctggaaggggcaggagcaaatttttgaaataaaaatttctggattaaatttttttcaactacttacgggtatcgatttgtcaagtaactcattatcacaatgcatccctgatgagttaacgaacctccaaggccttcaatttttgaacttgtcaagaaaccatctgtcatgcagcatacctggaaacattggtagtttgaaaaatctcgagtcccttgacctctcgtcaaatgaactttcaggagctattcctccaagccttgccggtatatctacccttagcattttgaatctctcgaataataatctatcgggcaagataccctttgggaatcaacttcaaacccttactgacccatcgatatacaacaaaaatcctaggctatgtggttttccgttgaacatttcgtgcacaaattcttcacttgcatctgaagagagatattgtagaacatgcgaggaccaatatctatcctactttgtgatgtctggagtggtttccgggctttgtctgtggtttggaatgttcttttccatcgagaccttaaggtatgtcattatctgctttgttgatgccatacagtgtaaggttacgcagaaggtgtcctatattaatcaatttctttctagaggaaatacggcttagcatctgtgcagctgtgtttccgtaatgttaccttatgatgaagaagtatatttagctttctgttgttctgtaattggcatgtttcctttgtatattaagactaagaggaatttaaaatgctactttatcttatccaaaatcttatggctttattctggaaatactctatccggcagtattccagaaaagataggcagtttgaaacccttgtggtgttattcctccgagcatttcaaattcgttatgctttggtatgttaagtatctgaaatagggtgaggtaaccactgtaagtcaacttcagtcaattgtggatccatcagtctatagcaacaatctgcttctttgtggcttccctccatgcacctacactggataaaaaaatgaagaccataaagaaatctatgcgccattactttattctgtaatattattggcctttttttttgtgtgttttggctttagtttggagctctggttttacttaagccactgagttttcatttttcactttaccagatagaaagaagttgtgcataagcagtagacattaatgcactcttcagttgcaaatcagcaaccaaagaatcatacagttttcagtttatattggccatttttgaaatagttaattcccattcaaaaattaagtatattagatgcatttttatggcatgcatgtgttcacctgaatgaacagctgtgttctagctactctagtgtactatactcattcctactactattcttgttgtggttgtccgatgtctgcagccagcaacctcaccaattcgaattgaacttttcatgcatcatgttttctggaatacgcaaaaaattgtgcatttttgtattaaaactttgaaaaaagtgaagtattacaatattataattctgaaatgctatactcagggaaaaaaaaagaaatacactacgtcatgtcccacaccaccaccacaccctaagaaaacacagccacgaccaagaacctccaaaaggatgcctctaaaaaggttaagacattaaaaacaccaccatcgcccatcccaaaagatatggttttcgcctaaaagatcttattaaagaggggaagagaggcacctcgacaacaccttcaagagggttccggcgcctaaaggcgttgccgctgtcagcttaagattgggctggctttcgcctggcggaaccaaggtagccgtactgnnnnnnnngaggtgcggctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaacctcatgagcttattatcctatgtcggaacaaattagttaaacttgcacctttcttgttgctacctcaccaatcaccaatcttgctgacacgtgactgcaatagcaccaacgccgcttcgccggctgtcctccatacggttgtcatgctgccgacacgaccacaaccataaccatgaccaatcttgcgaccaaccactgttgcactatggcgaccaattattagccttcttcccatgccatcacctccatcagctcaccaagaaagggaggaggtgtgaccgccaccaaccgctacatgttggcagcctcgaccttcctttcctgtcgccatcttcaccgtcttgccatatgggactccccatgaccaggtaaacctatcaagaaggtgaggagctccatggagatgtgaaggcaccatagatagagagcgacccaccatcatcgctgcccgtgatggcggtgctatgtggccaaatccgggctcggggccccagatccagcttctgctccacccaacaccagctacgccgccacacgggttggcaaacagcaaacctccgtcgttgccatgcacgctggtgctccggtcgagtcgtcctcaaggcgtgttaaccctccgcctggcaacccctgtgcatctccatgcgcccaaggagaggccccatcgtcgccaccactggccagccgagcggccgttcgcgaggagaggcaagggccgccaccgtcacctgcgtaggcttccaccatcgtcgcccgtgccgacctcctcgacaccagctgtcgcggcatcccactgtcgctagccatcatggccttccacgcaggaacccgcgtgggactcccgccgttgatgctccatcgtgccagcaactccaaccagatctggttcagaggcggcggatccacctgacggaagactagatccggctacggcagcattgaatctgtggcctacacgctgcgtcatcttcccagcgatccatgcgccaagccaccttcgtcacgctgaaggcgaggcgccgccagggttcggccccgctgccgccatcccgacttgccgcacggttctctgacagcggcgaggagagggagaggggagagcggcggcggcgggtggtaggattcgccacccaggcgtggacgacacggagggtgctgcttggatttgagttttttttttttcatacatcatgttgaacgaaagagcagaagcattgccactcatttacagcatcacatacatttccgtcatccactgaatattcttctaattcacattcatagaaggaaaagggactgctgcagtgaacagttctttctaagatatgttgattttctctcagagaattatatggcaaagtcataaatttctccatttctcttctctgtcttacatttacaagtttattgtttagcctatgggggaaaataataatattaccacagggatagtaacaacgagcaatacaattgtacaaagttgatgaaagacaggttttgtgattcagtgtacagaataatttctatatatttatcagcagttaatgtaatatactatcctaagcttacccttggcattaatataatctgaggatgcatcttacaaatcactaactgcgaagttcccttcctcccctcctggtgctttacatctctgcacagatatatattcacttctggtagtctgttagcttgctaattgtgatcagtttgaatggttcagagaggtaggcttgagtatgcgcagaaatctcctgcgctacagatctcatggaaggcctggattcagggttcacccttgtgcaaccaagcgcgattctcacgatgaacacgacctcttctgcgagctgccctgttggagcatccagccgctggtctagtatgtccttgagcagtagatcatcttcttctgatgatgagatggctggcagggatgttaagaggtcacctgggtgctttcccatcatgacctctagcgcaaccacgccaaagctatacacatcgcacttctccgtcaccctcatcgtgtatgcgaattctgcaagaaataatcgaagtcggtaagtgttaatggtgcggtgccgtacttgtcggaatttgagcagttccttttcccaatgacaatctttcaaagttctgcaaatcttcaggacaggagtatgtggcaatctattcaataatgaccactctacttacagtaatgacttcagtactttcatgaatcacaataatgtgcaaaacaatcttaaatagatcggatctgagtttctttctctcattttttccttttttaaacaacagacaattcgacaactatatttcataactactgctcttcatttggtagttacttgcacaaaatgttcttttatggtcagaaatgtttgacagtttatcatacactacattactacctgggagtatcgaactaaatttagccatctggtttttcgttaattatgactgaaacatcccaaatgctatttggtgctaccataaggatctcactgaagcactttgaagtataactaggatttgatattataagctacatttcaaaaattgtatgcataagaaacatgtgacattttaaggaaaaaaatgttcaaatttaagaaaagtacctggagccatgtatccatatgatcctgccacagaagtccagttcgtcgatgcacccccaagcaacttcgccgtgccaaaatcacacaagcgcggctcaaagtctgactcaagcaggatattattaacagtaatatcacgatgaacgatggctggattgcagtcatgatgcaagtaagccagggcatgagccagcccctgcaccaccttcaccctcatgccccaatccatcttcttcttcccttcctccccatacaatgtcttccccaagctgcccctttccaagtactcatacaccaggtacatgtagtcaccactggtgcagaagccatggagcttgacaatgttgcggtggcggacctccgtcagcgccttgatctcgttctcgaagctcttcttgttcacatccggtatgtcacccgtgtcggcgacatggaagcgtttgacggccacaacctgcccactggagagctcagcccggtagacacttccgaaccctcctttgccgatgcagaaggtttcattgaagttgtccgtggcgttcacgatgtcgaagaatgtgaacttgccttccttttcccagattgtggactcatatgaataattggtgttagattccacctctttcttctctctaggcctcctcctgcataacagtatgatgcaagtaacaacggctagtagtaacaccactccaactactgacacaactgttgcaatgactactctcttgtgatgcccagaagatgatccggtagaactgatgtcacaaggagttagaccttgcacatcaccacagagccccgaattcccaacatatgcagaagctgaagcattctggaaaacattccctgacggtatactcccggtgagtcgattataagagaaatcaactgattcgaggcttgacatgcgagaaaaccctgccgggatcgaaccactgagctcattgtgtgataagttcagtctctgcagagttatcagcttctcaagatttggagggatcgcgcctgatagagaattgctgctcaaatcaagcaggatctgcagctgagccagattaccaagctcacttggtatctcccctgacaacctgttcttgctcaaatcaagcaatatcagagcatcaagcttgctaatggcaactggtatcgtcccatcaagcatgttccctgagaaatcgactttctgaagcttggaattgttgctcaagctcgccggaatcggcccggaaaaggagttatggctcaggttgagattgaagaccctgatatttcccaacacaggtggaatccctcctgtcagattatttccagccaaattgagatccttcaagcttgtcatgctcccaaatgccgccggaatgccgccggatatgcgattgccgtcgagatgcaggagtgtgaggttgatgcactgtccccaggcagacgacagctcgccggtgagcttgttcccggagacgtccaggtacaccagcttggggtgcacgccgaaggcctccgagatgtcgccggtgaagtggttctcctccagccggacacggaccagcgccgtgcagttcttcaggcacggcggcagcgcgccggtgaagttgttgtagttcgccgtgaggtggtccagcgcgaagccgtcgcagatgtggcgcggcagctcgccggagaagctgttgttggtgaagctcacgtgctgcaaggccaggcccttgccgaggtccgccgggatggtgccgctcatgtggttgtcgaacacggcgaggtactggaggctcctcagggccgtgatggtggctggcagctcgccgtgcagactgttggtgttgacgtcgaggctttgcaacgccgtcatgttgccaatctccggcgggattacgccggtgagattgttgaagaatagcgccaactttgtgagctgcttgaggttgccgaacgagctggggatcggtccggtgagcgagttcaccgacaaatccagctctgtcaggttctccagctcgccgagctctgccggaatggagcccgtaaacttgttggtgaataggtagaggatgttcagtttgctcgccttgccgagctccggcggaatcttgcctgtcaacgagttgttctgcacttggaaggatatgagctccggccagctcgtgaacaacaccggcgggatctcaccggtgaggttgttcgtggaaatgccgaagtaccgcattgcccgcatcccggcgaactccggcggcaagccaccggagagctggttcaaggacagctcgaagaaaatgagattcttcagatttcccagctgcgacggcagagttgaagagagccccgagttcttgatgtcgagccgctgcagcatctggagctggccaagaaccggcgggatcggcccgccgagctggttgtcgccgagttcaagaatcctcaactgcggcatcgacccgaggaactccgggacgccgccggtgagattgttggcggccatccgcaggtcctgcagcttcgtcaacttcccaagcgacgccggaatcgggccggagaacgcattgatggacaggttgaggtacctcagattcgggagcttctccggcagcgtgtccggtatcttcccgaacagagtgttctgcgacaggtcgaggtaggtgacgttgccgcttttgaggatgaactccgggaagctgccattgaaggagttgaggtagagcgacatgaacgtgacggtgggcatcggcgagaacttggcgaagtcctcgtcggtgaggtagtttgctcccaggtcgaagtgggcaaccttggggaggcggctgagctggtgcgggatggcgccgacgaggttgttgttgtagaggcggaggtcgacgaggccggagaggtcgccgagctgcggcgggatggagtcgctgaagccattgttgccgaggtcgagcgaggccagcgagcggagccgcgagatgctcgccgggatggcgccggtgaagttgttcccgttgaggtcgagctcggccagcgccgggagcgccgcgaagtcgagcgcgtcgaggccgccgccaaggccggcgcccctgagccggagcgaagtgacgcgggcgccgccggcggcggcgtccatgccacaccgcaccacacacacaccggcacggcacggctccacccaaacagcacggccacaccatcctacaagccaaccttccanncagcagcgcgtcggcctccgtcgccgcatccgccgcggcgaccaccaccaccagcagcagcaggcggagggcgtcgtgtctccgcggcattggcgagatctagcggcggcgggtcagtggcttgggtttggctgctttggaggcagcctggttggtcgccggagttcgcgtggagggaacgttttttttttaagagcttgcggcgcggggggcggtcaacggggcggggttgaccaaaacacgtggggtgggggttgggtggggtcgacggcgggtgggggccacgtacgtttgtgttgacgtggaatgattatagccgtgcgatgtacggccagcccagtgtcaatttgtggtggccagatggcgtgggtcggtcgaaagtccaaaacccaaaccggagtgtgtcgtgtggtacgtggggtgggatgccatattcgcccccaaatataataatttttttttgtcatatcctttattttattggtgaaataagccaaacgatatatttgtaaattaaataaattttttatatatgtgtttttagcaatctagaagtaaaggctgaaaaataaactttgattgaaaaaacctcaaaatcaactttaaattttttatgttaaaaatttaaattttggtagataagtataagcataagcgaaaagatgagtcccttagtatcggataacattctagtactggatgtgacatattctagtataatgaatctagacagatgtatgtccagactcgtaatattaggatatgtcacatctagtattagattgttttttatgggatggagagattatgtgattctaaatttttatattttgagatgggcagtaatcataatcatggtcctatgtgtcctaggaatttaggaaccacgggcgtactggatgtgtgtgaacatttgtatgtttgactttggtgatgttaatattatctaaaatttggatccaaacttcagtcctttttcatcacatcaacctgtcatacacacacaacttttcagtcacattatcttcaatttcaaccaaaatccaaactttccctcaactaaacacagccattgtctctgatcctacagccccatttccactatcagaaacatattacgtcaatcattaatatagaggtatccacattaaaaaaaaggaaatcaaaggtgctcaactgtctaattgtcagtgtcagtaaaactagatccacaaattcccaatgtcgtctcatcacaggaagatgctcatctagagttgaaaatgagccgatcttggtacggtgctattggagtgggaacgtgggataaacttgctttctctcaaacattagaaaacacgctccacttggaacttgattgttttgattgtttgatctactactgataaagccgtagaaaaacaaactcaagcaatagaaaatgattattaatgaaaatttaaaatatttgtccttagcgttttaaaaaccactgctaaaaaataaaattaagaaaaaaaactcaatatcagcccttaaactaatttataaaatttgagtcctagttgcggttgataagacaagaataattgacgaactcagaaaaatgactgactggccgatcttacaacgaatcgcagtacagacatatgttcatcgtcgacaagtaagaagcttttagctttgtgcgccaaaaaaaataataaaaaaaagaacaaaggagaagcttaccaatggctttcgctagcggttaattgtcggtgtcagctgactcggacggatacactgtacatcatccacgaggatcacggccaaagccggtagtcattccgttctagattataaattgttttgactttgtcaaaattaaattgctttaagtttgattaagtttgtaaaaaaatagtaacattttcaatataagataaatatattaaaaatattttttcggggaaattataaaaatattgactttaatcattgactatattttcctataaacttagttaaatttaaagtaatttaactttgatcaaagttaaaataacttatactacgaaatgagggagtatgtactcagcacaattggcaacatcattccccgcacgatctcctacccccaatgcaaacgactgatcgaactgaacaacattttctcccctcctgaaactgtggatggcgatggccatattcagcagtaccccagttttattcatcgctatagaaaccgtgtgtgtgcatctcattctccaattagacacatgggcaaagagctcaactttgaccattcacttctcattgtgccggcctgtttctagagtgccggtgagccgtgcacgggactccgaaagaggcagattccatatccatcgatctaggggtgaacagaaatctcgaagctcatcgctcgaatcggtttgtaacgagcttgattcagatcgactcaaactcatagttttaataagtcaagccaagctagaattttaactcgtgaatttaatgagctactcgtttagctggttagtacagaagatcacctatctttatatgcttagcccttcttagctaatgatgtttagttccttaactacatccaaccaacctacttgagtttagtgaattttttattagtcagtgtttattattatttatatggaataaaatgataaatttagaattatagaggtgaaataaatatgttaacgagtttatttcaattttataattctaaattttattagctcgttatccacccctcatcgcggccgttttgtcgttcgtgaccacttgaatcatatacggctttagacagatcagtagtgctctgcgagagcttcctgtcgatcgtgtgtttctttttctaatttttattagtgcagagttaggcgaactttgcaaatgcgtagatagctaccataacacacgccgatgactcgtcggagatgaccgggcatgcagtgttttacttttcgtgttcaaaatgctaatgctaccatgcattgttctgccaaaccgtgtgattagcttaattaccgcatgctcctttgttttacattataaattgttttaatttttcctaaatatttttttaagtttgattaaatctatgaaaaaaatacagtaacatcattagcacaaaacaaacatattatcaaactataataaatgttagtttttaacggaactaattttgtgttatatatgttattaaatttttttataaatatagacaaaataaaaaaatatttgactagaagaaagaaattcaaagcgacgaacggagggagcaggaggttatgacgagtttgacaatcactagctcgagtcgtgccgttttgctcaccagtcacacatcgcacaatcgtcgactcctcgtcatccgagaaaggaggcgtgtgcagctgcgaccgcgggccgtcaacatatatccgttcacagtcgaaagtcggagcacgagaaaaaaaattaaacgcacaagcccggcggccagtcgaccggggctcatcctgggcgactaggggtgaaatgatgacgaaaaattcccaatcgaccgaacgttttcaacctttaccctttttagctatatataaaaattattctttctaatttttcaacatcgtattgatgttgatattgagtagtttaaataataaatatggttaattatcggctgtctggggtgggtttaaccctctctagaaaaactagagtcgagaccagttgctatctattcttttatgtcgtgaaagcattgttttagaagaatgctcccaattctaatcgttactgactgttttcacccatactcgcaatgacgtcgacaagaatttactgtttgccatccttataggttcaaatgtcactctttgaaattttcatttccatttgtcatccagtctaactctctcgtgtgtcactattcctacttttctagttcacttggtgttacatttgtattttttttcctttctatccgatgtgtcgaatgatgccaaaagactgaaatgcccttgggtccatatgtaagaggcttctcccgccctacccaagctgaaccaaaagagaggagggggagacagagccgctattgggaagatggagcccagcgccgatgctgatacatcctccccgaccgcgaacaccacaaaccatgccccctccccaacgtgtagaaccacccagcctcaacgtggtcctagcaggggcggatctatagttataggaccggtgtcaggcgacaacgacgacttttggcaaaacctatagctaaactgtttattcatatgctataacaccatgatctaagtataattagcatattatgacatcgatagacgcgttctgacaccaacaaatcgattttctggatccgccactgggtcctagcacactcctcctatctatcctcacctcctgcgatgccggcgaagaggagaatagggggagacgaggcagagaatcagcccacgacttgcctcaatttttaaattttgaaaactatcaacttaaagtttaaagtttgaaagctttcaactcattatttcaacttttaactcggattagaaaacttttaagtcaaaattttagaaccttcaactcaatatttatttaagttttaaattttgagttaaaagttttttaaaatttgatttgagagtttcaaattttgagatgtaagttttgtagtttaagttcaaattttaaattgaaagttttaaatagaatgttttgaaatttaagataaaagatctaaattataaaatacattaaaaataaaaaaagtacgctaaagattaaaaaatcgtgaaaaaaaggaaaacgtgtcaggaagtgggggaaagcgtaaaaaatggaaaaaaaaatcgtgcgggagcgtcagctgacatatacgcgtcagatagcaatccccgagatggggccatgggatgggaagaaattccaaagtccaaacctgtgtgtacgtgtggggtagtcatcatggtcctctgtgtttcctgggaatttagaaaccacggacgtgttggatgtatgtgagtcaagtggtctctttgaacatacatttgcgtgttcgctgccaggactttctgctcctatatcctcgttccattatcagaaactgattacgtgacagtgtagaatcatggatataaaggtgttcaactgtgggttaaattagaaaccacaatgcttacaaattccctatatcgtctcaccataagtagcagctcgtctagagttaaaaatgacccatttgttacctttttttttttcaggagacactctcaatcataaaatatggcaatctaatattggattgcatataaacatatactacgaatatagataatgccatatcttgggatggagtgagtagaacttgactgactgctatgaatgtttgatctacagtacaataatgaattaagcaatccaaataatttataaatacaagttttatatgtgtgttttttacggtttaaattatcttggaagataaaatataatgtaaaagtaaaatttgctataggacatctaaagtttataattcttggtgttgaacacctaaaaatgtgacatggttgtagaaaaaaaactggtaattcactaagagacactatagtcattattttatcattttcaggaaaatgaggaaagaaacttttagagaagatgagtttgccccctaggccaattgcttgtaatggcctctgtcatgggccctgtctttcaccgcctccaatcttaaggtcttggagaggggattggtagaggaaatgtggcttggatctggttccagatatgttaaatgataaaataataacagcagtctcccctaataaatcatcggttttttatgtcctaaaattgagtttatgttttttagtgtccaagagtaaaaaatcataaattttgaatatcccatagcatacttttaccaatgaaagaaaaaccttagtgttaacttaaaagtaagttttgaaatttaaattttgattgcagcatataataaaaaaaggagaatgatggttcatggatagacctatgatatgctaatctcactcgacgattatctttgacacaagaagtttagtaatatatttggcttgttggtatcagccgcaatcaaaattcaaattaattttagagcacatatgtgacataaccggtaacgccatccgatccacgagaaaggagatcgtgtggtttcatcgtccccgcacaatctcctccctcaggatctccactccaataaaaacgacctccatttggccattctctatctccacaagcaccaccatttttctccccacctgtggaaaccatggacggtgatggccatattcagcaattccctcccagcttcttctttgtgaaaaccgtgtctgtgcatctcctcctccgattacacattgacaaagaaatcaactttgacccttcactcctcttttccactaaagaaggatccaatatatacccatgaggacatgatagtgtcacacactcacacactactcttcgtacgggcgcacatccagcttctagattgcccggtgagccacacgtgactccgaagaaattaaaatggattccatccatcgatcatgtgtccgcttcgttcgtcgtacgtgacggcgtcatcacctgattacgtacgcctttagacacagattagtgctatgagtatcgtgtgcctgttgtatattgcatgagttaggcgaggatgcatattgttggcaatttttttttatatatattgtagagacagattcgggattggactctgctggtcataccagccacacaacgctggtatgaccggtctactggcggtggtctaaccggtcgacacacgacgatcagatcgaccctctcagagaaaaatcggtagaacgtccaaactttggtaatttttctattttaatcttagatgttaaatttgggtataaacacatatgctcctagatctctctctatagctttacaaatggtgtagatagcatgcataacacaatatgaaatgagtataggtatgatccacgttcgattcaaccaatgcataaacacatctattatttttctaagcccacataaacagcggcagaggcagtgactaaaacctgtggggttaaagctgtaaaattatttttagttttctattattgtgacacaaatatcaatagtttttttttggctgtttcgcgaaaacaagtggggtcagctgatcccatagattactgtagctccaccactgcacatggagagaaatagagcacaagaatcagtgaatgagacgtagtcggatgctaaccatataatatggtatgtaaagcaagattctaacacaattaacgatgaccagtagatctgccactgaccgagtgaccggccccggcccgtgcatgtgttttaagcttgatccagttcaggtgcagtgggtagtgtgaaacagtcacacgagcaccatcggatctaaaacgggcgtgatctagatgtatctaaacacagtagcaaaacactgcagcgatttattgtggcacagtaaagtttcgatttaccgtggcaattaggggtgggtgttcggtctgaccaaaaaattcggtctcggtcttcggtctttcggttatttcggtctttgaaaagtgaggaccgaatttcttcccaaaaaactcaagaccgacaaattcagtttcggtttttttggtttcggtctcggtctgaccgaactttcacagagggctagctggagacggaggcggtgtgatggcggcattgaggcagaggtggagggcggaccggcggagggcggaggcgggcgacgaaggcggcgccggcgcgatggaggtcgaggacgaccggcggagggcggaggcagcgcctgcgcggtcgaggtcgacgacgaccggcggaggtggaggcggagggcagaggcggtgccggcacggtggaggtcaacgacgaccggcagaggcggcgcgcggagggcggagagcggaggcggcgccggcgcgatgaggcggaaggcggagacggcgccggcgtgatggagatggagggtggaggcggaggcagcgtgaccgcacggcgcgagcgccgagcgcgaggggattggtggcggcgctgcgtgaggctggtgggagaggagggagtgtcagtggttccctttagggtttagtagtttattgggcttatcgtgcctcctagatctattaggccacaattcggttttctcggttaattcggttaaccgagaccaataaccgaattgcccaaataaatttcggtctttcaacggccaagaccgaattactaaccgaatttctcggtcttggtcgtttcggtctcggtcttttcagtctcggtatcggtcttttcagttcggttcttcggcccggtcttattttgctcacccctagtggcaattgatttggaccattggatcaaaaaattgagaactcagattatgtgcaatctatctattatattattaaaggaatagaaaaaggagcctccacgttcgctctcatggcctagacattctcacattaatcggagaaaaagaaaaagcagagtccatatagaaatacaatttagaaatagctgaaattcggaattaaaaaataaggaatattataataggagactagagtccatatagaaatacaatttagaaataattgaaattcggaattaaaaaataaggaatattcgaagaggagactagagtccatatagaaatacaattagaaaataactgaaattcggaattaaaaataaggaatattagaagtagagtatagagtccatatagaaatacaattagaaaataatagaaacttggaattaaaaataaggaatattagaagtagagtatatattctatatagaaatacaattaagaaaacaatagaaattcggaattaaaaaaataaggaatattagaagtagagtgtagagtccatataggaatttaaaactaactaaaatttggaataagcataataaaattaaaagtaaagtttagagtccgtataaaaatataatttacaaataactaaaatttaaaattaagaaaaacatgggaagaaaagtttaaagtcaatatagggatacaatttagaagtaactaaaattcattaataattaaagaatattgaaagatgagtttagagtctatatagaaatacaattagaaataataaaaattcagaaataaaaataaataatagtggaagaagagcatagagtttatatagaaatacaatttacaaaaaattcagaataaaaaaatatattaaaagacgagtctagagtccatataaaaatatatataatttataaataactaaaatttgatattacggccttatgaccagtcacatggcgcaatcgagccaatcgtcgaaaggaggcagctgcgaccacgcgcggagccgtcggctactcttggttcacagccggaagtcggaacacgagaagagaaagaaacgcagaatgccgacggccaatcgatcaaccggccgggctctggtcaggcgaacataaaagaaaaattatagggattcaatacatagcactccctctatcctaaaatataagtatttttagactctgatatggttttcgtgatgctattttgatcaataatatttataaaagtgagatgttttaaataaaattacgataaattgtttaatgataaatatattaatatcaattttacatgattgatattttttatttttttgctattaataattaaagttaaaaatgtttgatttatcactatgctaaaaatacttatattttagatggatggagtaataattatctaattattagttggtgtattaattaaaatgagacattttagctaggattggataactaacccaaggtcctctgatcctggattattgaacgtgggagtgcaactgtcgggctcaccgtcgcgccctgcagtggtgggaaaatttttcacgcatattgctaatctaatgaaaacattaattttttttttgaaattagatagcagcatttattatcccatgtctgtttccgctcacgccgaacattctttatcaccatgaattatctgcttcacgtcttttaaaatatgtgtgtttatttaatgttttaaactaattattaagcttatttatcaagacatttgacttgtatgtatagtcatataaataattgttagaataggtgtcgaatatactattcctatttggttatttggttacagttggacttagagttgtaataggtgttagggggtggagttagagtcggactctgtaacccggcaactctcttaaatagagagggggacaccacaatataaccatggcgactacaatgtagcatacacacgcagggagaggatggcggcgtggccatggactcgtagcggctaggaactatattggttggggagaagcgcccataattagagccccggggatgtaggcttcggctgaacctcgttaacaaatatcgtgtgttcctgtgtcgtcatctggcatgtcttgagtaatcaatgactgaagcgatcgggagggttagtcgtctttccgctatattgactaacttttataacaagtggtatcagagcagaaggtttcagcattggatcaagaagacatgtggagaaggaaacacgaggtgggatcgcgcatcgataggagatcgtcagtcgtggcgatgagatcgatggcgacaacgaggacgttgcggaggcgacgacctcactcgcgatcagactgacgatggcggagcgtgaccggaagacgaggccgggcgtggccgaaggcgttcggagagatcggaggggtagcgccatggacggcgcgcccgacgcacgtggcgaacgcggatccgcggcggcagggaggccactgacggaagggcgaagctggcgagcatggcgcggcgcggcggacgtgcagggccgatgacgacggggtcgtggacggtgaatacgagggctgcgactgcggtgcgtgcaggggcatggacgtcgtgtatggaggcatgacttgtgcacatctacacatgcataggtgtggtttccaagagcagaaccaagacggatacggtgcggagacgtcgacttaagcagggagaggtggcagtgggctccatcgtggaggagtagctatggactctagcgaagaagtttctctaatccgagcggtggaagtttcggcttcggtgtctgatgcaggcggcggcgacgactcagaggaggcataggctgcggcttgtagcaggaggaagcggataccgagattgagtcggggtttggtttttggctcgtaggaaggcaggcacactacaaggaatctgttaatgcatgatgaaaaatttccgtcacggatcatcaaaaaaccgtcactatgcagcacctgtgatggtttcagagatggtcacggattgagcgtcatggattaacctctgtgacggtttaccaaaaaccatcacggattaatggaatcgctgacggttttaaaccatcacgatagagcccgaggcctagttagcccagcccaagttcatttcctatgacgaaaaataaccgtcacggattgaatgccacatcatcatggatgcttacatggttgcttacgtggatgatgacgtagacactacctcaacctatttattaacaggccaaaatcaaagatgggccaatttttagcccaattccatccattttcgcagctccttttcagccattttggcagcccattttcaatagctttacaacccatttcagcagctttgcagcccaattttgtcaccattttttggtgcccttttcagcccactactacatcgcttacagcccatatatacagcttaatttcataactaaagcccatatacacagcccatgcaactaatagttgcagcagcaaatcaaatagaaatatcatttttccattcaatatcatatcacatgatttttcatccaacatcagattacaacattcagggctcctttgattcaaaggattggcataggacttttgtaggatttacaatcctatggattttttccatagtatgtctttgattcataggaaatgaaaggaaacgttccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaaaagagagagagagagaaagatgggaacgagaacaccgaggaccacatattagcagccaagaaagccaactgtgatagagatagacagcagcttgagccggccgctgggggtgcaaggcggaggcgaggctcgccggctcagtcgtgtatgcggcttccgctggggacgccggcccaacaactagcagcacgcagcaaccaagcacagcatccatctggcgcgcaggttgggctccgctaggcggaggcgtgcggcaggtccgccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataaggattgtgtatttcttttttctttcttttttttggggggttaggaaagcaatgccatcgaaaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacggcaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgcaggtcgttatgctgaagggagaactcgccatggtatggaccattatgcaaggaagacaaagaatgcaccagctcattcaacacaagaagcaaatgcggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagacatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgttgtgccatgtcatctcgttttctattcccagcttctctagagttgttaaattcttgtacatcaccattatagttctcgtctccatttggcacatcaacaatatgatctggatcaatctccaaacgacaattacttggccacaccatatctccattatgcaggcgtatgaagttgtgtagaacacaacaggcaaccgaaatatcaacttgtttacgagctgggtggtgtgagccggtctttagtataggaaatctcatttttaatacaccaattgctctctctatatggtttttgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatcaacaacaaataataaatctgatggtttggtctaccaatatatataggagagcagaagcaagcaaataagttgctaatccttacatacataccaaaaagaaaaaaaattcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggccctcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaaattgacttgacacaagttagcaatagcagcaaaatgcatgtagtagcaaaagatatagcatcatgcatgaattaacttgatcgaacttgactgagcaaaagattaagtttccgcttccatctcagattgagtcctcttcatcgaacttgtagacagcttgttttccatttgagtctagcaagcaaggagcaaacattgttgttgatgagagaattaaaaataagcattacaaagagcaaagtttgaaacttatcttacaatagcctattgtacagcagtggtgtagcatttttttttcttgctgtagtggaactccttgaacaaatcaaatgcattaggttcttcttcattgtatttgtcacgctgaaaacaacatatatgcattatgtccagcaaatgtgtacagtgttgaacttaaaaaaaaaggatgaatctagatagcatcaaatcaccgttgagctgatcaaatcaagcatgatccatggtatcccccaagtaagctgttttctgcacctctttttctttttgttggcaaatggattaaaacattattcagttttgaagatatctgaaaatatagcaactgtggatttctgaaaataaacacattctttttttatctaaaacactttcttttttttatctagtttctatgaaactttcacgaatattctttcttatttatgactgcacttgcatttgcagaaacaaggaattcagttttttgtcagagatcatattgttacagcatgaattgacttgcttaactaaattagaggtttctgcattcatcagattcaggaactttgataagcaactagcatcagcggatagagagagattggttacagttgggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagatagaaagactggcgcctctcctcttctttttcatccgtgtcaaaccgtcctcgcccaccatgatcgcctgccgtgctccctatgctcacgcgtgcagcagtgcgtcgtcctcctcgagcagcctctcgatggacggagctcgcgagatgtaggaagcaggcgcgctactgggaggggatctgcgccctgacctgctgccggagaaggaggaggaggaggactcgtcggagctctccctcgccggtgcttcttccacctcgattcacgtcaccggtggctgccccggatgctgcgctgcacgccccctccgggcccgagaggcgccggcggcagcggatccaccgctcccgcgcctggcagcggtggagacggatgccggcacggcaagcggcgaagggggaggaagccggcgcggtgagcggcgcccggcggcggcggagacggaggccggcgcccagcagcggcggagacagaggccggcggtctcatctgcagtagcgcctcgcgtgtggtggcggcttatctgatttggatcggctagggttgaggaaccaatgcgattttactaaaatacccatggtgcatccgaagttaccactaaaatatctggacaaaatggtcatttcacgttgaaattttgatcaacatcccgccacactgaaagtttggcgcccgctgctccttcgggccgccggcccagcgtctgtttttcctccctcctctcaattaatttcaaaatattaaaacttcaaatcgaattttatcatactaaataaatttatgtgaaaaagatgtcaaaaacaaagttatataacttaatgagatctacaacttttgttttggtcattttgctatatgactttgtatcaaaaatttgaatttgaatttcaaattatgacaacttcaaacaatattttcaaataataaatgatttcaactgaaaaagtcatcaacaataaagttgtacaactcatcaatatttacaacttttgttttggtcatttttctatatgacttggtttgaacaatatgaatttgaatttcaaattatgacaatttcaaacaacattttcaaatactaaatgatttcaactaaaaaagtcatcaataacaaagtggtataactcatcaagatctataacttttatttgggtcatttcttcatccgttaaagcgaattgtaacattattcacaaaatgtacatatctcttatacagtttataaactatgagagagatatgtaaattttataaataatgttattattactttgtcggatgaagaaatgaccaaaataaaagttatagatattgatgatttatacaactttgttattgattactttttcagttgaaatcatttagtatttgaaactgctgtttgaagttgtcataatttgaaattcaaattcaaattattgaaatgaagtcgtatagcaaaatgaccaaaacaaaagttgtagatcttgataagtcatacaactttgttgttgacatttttttttcatttcaaattatttactaccagaaaaattatttgatttttcttatatttaaaattcaaattttatataggtcaatcaaagtcagatggagaaataaccaaaataaaattgatagatctaattaagttatacaactttgtttttgataactttttcacataagtttatttagtatgataaaatttgactcggattttttatattttgaaattaattgagaagagggaggcaaaatggacttctcggcgaggggggagcaaatgggctaggctggcagcccgaagaagaaggaggggaatgggaagccggcccaggacggagagaaaggctgcgggctgagggagggagagagtaacacttgggccaaaaaaggcccaaggacagagagatattttaatttattttccatttattttaataggttaaatgaactttgtggtattaaaactatttattgagctccgaaaattcacggaaaattttagagaataatttagaccacttagaattttacaaaaatatttccggccatgatttttaaaggaaaaatttagtttcctcattaattcacttgattaaattgctttaacttttaatatatttcctgtagtgaaaagtataagtgagtgcatacataatcaactaaaagaagtagctatgaatgttgctggataactataggtgttaggttaaattcctacaagctccaaatattttttgttcgcacactatatatatgcaaatattttcagttttaccatatgcaacatatacaagtaacaaattagtaacaaaataatttagttcaaaaaaaatttgtcttttgggtttgatttgttttgcaatcatttactgcttcaaaatgttgtttgaagttgccactttttgaaatttaaatcttcaattgataaaacaaagtcacatgaaagtatgacaaaaataatagttgtaatagcacaataaatggatagatcatgagtttagaaaattttataaaaaagaataattaaagttgaagttagtatgagggagataaactaatttaaatttttatacacgcattaaaagtaaaaatctgcagctattctcgtgaattttatgatgaacaccacgagcaggtggcaggtccattacctgctacagtttgatatataaaatacagtgcacgtcgtttggcaaaacgcttcagtggctcagtggggtttcctcatgaatactgtgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacaccgtgatgattttaaaatcacacactgtgacgatctggataaaaccgtcacgagttaacgggccaagaatatccactagtgcacgtccatgacggaaaacaaattatcgtcacggattgcctctgtcagtgacggtttatgaatccgtcaccaagaatccgttatggattaacaagtttcttgtagtggcatgtgtaaaaagtgcatggaccggtgttaacctccacaaagtcaggcggtggaccaagaaaaaaggagagagtagtagtcttttgctggtcacgttaattatgatagggttacatgtgtatgcaagcatatgttggctgccatagtacgtgcatgcattatactactgtgcaacattggtttacgtatggcagggagccaggaagaccaataagctagctgtgtggtggtgctaattaaacgtggagatcaaagcgtgcaaggctaccaggagtctaggacgcattggttggcataattaaggtggtggtgattcagtagagagatgcacaggcgcaggggcaattggtgtggtgctgccatgataactaagacggaacttgtatggtctacggtgacttaggagatggtacatcatgtggcattcggtccagagaggatcgaggctggttaaactgggccggcagggtggttagaccgacggactggttagactgcggagcttggacggttagaccgggttcaacggaccggtggttcgttgcagaaacttgtgagcggattcagaagaagggcaaaaaggttctacggtctggatagtttgcaagtgacaatggcgaatagactggcggcgacaggtcggtcaggtcgcatatggaattatctggcagacatgatatatatgggactcgacgaggagttgagatatatggagttagaccagaactgaagggaaaaaaaagatcccgggcaacagcgggtcaaatatcgttgatggggtcaacgaaactgtttggcaatacaggatatatccaggatatgcaggtcggcatgatgggggatatatggaaatctgcgtcactgaagaggaaaagcaagcgctatggtgttaatttcttcaagggattcaaggcaacagtgaattttctcaaagtatcataggttcagtctacggatgcgggaaagcgaggatgttggatttattagctcggttcataagacaacaaggaagaaatggttctcttcaagtctggtgagtttgatttatctatttggtgatgacataggttatctggccatggattagatcaattcaaatttaagatggaagatggaggtgaacatggtcttcggggagtctatgatgtgacagctaggaagaaatccaatttcgcttggcaagacgactgagatgataggtaagaaggtggagcactgttgcaggtggattcaagaggaagaaattgcagggatagcggagtctcttcaaggcggcgggtctggcgcaggctcgtcaggcggctcgtggtgaagctgcaaaaggaaacaacccaagtctggaggacagatggattggcatggtgattctactacttctgggtggcgtatattcgccaaggtagagtttgttagaataggtgtcgaatatactagtcctatttggttacagttggacttggagttgtaataggtgttaggggtggagttagagtcggactctataacccggcaactctcttaaatagagagggggacaccacaatgtaaccatggcgactacagtgtagcatagacacgcagggagaggatggcggcttggccatggactcgtagcggctaagagatatattggttggggaggagcgcccataatcagagccctgggaatgtaggcttcggctgaacctcgttaacaaatatcgtgtgttcctgtgtcgtcatctggcatgtcttgggtgatcaatgactgaaacgatcgggagggttagtcgtcattccgctatatcgactaactttgataacaatactctctttttttagagctagggcatcactgcccccatttctattaccagaaacgggaataagtgtcttacagagcaagagaggagagggagaatagcagaaaaagaaaaaaactagaagcagaaacctcaaagggaggattacagttttcctttgccccagaggagcgaacacagagaacatagcagtaacaatgatactgctatgttctctgattaatactacgtactccacaatgatactgtcagtcaagtgtcaataatccgttttgaactcaggtactggggcttccgctagttgaccgatcagcttgcattatgcggcgcactagttgtttgtttacgcgttggaattcttgagcgaaagcgactgcatgtagccttacgccctcgttaatccgtttagtgcttaaaaacaggcaagaaatcgatgccaattttccttttttggtccttattagtcagcaaacccagtctgttttgccgtcttagaccaaactatttgctggttgctagtactagttattaaccatggacgtttcttcgacagtaaccgtggagtttgttttcagaaattgattatcaatccacagctcttatcttcaaactgaaaaaggtcgcaagataggatcacatgagctcaccatcagcataacgagatggcagacagcgacagggctagcgtatgcatcaactccggacaaaataatatactataaatatgtaaaaaaatagaaagaaaccatagattctttgatcctactcctcgatcctcggttcctgtagcagaagatcatgcatcaaaataaaatatttcctctattctcgaataattcacactcgtaatattcacgcttatttttgaaaaaaatatagatactcgaaaatatgttgtattatcgaaattataacattataaatataaccctataagttatcattcatcattagtaatttatggtcaaagtacaacacccatggtcaaaagtgacacattagagaacagaggaacaaacaagaaatggagtcgcttgagccagtcacactcggaagtcagaacagagaggatctcaaattcaaagtcaaagggacatggcactttcattagccacctgatacagctagcttcatgaactgctgtacagtaatacaatctttgaatcacactcacatggaaccagaaggtatttcaatcagtatatagcgcggaagaagggggcaaggcacatggaatggggataggagagcgcgctcaagtcaaaatgggtttagttctatgcaactaaaactacaattctatgtttgtatattgaaaatatttattttggaatcgagagagtagtactatggattggctgctctctacagtaaggtgccatcaatttcccaataatcgtacaatctaacccgtgttggttaaacattctcggattctcaagttataagttgataaaaatgggtttcagtagctgggcttgacatcgtcattggctctgtcactaagctcaaccgcgacaacattttagtaattggtatatatgttgcattcagtatgcaacatttcaaggaaaagggcatataacttagcggttgcagtgatctaagtagcactcgaaggttttgatttcaaatctccataggagtgaattttagattgagctattttgagaggttaagttcccaatttaaaaggctgcatatatccaattagatatggaggccggaaaaaaattactcttctaaaaaaaagtactcaagaaagcactattaatccatatttgaagcttcaaatagaatgaagaagaaaatatgcaacatttctttttctaaattgcttcaagagaatataattaatattggtagggaaacatgaagagaaatacaaacagaggcttgattgaaatctgatatcggtattcgccagccaagtctggtctgaaacggggaagtttgcaagagttgggttcaatcccacgaaattcctccaaaatctcccgttcgaaaggaggtctaaaagttaaattcctttcgtggaagaaaaattcttgcgcttcaaattaaaaaagaaaaactggtccatgtgactatgtctcacgaaaattgccgattgtgtactttacacacagtactgccgtactgggcttgtaattgtagatgaacaatttggttcaggtgatcaggtccgggctttcttaaaattgggcaaatcaacgaaaatgacagaaacaggccagatgtcaagaacgccatggcccgtctgtgaacttggcagaacagcccatgtgtaaactcaaagctttgaggtttcaagttttttttttctctttcaaattatatactgtacacgtactattgtcttcttctatccagtatccatggcgcaagcccagtacggataatattttacaattgggacttgggagagtatattttaccacttcaaataatattttcacagtcctgaaaagtatttacaatcatgagataatgcatctggtaggaacgggcacttaccgtagaaaaataatcttacaggtgtcagccaaggaggcacttacccagaattttgtaaaatttactcattaattaactatttcttccgttccataatataagtatttttaatgtttaaattttttccctcgatatagcaactaatcaacctattttcaagtcaaattactttcttgtcttaaccaatcacaatctatcagttaatttgtttatatattttttttctgcttgaaccaatcataaccattctgctctacaatttgcttatattttgcaatgacacaagtatattatatggcacgacaacagtacactagccctgattacccaaattctgccacgatcagatagaaaattgtgtcttccagagaagaggaagagagattctacacttacccatcaaactccctggttatcaccattccatgggctaaaagaaacactagctagtaaccacatgcgcacaccctaatagtgactttgcgtaagttggtttcacaagtcatctttttctgatcttttttaagggtgatcgcgtgcacaaatcctagtaccatcaaaaggttggcacatagaaatttcagtgacaatatgtaaacatgttaggtcacagtcacattggaatgttatgtgcgtgtgtgataatctgattcctttctgaagaataataaacagtgtaattcctctttgcttatgtacattaatcagtgtcagtcttttcatcatcagaattaccggataggagtagggtattacttcttgaataagaaggcctgaacctgtataaaattccttgtcttcaaacccatccattttcctagcttgatagccacccccttttattattgccaaaatcttgtttcgatagttactgtggagattatggttaccccatatctacatggcggttatattccagctggatatacagtaccaaatatagatagaatatttttatgaggactcgggttagattctaaacttgtatgtcaagaaaatacctggtatcctagtcggttacgattgtgttttatctgtaatcccatattccgttaggatatgggttgtactttgtattacggatcccttcccctatataaggagggtccgtgtgcctcttggggcacgattcttttttcccaattatacaatcaataacacactcggcggaatcatctccggacaggagtagggtattacttcttgaataagaaggcctgaacctgtataaaattccttgtcttcaaacccatccactttcctaacttgatagccacccccttttattattgccgaaatcttgtttcgacagttggcgcgccaggtaggggtagcgtcaagttctcgcctactaagtgcgatgggtttcgtttctggcatcgacgacttcgccttccctcccgggcaggcgttccggttcggcagcctcgacttcatcaccaacaacttcggcaagatttctctccttgactcggattcagaccagtcggggagagaccaggtccccgtgccattcggtattctgaactcggccaaggcctactccaagataatctctctcgagtcggcttcaaaccactcggacgagatccaatctactcttccgcgaccagatcaagacgacgggtcctacccctcaatcttgatgaaacttcctgatgacttggccgccgttttcacagccaaaacatctcccactcggagatctaggcgagctccggcatcggccccgatccagtctagatccaggaaggtcggcgttatactccaacctcttgggacagtctcgacggaagaattggatggctccctctgctcccccggcgtcagttctcgaccaaccgagatcctcgactacgacgacttcggctaccactacgaccacggcgacctcgacaacttcgacgacagctatgaggataactacatgcccctcttcttcggcgtattcatggctgacaacgaaacggaagaacagcgccgagcccgagaagcggaccaagatcgcgcacggcaaggagctgaacgtcgctgactggaggaagtgcgacagcgacaggagcgagaacgactacagcgtgagcaacaagatcgcgaacggattgcaaaggaggctgaagatcgacggcaacgcgccttggaatctgggcgccgagcgagagagctcattgggcaacaagacgtcgacgggacatcggtcttccgcaccgcccagcagaacgcggttgcagcaatcactctcctcgacaccctcctcaaggaagacgcactcaaccaagccgatcatgttgtcaacatcttgaaccagacgaagaccatgatcgctgcctcggttccagccaactccgtaagcatccgcaccccgactggtagccgagcccctcacctctgatctcatgatcatcatcagccaagcctcagcatcaccggcacaggatccagtcgcaggagcaggggtcacgacgaacgatctgttcactcgcctcctgaacgtcacagggagcgccgagtcgaacggcctcgctctccacctcatcagcgccccgtcgatcttcgcgacatgatcaaccagcaccgtgcagcacgaggtcaccgccattcaccaaatcgctacgacgacgacgtggatagagtggctaccttcactaatgacctacgtcgagtggattggccagtcggctttaagccgactggaatcgagaagtataacggcaccactaatccggagtcttggctcaccgtctacggaatcgcgatccgtgcagcaggaggagacagcaaggccatggcaaactatctacctgtggccctagcggactccgcccgatcctggctccacggactaccccgtcgcacgatcggatcatgggcggaacttcgcgatcacttcatcgccaacttccagggcacctttgagcgccccggcacacaatttgacctctacaacatcgttcagaagtctggagaatcccttcgagattacatccgacgcttctctgaacaacgcaacaagatctccgacatcaccgacgacgtcatcatcgccgccttcactaaaggcattcgccacgaggacctagtcggcaagttcggacgtaaacctcccaggacggttaagcagatgttcgaaaaagccaacgagtatgccaaagccgaagatgcaatcaccgcgtccaaacagtcgggcaccacttggaagccaaagaaggacgcaccgactgcaggggggagtggaagtaacaaccacaaagatcgcaagcataagcccgaagaacttgtggcgaccacctctccatcttaccgacaacgtccccgcgtcaacaccttcgacaagataatgaactcccaatgtccgcatcatcccaactccaaccacgtggccaaagattgcttcgtctacaaatagttcacagaacaatacgtcaagaacgcacgtaaaccttcagacggagatcaaggcacatcaaagaagagatgatgaagacgatgccccgactggttttcaagatcatcgcaaagaacttaatcacatcttcggcggacccctggcttatgagtccaagagaaaacagaagctaatggaacgggagatcaatgcggttcagcctaacacgccccaatatcttcagtggtcagaaacagcaattaagttcgaccgctcggatcatcccgaccgagtggtccacccggggtggtaccccctggtactagacccagtggttcgcaatgtcaagctccgacggactctcatcgatggcggcagcgcactcaacatccttttcgctaaaaccctggacgatatgcagattcctcgcacggaattaaagccgagtaatgcacccttccatggcgttatcccaggattgtcagctacaccactcggccagatcactcttccagttaccttcggcactcgggagaattttcgcacagaaaatgtttgtttcgaagtcgctgatttcgagatagcatatcatgctatactcagacgaccggctctagccaagttcatggctgtcccgcactacacctacatgatgatgaagatgtctggtcctcgaggggtcatatcactacggagcgacatcaagcaagccgtcacatgtgacaaagaaagttgcgagatggctcaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagttagattgtaaataggaaagcgcgctcatcacctttcttcagaataataaagatatttttgcgtggaaaccatccgatatgcctggtatccccagagaagtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgactatatcgacctcaataaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaacgcaggagcaacctatcaacgcatgattcaaaagtgtttttcaactcagatcggtcgcaatgttgaagcctatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccagagaaaatcaatgccatcctcaacatgaaaccgccaagctcccaaaaagacgtccaaaagctgactggttgcatggcggcgctcagccggttcgtctcacgactcggtgagcgggggatgccttttttcaagctgctgaagaagactgacgatttctagtggggacccgaagcacagaaagcctttgaagacttcaagaaactcctcactactccaccagttttggcctcgccacatccgcaagagccgctactgttatatgtgtcagcgacctcccaggttgtgagtacggtcctggttgtcgagcgtgaagaggaaggccatattcaaaaagtccaacaaccgatctattttgtcagcgaggttttagccgactccaagacaaggtatcctcaggttcaaaagttattatatggtgtcttaattaccgttaggaaattatctcactactttcaaagtcactcgatcacggtggtcacatcgtttccactcggggatatacttcataatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggactatgcatttttgatgggtcgaagaggcttacaggcactggagctggggtcgtcttaatttccccgactggagaaagattgagcgacgtattgtggatacatttttctgcgtcccataacgtggcggaatacgaggcgctactccatggattaaggattgcaatctctttaggcatccgccgattaatcgtccgtggagactctcagttggttgtcaatcaagtcatgaaagagtggtcttgtctagatgataatatgaccgcttatcgacaagaggtacgcaagttggaagacaaattcgatggacttgagctcacccatgtcctccgacataacaatgaggcagccgacagactggccaattttggttcaaaacgggaagcagctccttcagatgtgttcgtcgaacatctttacgaaccgaccgtgcccagaaaagagacaactgaagccatggatactcaaggcgtaagcatgattgaagccgactggagagaacctctcataaaatttttgaccaaacaagaactccctcaagacaaaaatgaagccgagcggatttccaggcgcagcaggctttacattattcacgaagctgaactgtacaagaaaagtccatcaggaatactgcagcgttgtgtatctttggaggaagggagacaattgctgaaggatatacattctggtatttgtggtaatcatgctgttgcacggaccatcgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccatttgcggtctaggggcttgacatggtcggcccatttaaaagggcagtcggtggttacacgcatctctttgtggctatcgacaaattctccaagtggattgaggctaaaccggtcatcacgatcacagcagataaagttagagattttttcatcaacattgtgcatcggtttggggtacctaatcggatcatcactgataatggcactcaattcactggcggagcatttaaagatttttgtgaagacttcggcattaaaatttgttatgcctccgtggcacaccctatgagtaacggacaagttgagcgcgctaacggcatgatactgcaagggatcaaagcacgagttttcgaccgattacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgattttggaacttcaacgaggagggctatgaagaaggccgagtagacgacatcaaccgactagaagaagcccgagaagcagctttaattcagtcgactcgatatttgcaagggttgcgccgttatcataatcggaatgttcgatcgcgagcctttttagtcggtgacctggttctaaggaaaattcaaaaaacacaggatcggcataaattatctcccttatgggaaggaccgttcataattgctgaagtcactcggccgggttcttatcgactcaagcgcgaagatggtactatcatcaataattcttggaacattgaacaccttcgtcaattttatgcttaggcatttcgtttgtatctttcctctttgactgctaacttcaagttttttcttgaagttttcagttagggggctactataataataatggagtgtgatttttatcaattcaatttgcctacttgatgtatcattgccctgtttgatttcttggcttagtcaatgaggactgaaagttttttaacaacttttgcgggttttaggctcaacaaggtttgacaaaaacttttaagaaatcaggagcaaagttaagatatcaagcacagcataaattcatcagtattgtacaaattgtgcctccatcatcattaatcatcaaaattatcggtacattaatcagtctcagtcttttcatcatcagaattaccaggaccagtcggtcgaagatcggtgtcctgaaatctctcaactacatcagcagcaattttgtcagccgctttctgcgcatcactgatgaggtcaagagcagcttcttcgctcgtcccgtctgcaaagccatcaatgacgtcaatatcaactctcggataaagggatttagtcatcgccaacgccatacttactcccatacttccagcttctttgatgttcttgaaatatatatccggagcaactctcagcttgtcgaaaatttcggaagcatcaagtgcactcgggccgttgttatttaagaacatcgcttgaacaattggggcagcagcgttatcaacctcatcccgggctccttcaagttttttgatcttgctaaccaggacgtcgaattgagcttgagatttaatcttgcggtctgcatcaacagattcacattaataagtcagcatatggaggataatggcttttgagatattgattgttgataccttcaacttcctttaaagccaggtctctttgtcttgccagctctgccttgtcgttttccagaatttgaatctgcttctccaactgagatatcttggcagtttgcactacattgactacggttaatcaagattgcaaagataacaatatgagtcagttaagtagggtttgtacgtaccttttgatgagccactcagttcaaaatttgattcctggagctcagcaattcgattcctcagatcatgctcattcttcctggcaagctcttttgtctcgtgcagcagactcctggtggcttcgagggtcccgagatgagggactagcctctctaaggtttccgttttagcttcgttcctaagatgaatcctctgcaagacagtttaattagcgcctgaattaaatggcaaacaagatggttgagatcaggtaccagagggcttacatttacaatgtgggttgcctgaccaagtgccttcttcagtaggcataactcttcgtcctctttttgcttatttatcacggtcccttgaggctgcatgttgtcatcccaccacttgaccagaatcggagggcgtgaatcctcagctgcttgtatgcggggaatttcttcttcatcactgatcattggccctaatgtatctactaacagaggttagacaattggtcagagttatttgggttgacatggtttcagacaaagtgttttacccataatgatttctggatgaggatgagtggattcggatgcctttaaaggagatctagatctctggttattgctggcgtcttgactgcgaaggctatctgcttgagctccaacctctggaatctcttggcttggccttgcgtccgactggtttctagtcgggggctcctgattaaccccggcttcggcttcggccgactggtttccaatcgggggttgatcaccggattctacattatcggttgccggctgattgtcacttggacggtcctcggcagttgtcccgatttctttggaagaatttgcgtccacgctagtcgggtcagagtctttccctgacggatctatatcagatggtttcctgcaaatttgattattagtattattgctgcaatggatgtgcatcaatgcaagagagatcgttatatgagttgtacctagaagacttcctgatctttggcgcagggcgactggatgttttcttctttggagtagcctgttttgatagtttcttggttgtctctcggtctccaggcctcctggtggtatcatcggcttcgtcgtcactcagaaccagcttcctctttcgagagtctgactggccgactgaatcagaagcacttggttgagtttcagaccgaattcttggtcctccgctcccttgcccagtttggtggcggggagatcggcgttgagcgattgggggatccgatttcatcaaagcaaattcctgggtgtaatatctttcattattaattgattcaacaggaagacaagatcatattttgaggaaggttgaaatgtttgagtgcataccggtggaggagggttgaatgcgttgaatggcacaacgggcagcagatgtgaatagctgacgacaatagcgtttgagaagatcttgtacattctttctttcatgaccttaaagtcaagagaatctggatcttcccgatttggatcatgcttgccgtcgaactcaaaagctgtgcgggatctttctttgattggagctaaccgacacttgatgaagtgctgggtgatctgctctccttgaagaccctgttctttcagctttatcatcctctccatcagttctactgcctgagcagcttcatctcccataggcaatgagttccatgtgtcctggtaaaccggaggaagacagtttgcgtgctcaggagtgcgggctcaggattctgaacatagaaccagtttgcgtgccagcctttatttgaggtcttgaagggcatggagaagtatttttggcttagtgttcccctgagttggaaaccagcacccccaactacgcatggtttgctcttatttggctggggcttgaggaagaagatgcggcggaacaaggcaaaatgaggcctaatgcccagaaaagcttcgcaggcgtggataaaattggcaatatgcactatggagtttggattcagatgatgcaagctaatcccgtagaagttcagaatgccccggaaaaatcttgaggttggaagagaaaatccgccatagaagaagtgagcaaataccacgatttcatgcgtatcgggagtcgggaatgcttcgccaaatgccggtcgccacccgatgatctccttcgctggaagaacgccgtgcgccaccatctccttcagattatcttctgtcacatcggagggcgcccactgactctcgaagctttctctttcttccaccatgaatgtgaactggatggtttgatttggttcgagatacggatggaaagggatgggggaatcggtgcggtggacgcgtggagaagattcgtgggatttttgagaatggattggggcggattgatgaaccctagctccgtcggcgtagtcttgtactgtagcgaggaatggggaaatggcgagagtcttggcggggaagacgaagcgtcgcttggacttcggtgttttttagggtatcgtgagtactaatgggcctgggcctgtacagtacttcagcccaattttatttccagcgtggcccgttgtgattcttagggacttaggcactttttgctttggcaatttgtactcacaatgttgtggcccaatgctgattaaatcctttttaatgcggtttgctaattctttagaattaacacgatgcaaacaaaaggtgcctgacagaaaggtgttatgccgtttttgtaagctttattaggctacaaaagctgtttgggttgatttgagatgactggtttattcatagttattctcttagcatgttatatgcttattttgattatggtaaaggttatagcctaggctaatgaacttcttaattaccatgatctttatcatatttggtggatcattttaagagtttcttgctcggattcctaccaaatatatatatttttagaccttttgagtgtttatcactcggcccttcttgtattttttgtccttgatatattcaagattgagaagcagtcggttgggtatcttactaagtaccatgcgtgcttcactataaaaccactcggttcttgactatatgtttagtttttcaactaatcacatagtcaggggctacacctaattaggtgcatctactcgatgcaccatgttttattttcgccctttacagtcttttagcactcggcaagccggagcaagttgaattaaagcactcggattattgtttttgtttcgagaagactattttggtcaactgtgaaggtctcgggggctactgtggagattatggttaccccatatctacatggcggttatattccagctggatatacggtaccaaatatagataaaatatttttacgaggactcgggttagattctaaacttgtatgtcaagaaaatacccgggatcctagtcggttacgattgtgttttatctgtaatcccatattccgttaggatatgggttgtactttgtattacggatcccttcccctgtataaggagggtccgtgtgcctcttggggcacgattcttttttcccaattatacaatcaataacacactcggcggaatcatccccggacaggagtagggtattacttcttgaataagaaggcctgaacctgtataaaattccttgtcttcaaacccatccactttcctagcttgatagccacccccttttattattgccgaaatcttgtttcgacacagtgtaattcctctttgcttatgtactttttcttcacttaggcagcgttcgtttggaggacattgagggagaaagcacctcgttttccgcacgcacgcttcccaaactattaaacggtgtgttttttgtaaaaattttctataagaaagttgctttaaaaaatcatattaatccatttttgaaatttaaaatagttaatactcaattaatcatgagctaatggctcacctcgttttgcgtatcttcccaatctcctcaaacacacccttattgtttatcggacatttaactgagcatatatacagtgccaaacagcgggaattggcatcccctgtttctcctttcttcagctttgtcagcacactgaactgtacaaaatcagttcatcttttcccacctaattctgaaaatgacatcaatagcaaaatgatcaaacaatcaaaattttcatagaaataaaatattttccttatcgcaattggcaccttacatttagatttattctaagttactcggcaaaaagaagaaggattaaattagtccatcgcttgcactgtttcatctgctagtgccagctccaacattttgaagagtttactattatagcttctcaacatctcaagcttgatgtaccaacctgtcgtagaaagcgtcctaccagtaagagcaatgatgcaagatcaactgcatataaacaaacaagcaaattaaacaaacacggtttgcaagtataaaaaacttatgtcaccttaattacatgcagtgcaatccagccagcagcaacaacaattaattgcacttggttgacctctataacattaaaaaatccctaagaaaattgctgacataatgttctagtcaattggtgttgcaactacccgtacatggtcagcagctgaagcaaggacgagagctcaactaaggaggtcattatctaaaaaaactagggatatgagggaaataattagaggattaaacagttcaattttgtactggtccacgcaatggaagagctaatagaatgttgtaattgcgtgtcaaatagattatacattgttgtgtagcttttggaactttcttttttcgctgaaatgtggcttttggaactcaagcatatcggatagataggcttgcacaagttgtccactagatcactactactgttgtatatgcactgggatgactatgaaagtacacaatggttggtaaccgtacactcaaaggaatacccagttttttaaaagaatttagggtatcaacttcaaacgagaaaaataattcatgaggggattctctattctccagccaaggtttacagaaccgattgccttaagacaaccgtgataatcaagcggttattatcgaaaaccagcaaaacttgttgaaaaaattgtatgctttttaaagttatctactttatcgagcgattcgtaaatacggctacggctagatagataagattgataaccacgataaccaaatggttattgccacatttgaaacggttatctaaagttttttttttttttgcaaatataagattgcttcaagatttgtgctctgacccacttcactcacttagtctctagctctatgcagaatgtttgtgtcctttcacccatctctttgccaccaatgcttaacggtaccttggaacacaggaaaaataataagatttcaaaggatttaaatcttatagtaaaattttctattaggtcttttggaacgaatcaggtcccagcccatataattcttttgaaatttgtgtggaatggcatgtttcatgggaattttgaaggattcctggcatgagctctctaatctctttggaatttccatttatgcctacctctctctgccatatcctgtgcttttcttgtattccatcccacgtagttttcctgtattttttgttccttacaattcaaggtgttactgacattctatttttatgttttttatattcctaagttccaaagagagtattggacccatgatcttgtatctttaagtgcctaccaagccagcatcgtgtcatagccggagcatcaatctccatatgaatccaatcgtgacctcatggtttgaatttttcaaattttcataatttttggacgccaaaagtctagcaatcctattttttgatagagatatatttactcatcacatatagagaaatcatatctcgaacaaacagtgcgcttgatggcgcccgcccaaccaccgccggctcagtcgctctaacacctctcgatcacctccttgcaagcaatgctagccatggccgccgccgcgctctcgccggagcgcgtccagtcgtcgtagcccctactcgccggcgccgctccaatcaccgtggttcagccacccgcggcggagtatgaagcgccacgacgcgggaacgccgccgcggcgcgcgcgcgaccatgcacgcggcgtgcttgtgctccacctgctgctcgtgtcggcctcgctgcgcggcgcgacggccgcgccgggcgaggcggaggcgctgctcgcgtggaaggacaccctgccgcgctcggcggcggcggcggccggcgtcctcgggtcgtgggcgacgccgtcgccgcagcagccgaacgcgaaccccgccgtcgcggcgtgcgcgtggcgcggcgtggcgtgcgacgcgtcgggcgtcgtggtgggcgtcgacgtggccggcgcgggggtcgccgggacgctcgacgccctcgacctctcgtcgctgccgggcctcgccgcgctcaacctcagcctcaactcgctcacgggctccttcccgtcgaacgtgtcgtcgccgctgctcagcctccggtccatcgatctgtcgagcaacaacctctccggcccgatcccggcggcgctgccggcgctcatgcccaacctcgagcacctcaacctctcgtccaaccagttctccggcgagataccggcgtccctcgcgaagctgacgaagctccagagcgtcgttcttggctccaacctcctccacggcggcgtgccgccggtgatcggcaacatctccggcctgcgaacgctcgagctctccggtaacccgttgggcggcgcgatccctaccactctcggcaagctccggtcgctggaacacatcaacgtcagcctcgccgggctggagtccaccattcccgacgagctcagcctctgcgccaacctcaccgtcattggcctcgccgggaacaagctcaccggcaagctgccggtagcgctggcgaggctgacgagagtgcgggagttcaacgtctccaagaacatgctctccggcgaggtcttgcccgactacttcaccgcctggaccaacctcgaggtgttccaggcggacggcaaccggttcaccggcgagatccccacggcgatcaccatggcgtcgaggctggagttcctctccttggcgaccaacaacctctccggcgcgatcccgccggtgatcggaacgctcgccaacctcaagctcctcgacctcgccgagaacaagctcgccggtgcgatcccccgcacgatcggcaacctcacgagcctcgagacgctgcggctgtacaccaacaagctcaccggccggctccccgacgagctcggcgacatggcggcgctgcagaggctgtccgtaagcagcaacatgctggagggcgagctcccggcggggctcgcgcggctgccgaggctcgtcggcctcgtcgccttcgacaacctcctctccggggccatcccgccggagttcggccggaacggccagctctccatcgtcagcatggcgaacaaccgcttctccggcgagctgcctcgtggcgtgtgcgcgagcgcgccgcggctccggtggctcggcctcgacgacaaccaattctccggcaccgtgccggcgtgctaccgcaacctgaccaaccttgtgcgcctccggatggcacggaacaagctcgccggcgacgtgtcggagatcctcgcgtcgcaccccgacctttactaccttgacctgtccggcaactcgttcgacggcgagctccccgagcactgggcgcagttcaagagcctctcgttcctccacttgagcggcaacaagatcgccggagcgattccggcgagctacggcgccatgtccctgcaagatttggacctctcgtcgaaccgtctcgccggcgagatcccgccggagctcgggagcttgccgttgaccaagctgaacctgcgccgcaacgccttgtcgggacgtgtccctgcgacgctcgggaacgccgcgagaatggagatgctcgacctgtccgggaacgcgctcgacggcggcgtgccggtggagctgacgaagctggccgagatgtggtacctcaacctgagcagcaacaacctctccggcgaggtgccgcccctgctcggcaagatgaggtcgctgacgacgctggatctcagcggcaaccccggcctgtgcggccacgacattgccgggctgaactcttgcagctcgaacaccaccaccggcgacggccactccggtaagacgaggctggtgctcgccgtcacgctctccgtcgccgccgcgctgctggtgtccatggtggccgtggtttgcgcggtgtcacgcaaggcgaggcgagccgccgtcgtcgtagagaaggcggagacgtcggcgagcggaggcggcgggagctcgacggcggcggcggtgcaggcctcgatatggagcaaggacacgacgttctccttcggcgacatcctggcggcgacggagcacttcaacgacgcgtactgcatcggcaaggggagcttcgggaccgtgtaccgcgccgacctcggcggcgggcgcgccgtcgccgtgaagcggctcgacgcgtcggagaccggcgacgcgtgctggggcgtcagcgagaggagcttcgagaacgaggtgagggcgctgacgcgggtccgccaccgcaacatcgtcaagctccacggcttctgcgccatgggcgggtacatgtacctcgtgtacgagctcgccgagcggggcagcctcggcgcggtgctgtacggcggcggcggcggcggcggctgcaggttcgactggccggcgaggatgagggcgatcaggggcgtcgcgcacgcgctcgcctacctccaccacgactgctcgccgccgatgatccaccgcgacgtctccgtcaacaacgtcctcctcgacccggactacgagccgcgggtgtcggacttcggcacggcgaggttcctcgtccccggccgctccacctgcgacagcatcgccggctcctacggctacatggcaccaggtacaaactgtccgtacatccatagccacacagggtgaaaacggtcggaatctaacgacgctgctagttgattatatttatcatttaaactactcagtacgatattaatgtgatgcataaagaaattagaaaaaacaaattttatatctatgatatttaaaatcttaatagtggtggtgtccattcgcacgcaatctctaccattgacatatgggtctcataatctatactattacctttcagcaaatcttcaatttcaccattagctctcccaaatttcaaaatcacctacttgttgaaataagaaaaactatagtattacttagactaaatagggtcttattattaactagctgggtgacccgcgcaattacgcggctagcacccaaacaaaatcatatattattttagtatgattcatttaaaatttattaaataactagctcattgtcttaagactttgaaagaccaaaccttatcatcctcgtgtttctaattatatagtttttaaaagtcacaccagttgctaccccttatgtcatctccttctttatttgcttgctcgatctatcactatttctattcatttttcttggaacatttaaaaattggattttatagtttttagagtttattgttatgttgggtttcatttttataatatctagatgtcccgtcaaacgttgccattatactcctctatggcccgtccactgtctcttctctttattgtcattgagatttttaaaatcgaacataattatcatttgtgttcattttttactttctagaagtcccgccaaaccatcagcggctttgccattgtactcctctacggttcgcccgctgcctcccttctttattgtcattgagattttaaaatcaaacatgattattattgttttttttttactttttagaagttccaaacctttaaaaattaaacttgtagttttattttttataatttttagaagtcccttcaaacgatgccactatgcccctctacagcccgtccgccgcctactctttatcgtcattgtgattctaaaaatcgaacataactatcgttagaatttattttttattttctagaagtcccgtcaaccgtcggcggctctgcaactatactcttatacaccctgcccactgtttttcctttttattgtcattgagattttaaaaatcgaatatgattatcaatggtgttttttttttactttctagaagtctcggcaaccgccttacttgtttgcttcacggcctacttgacgtccctccttttaatcgtcattaggattctatttggtgttttattaacaatttttatatgtcgtatcaaccgccactactctactcctttatatgcatggtacttaatttatctcgtcatgtgttttagatggttttctttcaatagtctttatttttatcacaaattttatacattgtattcctaattgaaatcttatttttctttttctattttcagaatttaattttttttagaaaaattagttaataccgtattgtgtttttttaatgtttttattttctattttcaattttagttgtttcaaaattgtattcctacttgaactctcttttaatttttctaattttggatattattttattttttattcaaaatttttattaatctcgtattaggttcttatatggattcttcgttcaatattgcctatttttaatttcgaatttcatctaattttaaattgtattcatacttgaactcttcttttattttcttttgctaatttcggatttatttttattccgaattttaattaatctcatattgggttcttgtatgtactctttttttaatattccttatttttaattccgactttcagttatttttaaattgtattcctacttggactctcctttccttttctaattttggattttattttatttttatttcgaattttgattaatctcgtattgggttcttatatggaaacttctttcaatattgcttatttttaattccgaatttcagctatttttaaactgtatttctacttggactctcctttccttttctaattttggatattattttatttttattttgaattttgattaatctcgtattgggttcttatatggaaacttatttcaatattgcttatttttaattctgaattttagatatttttaaattgtacttctacttggactcttcttttctttttttttttctttttctctgattaatgtgggaatttctagcccccacagcgaacatggtgcctcctttcaatgctgttttaataatataatagattgattgattgattcaataagctagaaatttaatttgttttctgttgcaatgcacggactctaagctagtatagccaaaaaaaaaaaggaaaaccgttgaaaacagtgccccttaaacataaacggcgcccaattgattgagaattttcgtgaccattttcaccccttatacacaccgaatccgccattgacgctgataccatgtttatcttgcggtcttgccgcagagctggcgtacatgagggtgacgaccaagtgcgacgtgtacagcttcggcgtcgtggcgatggagatgctcatgggcaagtaccccggcgggctcatcagctcgctgcaacactcgccgcagtcactgtcagccgaggggcacgacggcagcggcggcggcggcggcgaggaggcgtcggcgtcggcgtcgcgccggctgctgctcaaggacgtggtggatcagaggctggacgccccggcggggaagctggccgggcaggtcgtgttcgccttcgtcgtggcgctgtcttgcgtccggacgagccccgacgcccggccgacgatgcgcgccgtcgcgcaggagctcgccgctcgccggcgaccgatcctggacaggccgttcgagatgatcaagataggcgacctgacaaattctcacagatgagagagaaaatttgtgacaaattatcgattgctttgtgcttatgtgattccgttagtagattctcattagcatctgtatagtttttgtacagtgatatttagtcccgtttgagaacagatgatgaagagtgttgattgactttttttaaaaaagaaattaaaaattggatttatctatctatgttttaaaacaagttttatggagaaagttatttcatgaaacacgtcgtttagaagtttgaaagtactaacgaaaggcgaggtaaaatctacatgtaaattaccgaacgtttgggctgaattgatgccttcctacgggctgaatttatgcacagttatcggctgaatttgcactcacataagggccgaattcacgccagcttttgggctcaatcgacgtaaacttgtcggccagattgaccagcatttctgggtcagatttacctgcatatatgggctaaatatgcgcaaaccaacggaccattgagcagaaagcattgggctgaaattacgtcaaataatggccgaatttatcctcattgggtccaactaacgctcactgttgggccaaatttacgggcctaatgggctaaatttgcgctcattttcggtccgcactaacgctcaaataaggggccaattttacgaccttttcggccgaactatggactgaatttactcccaaaaatcttaaaagaaaattcaaaaacaattgttcttaaattcgagtataatctccacctcagttcttacaaattttacccccaaaacacttttatcccactcacaaaaacttgtacatgaacaagtcaaaatactccatacaacaagaatcatccatccggtcatccctcttgcaaaatgcagagacacagagaagtagcagcagcagctcagcacgagaccccgcatggcttgaggacggggcccttgggcttggggatgaaggggtcgatcctgacccagacgagggagaagatggaggcgaggaggatggaccagagcacgacaatggtgggcgtccggttctgcctccccatgagccccttgaggaaggggtagaggtggaggatgacccagaaggagaagaagagcttcccgaacagcgggccccacgacccgtacccgttgttcacggcgtccgacacgccggcgacgatccccaccatgttgatgatgatcagcgtcgtcggcggcaccagcagcgtcgtccacttgaacaggtagagctcgccgaacgcgtcggtctcgtcggcggcggccttggacgtcaccgtgaaagtggtgtccacgccgncgagcaccttgaggaggccctggaacacggcgaacaggtgcgccgacacgccgccgatcacccagaactgctcgttcctccaccagtcctcgatgctcaccccgctccaccgcagctccagcacccccgtcgcgatgatcgacaggaaaagcgctatgaaccatatgctcgccaaattgttaagctacacgtacaccaagatcgcgatcgatcggtcagtgcaagatcatttggagcttgaaattttagcggaaattttgatgttcttggttggttctttaccgtggggatgatgaacttgccggtgaggaggcagacggcggggatggtgcagtaggcgaggaggggaatggaggtgaaggggtagacgatggtgttggtgtaggcgaagcgctcgagccacttgaggcggccgccataggcgtaccagagcgggcaatggcggctcatgaagatctcgacggagccgagcgcccaccggagcacctggtgcagacgatccgacaggttgatgggcgccgaccccttgaatgccgccctcgccggcgtgcagtacaccgacttccacccacggcaatgcatcttgaaccccgttaagatgtcctccgtcaccgacccgtagatccacccaatctgcaagaattttgatttttggttagcttcgatcatcttcctcgagcttgaaaatggtggagattttttgatggattacctccttgccccactcggtcttctcctcgtagccgcagctgatgacgtggatggcctccttgatgagggcggcggggtcggcggcggcgccctgggggaggccgccgtcctcgacgagggtggaggcgatgaacaccggcgactggccgaaccgcttctcgaagctcttctgcgacatgagcgacgagcgctccagctcgtcgtacccctcgaggccctcctcgatctcctccagctcgaacccgcgctggtgcttccggtaccctttcttccctccggcgagcgacgccgcgccgccgccgagcttgtccttcttgctcctcttcttgtagaacccgagcagcccgcggcgcggctcgtcgaggccgccgccctcgccgccgccgccgcccttcttgttcttgtgcgacttgccgcgcttccccccgccgaagcagcagcagcagcagcaccacgacggccagcagtcgcacgtcatcttcggcctcttctccggccgcggcgggtcgtatccgtacagcgcctgcctgttgaacaccgtccccgtccccacgtacaccggcccctgtatcccgtccagccccttcatgttgatctgcacatcaaacgacaccatcgttagctcacgtcacggcgcgacgcacgcacgccggagaagaaggcagtgctcacgtcgaagaagacggtgttgcggttggcgtagcgatcgtggcggtcgatgccgtcgaagcgctgggggaactggacgtagcacagcttcttgccgagctgcttgtccatgaggaagcacatggcctcgcggacggccttgctgttgttgacgtagtggtcgcagtcgaggttgaggatgaagggggcgttggtaagcacggcggagacgcgaacgagggagttcatggcgccggccttcttgtggtggttgtagccgggccgcttctcgcgggacacgtacaccagccgcggcagctcgctgccctcgacgtcgagcgcgccctggctgcccaggtacacctggatcatccccgggtggtccctcgtgttgttccccggccatggcgtcccgtcctgcatcacccacccttcctccggcttcttctgcgccttcgccaccagcgcgtttatcctcaccttgaactcctcatactctctctgtcacatcaagagtaggtgttaaaaaacttatagacgatctaaactggatgacaacatcgagaagggatatatcggtaacgaagtttagccatagcctacatctccaaaaacagactgatcacgagatgctccaattgaatgagggttcaaaattacataacataatttttgacatttcagttctattggacaacctgatatgatattatttcggacgaaacttttaaatgtttttcaaatttttgtgaatttgataatatttattcaaattttaatcattttttttcaaaataaaataaaataattttggatcgaaataaccggctatatcggtccccccaacacaaatgcctaaaacaatatattaaacccttgaatccggtatatccacgacactcaacccgcagatggagtggagaaggtttaccttcatggcgcggcgttctttgacgaaggtgggctggaccttgtccttgaggtagtcgatcttctgggagaagtagaactcgggggcgcggggctcgatggtgaacttcttgcagaaggggacccaccggcgggcgaactcggcggtctcggagagcgtgtcgaagagcagcatggacgcgccgtcgtcggagacgtagcaggagacgcggtcgacggggtagtcgacggcgaggatggacagcacggtgttggcggtgatgatgggcggctccttgagcgggtccaccgtgctgacgaagaaatcgatcggggccaggcggcacggctcgccgtcgcgctcgtaccggagggccagccggtccaggtacgtctccctcgtcaccggcgaccacttgggcagctggtcgaggatccacgacagcgcgaaccacagctcgcagatcaccgaggccagccacagcggcaccgcgtccatcgccggcgtcgtgatccggaacttgaggaagaagcagagcaccaccagccggagcacgatcacgatccggtacgggttgatcttgctcgacgggatcggcaccttcctccacagcggctgcctcgcctccgcgagcctgcatgcagaaattcgatcatcacgatcatgccaaagttcacaagatttgaaaaatctgaggtcgatcgatagatagatctttggagagctaagcttacagcatgtactcgtcgtcgttcttgtcgtcgtcgtcgtcgctgtcgtcgcggttgagcttgccccgcttctcctgcttcgtcttccacttgtcgatcctgtccttccactccatgccaccctccatctccctctcctgctccagatccttcccagccactgcaatttcacagcaatccacacacacatcttcagatgaattgttacaccaagaaacgcaatttcttgcgggatttgagtaccgaccgcttccggtgaaggaagagagcgccgggcctccagggcgccacttctgtgccggctgctcgccgttctcctgcaagacaaaggttgtatacaggtttcgcatcagtttacaagcacttgattgcagagcaattgcagtgagaaatcaatggcgatggatcgatcgagtcgagttgagctctcaccgagtagacgtcgaagttgacgggctcgtgggggggtttctgcttggtggggctcttgatctggaactcctcctcgaagtcgtccatgtcgccgccgtcgtcctcgtcgccttccacccgtgggcaccctgcgaccgatcgatcgagacagacagacagacattcttgtcaagctcgatcttgtgaactaaattgcgattgatcacatggacacaacacatgatgttacctttgtggcgcttgtagcgggtgttgcactgggggcagcactgggtgccctcgctgcgctcgtactcgtagcagggcttgcacaccgggaagccgcactcggcgcacgccacgaacggcttcccgtcctccctcgccgccacctcctcgccgcacacccggcacgtcttctccttccccttgtgctcgccaccggtgacggaggcggtgtccatggtgaggtgccggggaagcgacgttggtgggcgaggaggaggcggcggctagctaggtgatatagcagctggttgatgatcagatgcagggaggcgggggcggtaaggtggcggggtggcgtcccgcaccaaccgtgagttggggcgtcccggtttgattagagcgcaagccaaggcacgcacgcacgcggccgcgcgcgccatgcattgctcgcttcggaagcaagccgccgctgccgatgctgctgctgctggaacgagatcgtcgtaaggtgagatcgcaacgagacgcgagggaaatgtgttggaggggtcgtagtgcagctgaagcaaaatcgaaggccaacggtgaagggacgtggatgtgtttggtgggtgggttgcggtgacgcctcaccgtttttctggtgagatggtgcaggggggagatccgggccatccggctcgtgtaagcgttaagtcactgcgtgtataaatggcagacggtaggaggaaggccatctgaacctgtcaagtgagatgaaatcctgcgatgctggcgttaacacgcattgcgattcagggaggctctggtgtagcagcacgccgacacacacacacacacactctttctcggttcaaacgtgagcgtgaccaacacatatcaggttagccatctaggacaaactagactcgaggccccgagagccaacatcagctagatttttgtttttttttatgtttcacgttttcagtacgaatcaggtgtgcagtgagaaaagcaatggattgatgcttgcattaaaaagggtaagtagtgtacaccatccagtaagaatatgccgtgtaagcagatcgcaatgccatggctcctcttgattgtcaatgtatgttacgagcaaaattaagtggcgtacaaactcctcaacatctttgtatcttttaccataagctatcagagaggaaagcaacacaataggtcggaaaaattgcctcggacaacaacactagctgaggctgtaaagaacaggcgccggtatcggcacaccactcgatggccactatccaagctgcaacgttttgcggtgacttacacgttgtaccgtccacctctgcttggtttctccctcttggcgtcatcctgcattgaagttgaagcaccatccaaatagaatgagctatggacgtatttgatctattctacaggtgactaaaaaataatatgttattgagacaacaaaaatagtctaaacacatacatggaagctgtagaccatcttatcattgtagtcaacaatctccttccatttcttgccaatgtttacctgcaaagcaaaggcatgttagttttctctagttatcattggtctatggttgaagccatgtttcaaaaggtaatgctcaaatctcaaaaaaaaacacatatagagatgtcctttgaatgcacagacctgtggtaacaatgaaaaatttatgaagtgcagaaaaaagagacaggatggttgaagagttagggaattacaaagcgattgcttcattgcaaaatgtgaaacgttttagtactattatggtgctcatcaatgcaaaccagcattgatgttgtgtttatgtttttgttatcataccaatgcaatatatcactatatcagaaacaaaatagatggcaatcataatggatgcatcaaccatcaatagtattgcatgatgtgggcaccagatgactttaagagtcttgagtctctttgacacggcatcaaattacctaatagggatttagctcacacaataggctttatcaagcatagcttaaattgactgaaagtcaaatcaaacaaaatagttctctactcaagacagaaataaattgttccaataaaacaagcagataaatggtatcaaataagatatggaactcagaaaagcaaacaaaatgtaaagtctagcctaccatcaaatacttgtcaactgtatcccaaataaattgagcaaaattagtgaagtggacaaatttgatgaacagaatactaaagagaacatggcagctttgaacaacatgtttaatgttgactatagaggtggtgggaaaacaatgtactacagattaaattgcttgctacatcaaatatatgagcaaatacactcatattgttatactacagtatttttcaaaaaaccaacctgaacggcttcattgctggcagtcctagtccacaatgcaagcttgtctcctctctggcggacactagcaacaactccacaaatttcctcactttcatcaaactgctctccaatcagagccatcagctgcatgttcgaaaagtttgtcagcagaaatgatagaaactttagaagataggtcaagcaacagatgttatatccaaagcacttcagagcctccgaccaaactaagcaatgattttagaggaaatgtaccgtttcaagccacatgttctcaagggtggtcttcctgctacatggcacagtccatttgcccccatttgcacactctgggtcttcccactttggttctacaccagccttgaataaatgaaaatcagcatttactgtcaccttgcttggacggaaaatctgatcatacaagctgcagcaagaaataaggggatttaaatgaaaggaagatcatgcctgcacatataggataaaaggacaatcaaattcaaaagtatccgataataggcaggaatacctacagtaagaacttgccaaaacatagaaaaaatacaacagagtaattaatacctacgcctccatgtgcccacaatattgaatgtcattctagttgtaagtctcaaaaggtataactatttttcttatctttagacacaaaaaaaaaagtcgcatgcaagcttgaataataaataaacaacaaagatagttgtgttcatatgttgtataattgctacccttgtacatttaaccacattaaaagtcccggaacatccataaaagaagctagaaaatatactccatgcagcatgtatggaaataagacaactctatcaacagctggttcagcaatacgaggccttcgagaaatcttaaacattctagtctatcaacagctggttcagcaatacaaagccgtagagaaatctgaacattcaaaatcagttgttacgactatgcgggaggggacaattgttgtttataagacacaacaaacgaccagggttgcacttcgggaaacaagcatccagacaatccctaaacatcagtaatccacgatgcagcctacacttaaaatcagctccaaagtaatcagcatcgatgcattgtagtaattagatctgacgaaaactgcagccaacgatagcatcaacaaacatatcagcgaaaaaaaaaactaaccgaagtaccctctaatcattctagattgtgctcgcatgggaataatcagaacccccgatctacaccaccagaaatacccacggcatagccactaaatcaagcatatgagctaccagacaggatcaaaacacagaaagtagatcagatccgaagaccgggaaacggatcgggcaagggcttagggcgcttcatcggcacgtacccccagaactcctcgacggtgtcgaaggtgtaggccttgcggagcgaggtcccccacgcggcgccgggcttgggcttggactggatgtcgtaccagaacgcccactgcctatgcagcttgtgcggcgccttcgccgccgccgctccctccgccgccgccacctccggggtctccgccgccgcaatcggcgctgcctccacctcagccatgtccgctccgccgccgccgccgccgcctctgctcctcctcgagggaaaacgaacgagtaggcgatgcgagagagagaagagaagggagaagccgccgccgccgccgaggggaaagagaaggagaaggggaagaaggtttcggcttctggatatggccgcgttggcgagggagatgtgctgcgttttcacctgggctacgaccccacgatgccactagaggcccggtccggcccgtttataacgggacgcaagtacatcgcagtctccttgtggcccatatagatgggcctcacgtgaaacgaaacccattcccgacacaaataaaatgggcctcatgtgcaccgaaggtccctcaacttgtcatcgagttacaaaatcgtctcccaaccgcaaaaccagatatcgggtatcccttaactaacaaaaccattcgttttaggtccttcggtggttttgacctcggttttatccgacgtggcggctgagtcagcgtgggacccacatgtcagcgtggccatgtcagcctcctctctcttttcccctcttctctgccttcctcatctctctctcttctcagcgagatcaacagtgcaaggcggcaacgctgggggagcggcgcgcaggcgacagggggaggagttgcgggcggtaggggaaggagcggcgcgtgggcggtggggaaaggagcggcacgcgggcggcgggaggaggatgtgatatcccagctcaaggcttaataggattaatagaatactcatatcttgcaacttcttttccggaagccggtctcgaaaaaactctgagattaagcgtgcttggcctagagcaattttgggatgggtgaccgaccgagaaattcttcttaacctagagcaattttgggatgggtgaccgaccgggaaattcttcccgagtgtgcatgagtgagaacaaagtgtgcagaaaagactagtgttggtttgtgagggcagtctatatcctaggaaagctgccagatgtagaaagggcccggcctcggagagtgtgggggcgtcacatatggtatcagagccgactcttgtagctatacgtatatatgaatatgcacgcgggcatacagtgtatacgggatgatccacgatgtggtcgtatggtatgacgtatgtgcgccgaaaaatgtctgcatatacgtggtgctaataggagacattcctggcctgggttgaccgacgaggacgtcggtatcttaagggggtgagaatgtgatatcccggctcagggcttaataggattaatagaatactcatcaacaagttgcaacttcttttccggaagccgatctcgaaaaaactctaaggttaagtgtgcatggcctagagcaattttgggatgggtgactgaccgggaaattcttcccggtgcgcctcaggttcttcctccccccgcgccgcg

SEQ ID NO: 58452 - DNA, 5491 bp, Oryza sativa
cccatgggtataaatatgtacacccgggttcattgtaatctatcttcacgatcaatacaattcggcgcatcgccaccttttaccttttctactttattttatcgtccggcgggacttggcacctgacgcagtgctgcatcggtgttcgatctccagctaaggggtaagtccaatgttccgttggcccaggcagttgtatagtttaccgcggtgtcgttcaaggctgcattagtacattcgacctcttggattgctctggtttggatgatatatttgcctacctatttatcatatgtcactgttaatctagtcttagcatatcaatttagctctatcggctgcttctcgtttagggtttatgccggtatcggctaaattgtgttgttagattagattagcttagacatctaccaccctgaaaactcagtaaacagcttgattgtctagatattatgtttttttcatacttagtgctgtattagttaaatttgatctactaagtcgtgcttagaaccataatctctagccatctttttgactgccaataagggtttcatcggggtttcagccgataagttatctggacgttgcatcggcttataaggatttcatatatatataagttggatttagccgatgacaacaaaggtttcactatttaatctaatctgtggattttatgacatcgaacctccagctgatgtatgctttaaccttcggattgatacttatttatcatatcattgctagccgattggtttatactggattatattgttattttattacatcatcatcagccgattgcctttatatcattatctacattggacatatagccgattgcttaaaccctatcgctatcggttggtatcggcatcggctattatcggctatcggctggaactactccatcggcttgtcagccgattggctgttttgtctattatttgcatattttgtcagttgtaggatcaaactgactggcacacccgcatctcatcaacctttggacctgcactggagctaagcagatctgccaggctggcgtgttcgattttttcatcaacactcaagcaatagctctctcatttctctcaagtttagtttagtagtatctagttggtggaataggaatagagtagaaattaggagtccggaagccttcggaatagttcgggtatggctctatcagcttttctcttctcttttgtaagctttgtacttttattagaatactctactaaatacatttatggtattgaaatactttccgagtatatcagtacctaatttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgtggatgagaggtggaccgctgatggtgacaactcagtacgggtattcctccatgcctatatataatcctaagttaattccctggggagggtattcctccgtatttagccccgattgtatggtcatggcggactgtcgtaaggaactcgacagtcaggggtggcttctcgaagtaccaggagggcatcggaaagagggtattagctagtatatcagtaaactaggatgtatgtatactatgtatattagaagtttaggaatagattatcttcctcttttctttccacttagcttagataatatattatgagaataagtagtttatgcttgtgtgtcactctacccttggattatcttaacccctgtttagaatatgattatcacaagcaatatataaattactagtcatgttctctctacatgattttcccacaggataaaataaatatgatacccttggaatactctcgggtaaaatgctataatggtatatccgtgcgcttgcggatgaactctgtaaccataatatacaagaagtatttctgcgccattgctgggaattatatttctagtaatgtcattaagaaataccaacaagcatttctggcgccattgccggggaagattcataatagagattacttattttatatttccctctgtataatcattttcctttgcaggctaaccttggttgttttcacttttgttgtgaaaacagggtagtgcatgacttgtttcaacctgctggaaaacttcaaggaaaatccagaagttgttgctccgcagaaaactttaccgatagagaaactagccgtaccagcgccaccaattttcaagactatggctagcaatactctccgcgagttcgctgctccttctgctgacaatgtggccattgggccacagatcaacatgggagacatggatttcgatttgaagtccagcctcatcacgatggcgcaggctagcccgttctgtggcaagcctaatgaggatgccaatgctcatctgcaacagttcctggagatttgtagcacgtacaccatcaaaggcgtcagtcccgacgctgtcaggctgcgactgttcccgttctcccttctcgagagggcgaagcagtagttctatgccaactgtgctgctgtcaacacctggcataagtgttctacggcattcctctcgaagttcttcccgatgggcaaaactaatgcccttcgtggacgaatttccagtttccagcagacgagggatgagtctattcctgaagcatgggaacgtctgcaagaatatgtagccgcctgtcctcatcatgggatggacgactggctgatcttgcagaacttttataatggactcaccccgacgtcccgcgatcacctggatgcggcagctggagaagcgttattctctaaaacggttcaaggagccgttgatctaatagagaagatggtctccaatatgggttagagtgaggaacgactccagacccgctagcaaggcatgcacaccgtcaaggagacggaattgcttgctgccaagctggacctcctcatgaagcggttggacgaccacgagaaacggccacaaggcaccgtcaaggccttggactcgcacgtcacgtgtgaggtctgcggcaatacgtgtcattctgggaatgactgctcggaaacccgtgaggaggcgatgtacatgggcaacaagaacaacgggtatcgtccacaaggaggtcagggatggaaccaaccacacgcatattatcaaggaggtaacaataacggtaatttctctaaccagccctgcttgaagcatctagtctttgcgcaagctaaaaccactgatgcgctaagcaaaaatcttgcggccaatgacaaggtcctggagaacataaatgtcaaattatatggctttgcttccgcttttcaaaatcagctgagctttaataaaatgatagaaacccagttagctcagttggcatctttcgtccctgcaaatgaaactgggaggattccagggcaacccgactcctccaatgaaaatgtcaaggcgatcacgacgagggaaggtaagtccactcgtgatccgccatatcctaacccttcaggaactactgggatgtcaaaagaagcaccatctagtgactcggctgatatggatgttcagccagaaaagacagtgccgtaggagtactgcgacacacggttgctgcctttccctcaatgaagtaggagaccgtcagtggacgagcaattcgctcgttttgttgaagtaatccagaaaatccacattaacgtgccgttgttggacgccatgcaagttccaacatatgcccgtttctcaaggatatcctcaacaacaagagaccgctcccaacaacggaggtggtcgacctgacagagcaatgcagcaacattatactccacaagctcccggaaaagaagaaatatccggggtgtcccacgatcacctgctcgatcggggcacagcagttcgaccaggacttgtgcgaccttggagctagtgtcagcgtcatgccaaaagacgtcttcgacaagctcaacttcacggtgttggcactaacaccgattcgcctacaattggctgattcatcagtccgttaccccgcagggatagcggaagatgtgctagtcaagatacgggatttattcatcccggttgatttcgtggtgctggacatagagacgggaaaggagacgctgctcatcctggggcgtccgttcctcagcaccgcaggagccaatattgacgtgggaatggggagtatccgtttccatatcaacaggaaggaagagaagtttgagtttcaaccgaggacggaacaatgctccatggtcagaataaagtacaggccgaacccgcagaatattcaagaggtcgaagtggagccaccgaaaacggatagcctggtgaaattcatgcagaatttcctggagaaggaaacaacgatgcctaggaaccgttattggaagacgccgataaaaccacccataccggccaagaagtcagagcagccagcttagaagaagccgctatccacaccaaaaccaaagaaggtgtggaggaagaagccaacgacgcccgctccaacacctccggagacgggtagaaaattcttgaactgaatcagaaggaggtacagtcttgcacgtcggactttaaatgacgcgactttcgccaacaggtaaattggtatgtatccgcataattgatttcaacaatttgaatttttgcatcatcacatgtttgaacttcaaaattgcatttaggacttttgaattttgaggaaattcttcaaatgaatttttcagagcaaaccaaaataaaattttcaataaaaattcattgtgccatgaccacactgaccgttggaatccaacggccgaaagtggggccggtttggcctaccaggggttcggccgaaccagccaggccaacggtcagctgccccctccttttaggcaacggctagtgggccccataggtcggttttgaccgttgtgggtgcactacttaagccaacaggccgggagagggaattccaccccatttcaacacgttttcattccctctccaaagtttgctctcaagttcattcaaactttgatagtttccctcaaatttaaactcttagttgcatatatacaagtcgctttggtgaaactaactggcgagtgaaatccttgtcattcctaacccccgccgagttcgtccgttcttgctccattgtgcagaatgaagaggcgattgtctcgtctgttcaaggagtccggctcttcatcaagtcatcatgatgagtctagtactcgttcatcagccgatatcgtgatggaagatgccaaagtccgccacaactcctgaaccacgccgatcttgaccttgttggtgatcgggagagacaagcctactatatgctagccgaccgggagtatgctcaccacgcgagaatactcaccggagctgataaaaaagataggtatggatactgaatttcgtgctatttg

SEQ ID NO: 58453 - DNA, 10383 bp, Oryza sativa
gtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaacaaatttagcatgttggttttataatttcctttcatttcttttgaaaccagttattcaaaattacaaaatttgtgacctcgtttccaaatgttttaatttatttcgcaaagtttactttatttacttacttttttttactttgattttctaactttattcaaattaatccaaaaacttgtgctattaattggataaagtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctccccaaccttagggaagtgaccgtggcagttaccttgagactgaaggaattgagaatgatgtaccaccaaacatttggttgagatgttgtgggctatggatgaaagtcgtgcggagactgtgttaccagctcaagatcgtgaagatcggaatcgtggtaagatttgcaagctagaagacaaggtggatcgtttgaagaaggaattagccgcattgaagggagaagcaccgccgcagaaggccaggattcgtcttaccgcaaggaagagagctttatttgtccctcgctatcaactggcgccaaaggttcgtgtggtggagaaagaagttgctccagctcaagcggatcctccggtcatcatcataagtagtgatgaagaagaagaatccaagcgcaaccattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtggttcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcctaagtagtttccccgttttctcttcttgtgccctgtccatgccagatggtgaacactcgtagcaatgggaatggtcccaacaaccccaataacaacaacaatggagagaatcccactcttgcccaagttcttgctcaacagacacagcttataaacatgatgatgcagcaatttcagaatcagcaaaaccaagggaataatcatgcacctccacagaacaagttagcagaatttcttcgtgtaaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtccatgccacagggaggttcttcgtctgttgttcgtccgcaacgtcagttcttcaacaacaatgctggcaacaacatccgcaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggagctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttcaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaggatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcttgaaccaaagaagagcatgaggaacatcttcgccttgcattggagaagctacgagaacatcaattgtatgctaagtttagcaagtgtgaattttggttgtccgaagtgaaattccttggtcacgtcatctcagctggaggagttgccgtcgatcccagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcataagagtttaaagtatatctttactcagccggatctgaacatgagacaaaggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtaaaggtttcgttgcagccttagaagcgaagcccactctaattgatcaagttagagaagcccaaattaattatcctgatattcaagagatcaagaagaatatgagaagaggaaaagctattggtttcttggaggatgagcacggaactgtatggttgggtgagagaatctgtgtccccgacaacaaagacttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcattttattccggtaaaaacaacctattccggaagtcgcttagcggaattgtatatggcaaggattgtgtgtttgcatggtgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcgaattttcatacaacaacagttatcaagctagtttacagatggctccgtacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctctacgaggagttcatcgttttcataccaagggaaaattggcaccgcgttttgtgggaccttataagattgtcagtagaagaggggaggtcgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaaatgagagaagaaccaggaatcgagttatccgtttttgcaaagtccagtggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaaatggaatttttagaaataattttaaaaagtcttgaagagaagatctaagtttaattaataaattccaatataaaattgggccagataaaatttcattaaatactttgcttaattctataattcctagatttttctggaatttttttgagctaaggaagtatttttaataatggaattgcatttaagaaataatttaaattgaaaaggttttaaaaagtcttcttttggctttgggccgaaagtcggcccaaaaccgttctctctctcctcggcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctctgggatctcctctaccttttctcctttggaatctttggttaaatcgctttgtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctattttttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttctttcggctggccttatccctcctccaaagtcttctttgtgtccctttttcaatcgggccaagaagtagaagcccagccaaaagtctagttggcctccctgctacagtgtcttcttcaatctccagccggctggagacagagcccgagccagccgcacagtacctgtatagccgcggttttcccctccaaatccggccttttatctcgtgtatttccaaaattagttgaggggaaatattcctcttatcctcctctatctttacccccaggaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtctccgtcatcgccgtaaggtgcgccgaggtgtgggcaagctcggccgctatctccccgaagccgccgaccaccgcagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttatttataagggggtgattatgatccaggaaaggtgcgctgtaatggattatgttgtgcaaggggtattgtcacaactcctttccgaggtaccgtggtggtattgaggcacatgatgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttatgtacctcggctgattcctggacgaggattttatgcacaaataagttcggaaattactagtgaatttccgggcgtgacactttggaaagctttggaatcgagttcgattcggatcggttttccctctctccaagccgcgagtttccttcgccgttgccgtcgccgtgggcctccgccgtcgcctccgagcccctttaaaaggatccccggtgtctcctctacccgtcgcagccctcgctttcgcctctcgtcgccggaagagctctagcgccgtgtgccctagcttcgccgtcgccgccgccgcttcagccgtgtgccgccgtcgctccagctgtcgccgccgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccgttccttttccgccgccgttttggtcaccggtgtgttcgccgtgttgtcctctacgtgctggtgccctccgttggtgccgtggtgccgccgttcgccggcgagtgtccgccgcccgagccgtcttcttcgccgagccgccgccgtcgtcggtaatgtcatcgttgacgtcatcgggatcctctcccgtaagccggtcgtggaccgatcgatct

SEQ ID NO: 58454 - DNA, 21152 bp, Oryza sativa
ctgcccattgctccccacactacccccaccacctcccctcccttttccctctctttcccatccccagcgttgccgcctcattggaagccgccaccgccgccgctgagccgatgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggctgtgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtaccatttcgcaattattagaattaattcaaatttgaatctttacactagcataacttattcatttcagctccgatttgagtgaaacttgaacctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtagaggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaactcaatagaaccggtgcttaaacttgtcgcatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttatacaattaatttatctttttcatatattaaactagggagtatataagaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactataattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaataggccacgatgacaatagaaaaattaagaaactttagccttagcatgattgggatccattagcaaacacgaatagtacattttgttgcgcatatttgattgttgtttgaatattggtttttctcgcgtattatagaccttgtgtatcgcttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggactgagccatgaagttaagcatgaaacaaccccccgtacaaccgtacttctcgaatgggtatagacctagcggattagatagccgagcggaggcagtatccctgcatagatggttcacccctgagtgaggcaggtgcgctacgatgggacagccgttgaggtagggctgagaggcgtgccctacatcggtgtcaccattggtaggactgccatgagtgtgtgagagagagaacttaacttgaaccataatttaatatgtgtgagacttctctttctcgggagcgccagaactcctcacactgctagaaacatggacgcctagagtgcatgaggatttaagttcatggagcgggtactggcaatgcgaggttatcgaaaagctttgccatgacgcgtctcatgtgttgggatgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgtggtggcttgctgagtacggttggtactcacccttgctattcatatatcttttagaagagtgtttaagaaaagcccttgtcggtacgcttgcgtatccaataacatgatcggagtgcggtcttgttctaggtctcgttccccagtcgactgcctgtggcatgttaaccgggcccttatattattttgtgttccgctgttgttctctgatagttgttggcctacctggccctaatgtaagtatttaactcttttagcctgaattcattcgtgatatgttgtgattcaactatgtatgtgtgtaccaactattgatccagggattggtacggataaacacagatgatttccgatttccaaaatcgggggtccacatcaagtcttctggagaattcaagtatggttctagtaactcttccctctttatccgataatgaaatattcttctttatataatttggtcctttactatatttgcataattatttgagtaccaactttggtttacacttatctcgtattaattatgcggctagcttaccagagatatgcaatggtattggcttagtgttcatttatttgattgctctatgttatctgcagaggtgtagaatagtacttagtaatgtaagcatggtgcttagattactaagtatcattaaatggttctatatgccacggatctgtagaggcaggacgctgatgttgacaactcagtacgagtattcgtcgacgtgtgtatatagggctaagcaagattcatggtgcgggtattcctctgtatctttaattggttgaatagccataatggattgtcgtaaggaactcggcaatcaggggtggtttcttgatataccaggtgggcatagttagggggtattagccacatagttgtaccatagaaagtgtatactaaaatgactatatatattagaagtacataaatggtgcttttattacttcttctctgcttaacctagacttatattttagtaagagtattttaaactgaaccttctatgtgtcaaatctatccttatcctcaactgattaacccatgcataagactttgatttacataagtaagataagaatttatagcatagtactctcttaccatatcttcccatggaattaaataaatacgataccttggaaatacttacgggtgaaatgctatagcggtatatcgtgcgcttgcggatttatttctgtaaccataagaataccgtctaatatttctgccaccattgttggggatcatattcctagtaatgtcgttaagaaatatcaacaggtataaatatcaacaggtatatcggtgaacgtcgcctccatccatcaatcgagttatccaccacctctcatcgaaagattgggaacaaaccttcacgggttcatatcagtgagcttccccaaggtagctgatttgttcttgttatcttaatttattttgtttttgtttcatttttttggtatattcttagtaaacatagagactaggttaatttcatttttttatgaaatattcctgttttttttaaaaaaacaaccttgtcatgttatcttataaaaaaggcaaccttatgttatcaatatgatagttcctcaaaactagaatgtgaaagatggacaagtccttaaagtggcctcattagcagaaaacgtgtagtagatattatcttcttataaagttgatgcccactaacttctaaaactcaacatgcaaatgtgtcacatatcatccactatcaattattatccagagtattttaaatcacatgtgtaaaatcaaaggtgtttttgattattattctgtgatgaacaattggcataggagattattggttttgttatttggagtttatttacgaagtggttttggagatgattggatttacaggtgaatcacaggtttatcattttatgtggaccggtcagaccgggccggtgcggtcggtcagaccggcgtgtaatgcgtggtcagactggcgtgtaatgcgcggtcagaccggcgcagcccgcggtctaaccggtcgacgctgtgtcggtttcggtttcgggttgtttgtttggatatccgtgattatttcatgattatgacttctagatggatactatacatatgtaatactattgtttgctactaatgagtgaagttggagatagcttggtctcggaatatggtttctttgtttatttcatgtgcaggtgactcgatgcctcgggagagtatttgcggtgatggaccgggagtcggcttggggataagacgacgtccgtggtggtcagagatcatgcgggatacttaggctagagttgatgcacgtggttgatggagattcgatatggcatacgatggaggtattgtgtgcgtatgggatgcggagtcgaatttggaaggagtccaaatttgatatgattggttatgtaaagtttgtttcttgtactagagggtttcctaaggtgtttaggactcctagtatgagtttggttcgtggctttagggcgcctacctcgggtataaatagagggggagcatgaggcttccagttatcgctttttagagaatttgagttgagttttgagttagggtttagagtttagtcgaaatttttgtaagtagtgttgttggtgcactatgtaaacgcagagagaagtaataaagtcgtcatccactttaagagttcttcgatttgtttttaccgggtttcgacggtctaaccggcgatattatgatggtcagactggcggcaagcagcggtcagaccggcggcatacgagcggtccgaccggcggcggcgacaggtgcggcaggcatctcagcgattcaaccgatcgacctacatcggtcagactgacgttcatcaggcggtcagactgcgatccgtcgaattagagggtaacttttatttccgctaaaagttttcgatttttgggtataccaaccattcacccccctagttggcttagtttttgttatttgatcctacaagtggtatcagagtcttgttttcttctttggatttttatcggtctagagtttttgccatggctactcctgctaggttttcaactaagaatcatgttttcgatggaacggatttttctcattggtgtagtaggatgcaatcttacattatggctgaagattatgatatttggagaaaagtttctcatccttatgtgattcctgaagctattaatactgctgctgaaaaaactgcttttgaacaaaattgcaaagctcgcaacattcttttgagtggtatttctcgttcggattatgatcgtgttacgcactttcgaactgctcatgaaatttggaatgttttgagtaactttcatcaaggaacaaataacattaaagaacttcgtcgtgatattttcaaaaaggagtacattaaatttgagatgaaacctggagaagctttgaatgactatctttctaggtttattaaaattttgagttatcttagatctgttgatttttcttatgatactaattatccacaatctgagatttctcgtcactttttgaatggtcttgacatgtctatttgggagatgaaagttacatctattcaaaagtctgttaacatgtctactttgactttggattcactttatagaaaattgaaaacacatgagatgaatgttctttctaggaaagttgattctaagtcaagcgctttggtttcttcttcttcttattctttggatgttgatgctttttcatctaagccttcttttcttgctgtttttaatgtcacatccgatgatcaactcgaacaaatcgaggaggaggatttggcttttgttgctaatagaattctcgagctacgaataatgccaggaacaggaaaagaggtggtccaaatcgttgctttgaatgtggttcaattgatcatcttcatttgcattgtcctaagcttgggagaggcaaaagagaagacaaagatggtgagaagaccaacaacaataagccgaagggttcatcccaagggaggaaactagagaatctcaggaaggcttttcaacaagtaagcgccgccttcgagccacaaaatgatgtagatggtgaaagtggagatgatgataagggaaagaacatctccgatgtttgcttcgtggcgcgtggtgaatctgacacagagtatgaagataatgaggtaagtgcttttgaggaagctattaatgttttgagtgaaaaaaataagaagtgtgagaagatgtatagaaaacaggaatttatcattgaatctcttaaatatgaaattgctagattaaaatctcttattcctaatgatgatgattgctcaaattgtgaggttttaatgaatgagatttcaaaaattagagatgttaatattgcacatgatttgaaaaatagatcttctcttgcttgtagttttgctttgcacacacgcactttggatgagttgtttttaactaaaaagttgttgcaaaaatatcaaattgcttttcatgctaatttgaatttaacatgatttctgctaaaaagttaaaacaacctcatgatgttttggattgctcaacatgtaatttgaataagttgaaattgaaagatgctttaggtcgtgttgagttcatggaagatgttgtgaaaaataatgaagtgctttcttgccctaaatgtcgtaaaagcaaaggtgtcatggtagattatgcaaattgtgctaatttggaaaaagaggtttcttatttgaaaaattctttgttaagattttctgatggtaaaaagaacctcaatatgattttggatcaatcaaaggttagcacacataaccgtggtttaggttttaatccttatactcataattctagacaccctcctgttgtgttaggtgttggtgctagaagtggtgagattttggttaaacctgatactaacaaaactgtgtttaaatctgctggtatcatgtctaccttgaatgcatcttcttcaaaatccaatgttgtgcatgcaaattctcctgttgttgcttgtgttgctaaatcttctaatgtttccaatgtgtctaatcatcgtgaaaaatatacttgttctttttgtggcaaagatgtacatattgttggtttttgttttagattagctcataaacagaaaaaggagagagagattgcttttgcaaaatcaaagtggcaaaaatctggttttccctcgaggaaaccggttagaccgcagtgggtcccgcggtcagaccggcccccggtcagaccggccactgtacttcggtcggaccggcctcgaaggaatttttctgaaaatcctaaaattgattttgcacgtggatatatgcctattggatcttctggtcgtgtgtctcagtactggattcctaaatttttattatcatctaaccccagtactgaggcttcgacttctgcttgtgtgtaggctttggtggcaaggaaggagaacgtgtggattgtggattccggttgttcgcagcacatgaccggtgataaaaattggttctcctcactcaaaaaggcatccaagactgaatcgattatctttggtgatgcttctacaagtgccgttctcgctacaggtttggttaaggtaaatgaaaaatttgaattaaagaatgtagctttggttgaggacttaaagtacaatttgctttgagtttcacaaattgttgatgaaaattttgaggttcactttaagaaaactggaagtaaagtttttgattcttgtggtgattctgtgttgaatatttctcgttatggaagagtgtttaaagctgattttgaaaatcctgtttcacctgtcataacatgtttggttgctaactttgataaagatatgatgttttggcatcgtagacttggacattttggtcttgatcatctccctatgtagagtcgtctggatcttgttcgtggtttgcgtaaacttatcaaagatcttgatttggtttatacgccgtgtcatcatgctaagatggttgcttattcacatgctcctattgtttctatgatgacggatgcacctggacagctattacacatggacactgttggtccagctagagtgcaatctgttggaggaaagtggtatgtgttggttattgttgaccatttttctcgatattcttgggttttctttatggcaactaaagacgaagcttttcaacactttcgtggtttgtttcttcgattggatcttgaatttcctagttctttgaaaagaattcgaagtgataatggtggagagtttaaaaatgctttttttgaacaattttccaatgaaagaggtcttgaacatgaattttcttctcctcgtgttcctcaacaaaacggtgttgttgaatggaaaaatcgtgttttggttgagaaggctagaaccgatgtggatgaatataaaactcctagaaaattttaggctagggctattaacactgcttgttatatttcaaattgggttttcttgagatccaaacttggaaaaactttttatgaacttcgatttggacatcaacccaaagtttcacatttgcgtgtttttggttgcaagtccattgtcttgaaatctggaaatttggataagtttgaggcacgttctaccgatggattgtttcttggttaccccgcacacactcgtggctatcgtgtacttattttggagactaacaaaatcgcggagacttgcaaagtttcttttgatgaggcttgtccaggtactagacccgatattgcaggtacactgtcacaggttcagggggaggatggtcgtatttttgaagacgagagcaatgacaacgacgacgacgaggtcagctcggccggtcagaccgccggcacacctccggtcagaccggcacaggaggtacggtcagaccggccagggtcgtcggctgaggattctgttgatgctgttcgagatggtcctccgtagattacaacttcgaccagtactgacacagaacgtggatcaactttagaagtcgcttctcctttgcacattcaacgacgacatccactggaacaaataattggtaatataggtgagcggactacaaggtctaaggtaacgactcatgatgtttgtgcaaattctgcatttgttgcttcttttgaacccaaagatgtgtcacatgcattaactgatgaatcgtggattaacaccatgcatgaagaacttgaaaattttgaaagaaacaaagtttggactttagttgaaccaccttctggacataatattattggaaccaagtgggttttcaaaaataaataaaatgaggatggtttgattgtgagaaataaagctagacttgttgctcaaggttttacccaagtggagggtttggattttaatgaaacttttgctcctgttgctagaattgaggcaattagacttttgttagcttttgctgcttcaaaaggttttaaattgtatcaaatggatgtgaaaagtgcttttctaaatggttttatacaggtggaagtttatgtcaaacaaccaccatgttttgaaaatcctgattttcccaaccatgttattaaattgtctaaagctttgtatggtttgaaacaagctcctagagcatggtatgataggcttaaaaactttttacttgtgaaaggttttacaatgggaaaggttgacaaaacgccttttgttcttaagcatggtgataatcaactttttgttcagatttatgtgaatgatatcatctttggttgttcgactcatgctttggttgtagattttgctgagactatgcacagggaatttgagatgagcatgatgggtgagttatcgtactttttgggattgcaaattaagcaaacacctcaaggtacttttgtgcatcaaacgaagtatacgaaggatcttttgagacggttcaagaaggagaactgcaagccaatttcaacaccaattggttctacagctgtgttggatcctgatgaagatggcgaagctattgatcaaaaggaatatagaagtatgattggatctttgttgtatctaactgcttctaggccagacatacaatttgctgtgtgtttgtgtgcacgctttcaagcttctcctcgtgcttcacatcgtcaagcggtcaagtgaataatgaggtatttgaatcatacacttgagtttggaatttggtattcaacttcatcttctatatgcttaagtggatattccgatgctgattttggaggttgtagaattgataggaaaagtactagtggaacatgtcattttcttggtacaccattgattgcatggtcttctaggaaacaatctagtgttgctcaatcaactgctaaatctgaatatgttactgctgcaagttgttgttcacagattctttggcttttatttactttgaaagattatggtcttatttttgagaaagtacctctcttttgtgataatactaatgctatcaatgttgctaagaatcgtgttcaacactcacgcacaaagcacattgatattcgttttcactttttgagggatcatgttgagaagggagatgtggaattgcagtttttggacacaaagttgcaacttgctgatattttcactaaacctttggattctaatcgctttgcttttctttgtggtgaattgggcataattcatccttttggcatggtttgagggggagtttgtacttcatggttttatcaagcaataatatgacaatgagaaaaattgagaaaagagagctttgtttatgcatatggtattttcttgtgcatgctagcaatactttgaaggtttatttgtctctagcatagcttgtatgtattctagtcttttcatgagatttagattttgcttttaagggagatgatacatgacatttaaattctatacttgaattaagcaaatatacaatgttgatgctaacatatggtttgatttctaaatgctttatatatatgctttattgaattgttattcctcaaatagctttaattggtcattgtgaaaagagaataaaaatatgaaaaaaaatgaataccgaatcattggaaacagtcttgaggacaagaacgtattcgatatgagcaaaataatgggtgccgaatccctggaaacagtcttgacgacagggacgtatccggaataaaaaagaaaaaatatgagcaaaaaggctcaagaaaagaaaaagttaaaaaattctcttggttattttgtgctaaaggttatttgagaaagagtgataaatgcaataggtatatgtgtttagtgtttattcttcaacctatgtgcttgttaagatgttgcattataaatcatatgaaatcatgaattttgattgttgattaaagcttaattataaaatctttggttcatggttatactttaatgcatgcttgttatattacacatgacatgatatgctatatgtgttagggtcatggatatcacatacctaatagtagttgactaaatctcggcaggatccaccacatatcatgtcttatacggaaactgacttcagatatggagggagttctggataaggaaagacaaccagagttctacatggaaacgacaaggactactcagattgtatccatattggtttccctagttctactggacaagcggacacctgtgggtataaataaaagcccccctaggaagacacgaggacacccatgatatgagacgatcaacacgatcaacaaccaccatgggggaccacgagacaatcaactcccaacacaatcaacatagaagcctagatacgccaagacaaaccgccgaatatcgacatcagagatacgcctggatcgaccctatccggtaccttcagaggccggccgtagggatctagcactgtctctgattccgtcgggcgcgagctcgaggaggaaggctaccctgttgtcaactatgagttagaccttcagaccggcatgtcgacaacagttagataggctaccccacatattgtactggtatgattatggtgaataaaaagcaacatcggctccggccaacaggatgtagggctattacatgatagctcaggggcccgaacctttataaaaatcctcgtctccatctcttttacctcagtctcgcgtataccctagcaccgacgatccccatactgtctaaataccgtagtcgcgacatcaaacgtcaacagtggcgcgccaggtagggggattttggtgcttcagaatttcaacgagatgggttcaaaagacggattctccgacaacaagctactcgacgactttgctgtggggagatccaacccgaccagagtatgtctcccgatatgatcggaaccatcgtcgtcaacaactcgatctctcgagatcgaccaaacttcaagacgttgccgccgcggagaacagtgacttgatattatcaactaggaggtctccgatctccatctcttcagaagcgacatcataaactgatttttggtaacctcggtaatgccgctgcctgctcagaacaccggccatcgaggaaccaaaatcaacatctcgatctattcactagattcttttgggactcggatcgttctcacaccccgattaggatccaaattttggacccctgacgcatactgagaacatccatcccgacatcatgtgttcccgggattattgatcacggatgtctaccaagataaatcaacggccgcccgtgatcaggtatttagtagattgattttttaaaaatggtctactaatttcgtagatacatccagcgtgtatctacaaaggtacgtaatattttatatgcaatttatcgtacctattcagatgatacggcattgtcagatctataatttattatgtttacctagagcttgttttttatacaatatcaattgcgcggatgtttccgatgttaaaccaactacggtctaacgctgggggctcgctctattttcttctgtataaatcatgcttgtttacggtttacataatgcctaatatttacatctgctcgttatatcctaataatactagaacatccatgcagttttttgagtacatactcgacattatttgctatatatcttgccttctagaaaatatttttcaggaacaattgagcactcgagtaggtcatggtcgagtacaccgcattatcgagaacgatctcgacaaatgcagagtcgtcacgcccaacctaccaaagaagaccgacgacctatctcatagcaccagccatcgctggactactcgagaaaaggttgttaacggataactcctcacgaacaccgtcggcttgatcacccaacatgattgcaagaggacatccggatatgctataagttgggtatgtgagtcatgctggccacatgatatgcacatgtaataaaccaactttagcgcccccataagtgattaagagactcctactcctggttctcgaaccaggaagacgtagtgatctctctcgcctcactttaagtggtcgagttacgactactgcctggtcctcgaccagcgatgtagtgtttctcccacaacttccactttaagtggtcgagttatgactactgcctagtcctcgaccagcgatgtagcgtttctccggctacttccacttcaagtggtcgagttacgactactgcatggtcctcgactagtgatgtagcgtttctcccactatttccacttaaagtggtcgagttacgactactgcctggtcctcgaccagcgatgtagcgtttctcccactacttccactttaagtggtcaagttacgactactgcctggtcctcgaccagcgatgtagcgattctcccattacccctgcttcaacaaagttgatgtcaggtacacaagatcgccaagtgttttacccaaagatcccttaccacggtgacacctagcgttgaaacctatcctactgtccctttacgccgtcttgacaaggcctccgaggaacctgagggaactttggctgggaacgcccagagccgataaggccttgtcggatccttcagagacgaaagaccatgtaagatctggtcgtgtaagagttctcgccatgcgtattaactaagccgtgtaatcggaaatagattttccaacttcacggctgggggctaggatcagtgcttgttcaaccgaggcaggtcaaaggtccaagagctttatcatccgagaacgattctccgacgacaaggttgggggctagggagagtgtatgactctacaaactgactgatcaaagtcggtaggagagaagacgctcatacacaaaacattggtcagtaaattcaatttgtttttagttttccatacatattataacatgtcaccatttgagcgttcgctcgggggctatttctatttgatattcttttctgagtattgatttcaggaaaattctattcgacattgacgaagactccatgtctctatggttctacaccaagattgactaaggcgaatacgacaaatgttgacaaagctccgtcgcagactctacgccttctcgatcacttgagaacggttgctggatctcgacaaggaatacggaatgaagagatggtgtacccgccgagataaaatttcttgacttcaatccaaattctcgattacagcaagacgtgagacttagtcgtacactctatagtttctcggtagacatcagagattaacttagacaaaccttttcggtgcccgcacgaggctgacaaaggaagtccaacgttatctctaaactcaccgagaacggtcacatgagctcgataacagttactccaatgtctgcgcgcggttgagaatatgaattcgttcatttgcatcaaagtcgggggctatggtcagggttatggataccacatacctaatagtagttgactaaatctcggcaggatccaccacataccatgtcttatacggaaactgtcttcagatatggagggagttctggataaggaaagacaaccagagttctacatggaaacgacaaggactactcggattatatccatattggtttccctagttctacttggacaaggggacacctgtgggtataaatacaagcccccctaggaggacagggggacacccatgatatgaaacgatcaacacgatcaacaaccaccatgggagaccacgagataatcaactcccaacacaatcaacatagaagcctacatacgccaagacaagccgccggatatcgacatcagagatacgcctggatcgaccctatccggtaccttcagaggccggccgtagggatctagcactgtctctgattccgtcgggcgcgagctctaggaggaaggctaccctgttgtcaactacgagtcagaccttcagaccgccatgtcgacaacagttagataggctaccccacatattgtactggtgtgattatggtgaataaaaagcaacatcggttccggccaacaggatgtagggctattacctaatagctcgggggcccgaacctttataaaaatcatcatctccatctcttttacctcagtctcgcgtataccctagcaccgacgatccccatactgttcaaatatcgtagtcgcgacatcaaacgtcgacaatatgtatgctaagctcttgaacattaatgaacataattcctatgcttgatgaaatcattgtcaaaagggggagaagtaatgtgaaattttttggatttttgggagaagcaaggtgaatttctgaaagcatgtttttggttcaattgggaatttctttgtttaaaaagggggagaagttttcttttggctttttgagcacgatgtgtacatttgtacgaagtgtgctttttaccacttttgtttttatttttccaaacaccaaaacattttttatgagtttgctaatgtgttcatcaagggggagattgtaaaatcaaaggtgttttttattattattctatgatgaacaattggcattggagattattgattttgttacttggaatttatttacgaagtggttttggagatgattggatttacgagtcaatcgcatgtttatcattttatgtggaccggttagaccgggccagtgcggtcggtcagaccggcgtgtaatgcgcggtcagaccggcgctgcccgtggtctgatcggccgacgctgtgtcggtttcgatttcgggttgtttgtttagatatccgtgattatttcatgattatgacttctagatggatactatacgtatgtaatactattgtttgctactaatgagtcaagttggagatagcttggtcttggaatatggtttctttgtttatttcatgtgtaggtaacttgatgcctcgggagagtatttgcagtgatggaccgggagtcggcttggggataagacgacgtccgtggtggtcagagatcatgcgggatacataggttagagttgatgcacgtggttgatggagattccatatggcatacgatggaggtattgtgtgcgtatgggatgcgtagtcgaatttggaaggagtccaaatttggtatgattggttatgtaaagtttgtttcttgtactagagggtctcctaagttgtttaggactcctagtatgagtttggttcgtggctttaggctgcctacctcgggtataaatagagggggagcgtgaggcttccaggtatcgctttttagagcaattgagttgagttttaagttagggtttagagtttagtcgaaattttttgtaaggagtgatgttggtgcactttgtaaacacagatagaagtaataaagttttcatccactttaagagttattcgatttgtgtttaccgggtgtcggcggtctaaccggcgatataccggcggtcagactggcggcaagcggcggtcacaccggcggcatacgggcggtccgatcggcggcggcgacaggcgcgacaggcatctcggcggttcaaccgatcgacctacaccagtcagaccgatgttcatcaggtgatcagaccggcgcatatacttcggttaaaccgcgatacgtcgaattcgagggtaacttttatttccgctaaaagttttctttttttaggtataccaaccattcaccctacccctctggttggcttagtttttgtgattcgatcctacaacatgcaagtttgtcacatcattactcactagcaattattatatggagcattttaaatatcatgtcataccatttacaattttgttatatttctataactcaatatgcaagcaatatcaaatcattatctctacatcatttttacattatttaaacatgcacatctaccatttctataatgtataacatatattcattcacatatcccgtagcaaaacgcggggcatcaactaattggaaagacaagagtagccttcaatgcgggaagtagagatggcattagaatacatagctttaaagaagggcatttttgataatgggaatatatatactgcatcgagtagatcggatagaaatgatatttcaacgcattacatgtcaattgaagtaattaccaaggaagaaagtaggcaattgacaatgaaagaggaatgtatttgtcatcaacctattcttaattatcaaggtctgcctagagggaacactacctagtttgcaatgacagatccagcgtgggagggggaaactattctaaactctcgtggggatgccctttcattgtttgcatatcactcaaatggttgtgaaaaatattgaaaaaaaattgagaagagtattccgggcattacaacgaaagaaacaaattaaaccatagctagttaataatatgtttagtcccccccccccaaaaaaaaaaaaaagtttttccatggatccacacttgctgtctgtactaaagacatgaacctaccaatctacatacgctgcatttgttctattgtcataatatattctacttctaagacatcaattcaaaaggagaaaactgcaagtattacttgtgatttggtttattgttggtatttcttatgccctcacaaaatgtatccaagaaaacacagatttattggtgtagcactttactttagagtattttatggttatccgataaatagaacagagtttgtgaaacacagataaaaggaatctcacacctatctagttatgaagaaatctgagagaactattggagcctaacaagataaagccatgagcaaatctcggtaaagaaaaagaataatatgagtttacgatgctggttattttaggcacaagacataatccaccacgcagagctgttgaataggccctcttgacaatatcagcttcttattagaaagcttatgagatctagtttcagatatttttggtcccacattcaaattcatcctgagctttccaagatctaaaaaaacaagtgcctctttgagtcggagtctgttttggtattagcccttagttatttcggttttctattggctgctttaactctaaccctagctctatttattgcctggaataagatacgttttgtttgaaataaattgaatgaataagacagaaaagaaaaaatctctcttttggattcttggcattctacgcatcaattaccaattttttttcttggtcattgagattcgtgcataatttagtattgttttgggccttgaattttgtaattgagtcttttttttggtaggcccatgttatggtcgacctcctacccctgtgaactcataaatagataaccgctgccacctcaagtttagattttctttagattattctgtctaacaataatttataacgtgattatttgtataacattaatttatctgtaatttatttagattaccttcctccttgttcacatgaattttaattgcttgcaagatcaataatcatcgaggttatgtcgattgcaagagagcttggtcgataatgatgagatgtccaggtgtagcgcttgtgtggttgcgatcgactgatccgaagctgcaaaatgtcaacatcttcacatcgacaaatcaaacctaagatctagcaccaatttgcataaagggacccacaataaaattctcatttttagttccttgtagataaaaaattcgaacatgatactccatccgtcccattttaagtgtagccataagtttccgtgtccaacgttcagccatccgtcttatttgaaaaatttatgaaaaaattttaaaaattaagtcgcgcataaagtattattcatattttataatctaattacaataaaaatattaattataaaaaaataaataagacatacggtcaaactttaggcactaaaacccataactgcgtttattatgggatggagtgagtattttctaaaattccgcgcagacatccatagtttgtatcccctataggaataagttcactttaagtccctctatttgtcggtcagtctgactttcgtcccttgaccgtaaaaccgggtacgaaccgtcccccaacttacgaaaaacgggcaaacaaagtccctcggcagtatggagggcggttttggctgacgtggcgtctatgtggcgcctacgtggctcctttgactaggtcttcgtcccacgtggcattgacgtggcgattacgtggcaattttatctcgaaaaaataataaaaatagtgggacccatatgtcagctacacaaaaaaaattaaaaaaaggtggggccatgtggtcccatatgtcagcctccttctctctatcccccctctctctcccccctacattgccaggagagaagggcgagcggcggcgctgagggggcaacgggtggagcggcgacggagtggagcagcgacggagcgaagcggcgcgatggccggcgggagaaagcggagcgacgatgggcgacgctgcgacggagcaaagcagcgcggcggccagcggtgaacggagcgacggcgggcggtgagcggcgggagaaagcagagcggcagtggggcgaaatggagcggcggtgggcggtgggcggagcgacgccgacgccg

SEQ ID NO: 58455 - DNA, 7734 bp, Oryza sativa
  unsure (1)..(7734): unsure at all n locations
tcggtgatgtcatcgttgacgtcatcgggatcttctcccgtaagccggtcgtggaccgatcgatctcggccatccgatttggatcggatcaatctcgaccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaacccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagagtggttgggcctatacaacagggtatgttgtatagcgttggattaatattgtttaattacttaactgatttgttaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaccaaaccagtacttgaacgaggaagggaacgtggagagggatgcggagaggaaccagcaggggcacgtggaaaggaatgtggaggggaaccaggaggaggaggctagtggtagtcaaccctccgttggacagaagagggcacgcggacaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacagtgtactggcgaagaacaagggcacgcggagatcatgagagctttgtcccagattcggagaaagagatgctgtggaccacaatgctcgagacattcacccttcctgcgggtagagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggatgagtttgttgcatataagacaggtgaacaagggcaggcgatgatggaaagaaacaaagaaaatgccgccaagaagaagtaccatcaccacttggggtcagaaggctatagcgtcgcgatgccaaagtgggaggtgatggaggctagcttgattgagaggggtatcgaaccggcaaccgccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccggacagagatagggacgagctgacactcgccctacaaactccagagcatccaggatgaatacgagggaaaggggtgattccttggaagattggtttcaaggaggacatccacacgtacaggagtcggatgaggagcaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgttaggaaaaccgtagcagctgcgcctcaacggggcaggtaggatcacagagcatggacgccatgcaaacacaggacgaatcgacctgtcccattgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacagtgagacgcatctacgacacacaagccagcggtacatcatcctccctgggcgacaagcggcgtctcgtgcaccatctcctcctcaggatcctgcaccgtctcctcctcatgctccgccagcaccgtctccacctcaggctccagcactgactcctcctcaggatcctgcactgactcctcctcgggctcctacacctactcctccgtaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccaatgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccgttggtgatcggggaagacatgacgatagaagaatttattattgacaccggtctaactacggatcaattgctaggagttgaaccaatagaaaaggcggaattgaaatacatgtacgaactcgataaaccgcttgtcaagcccgagctggtgcagtccctacccacacaaatgtacaagttccatcagctgtacatggagatgagcgccaccggtagagagatgatcggagcgaggatcagggacccggacttcttgcaaggagatgatattctctagatcaatttcaagggaatctatgaagtataccagctggacgccctcgacgtctctattatgagttgctggattttgtaaatatatcgttcagttatatttcttaattactacgtctcctttaattaattaggtccttgtatataagtaaactatataaaataaaatactcccttttatcgttgtagaatggagattcaaagggcccgacggcggagggttttcaatactggattcatcgaccctcggagagtaaatgtcgcaatgctcgaccaatatccacaagaaacagaggacaatctcgtccatctcctgaaggcgcaacattacaagacgttcatactgttgccgtacaacacagagttagtttaattttactgtcttcctacataccaaatttcattcccgtatgaacttgctaagtgtttcatatgtaatgcatcccacgcacattgcagattccactgggtgcttttactcttcgacctgtcggcctgcactatcaacgtatatgactcaatggataaaaacgagtctacgtttgacaaggttttcgaacttatagacatgtactggcataagttcctctgttaattaagaaattcttgttatgttaattatttctactacgaatcatatctttaaactccttgtagggcttggtatcggttccatcatttggtccgtggcaactggagagaaagacttaggcggaggttcaaattttctttgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgctgaccaaatcatcaccacaagagagctcgatgtacgtacaaataaattcaaaatttcattacgtatcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatacacacacacacacacacatatgcatttgcataacatatatatgtataaatacatatatattatgcatgtacatatgtactgaaccatatatacatataatataatatatatatatatatatatatatatatatatatatatatatatatatatatatatatatatatatatatatatatatatatatatatatatatatatatatgcatatatatgtattgaaacatatatatgcatggtttatatatatatatatatataaaccatgcagcaacagggccatgcaaaaagaaaaaggtcagctcgatctttagtcccggttggttggctgagccatctttagtcccggttatttcacccgggactaaagatagcgatctttagtcccggattggtactcccggtttggaaaccgggactaaagggggttacaaatcgggaatacaaaggtttctccaccagtgtatgcagatactgagcaaacaagaaagcagtattatctcctttagcgatgagatgcagctgtatgtagtgaccgaacaaaaaaaatatagcagcatatactgaccaaattttaaaaaaaactagtatatgctccgtcaatactaatgtattcccttcgttttatattataagaatttctagcattgcccatattcatatactccctccgttttttaatagatgcgccgnngactttttctcccatgtttgaccattcgtcttattcaaaattttatacaaatgtataagatataaatcacacttaaaatactatgagtgataaaacaactcataacaaaataaattataattacgtaaattttttgaataagacaaatggtcaaacatgtgagaaaaagtcaacggcgtcatctattaaaaaacggaggtaatatatgttatgtctagattaattaacatctatattaatatggacaatgctagaatatcttataatatgaaatggaggaagtagtatatactagccagaaatttgaaaacagtatatactgttccaaggaataagtagcacatacttgtaacaaaacagtatatactgttccaataaacagtatatacttatatatagtgcaggatgaatgagattccacagccgatggagagtgacataattggctcattcacatgcataattgtatctattaattagatgtaatgtttggtcatgtattttttatggattgaacgtgacatcgatgaacttgttattgtttaataaatgcaattttgcttgctaattacaaaagtatgccacgtatgttcggaataaacaaatactattcaatatcttttcatggttgaacaactttcaaaaatcagtcttttgggaaaaagacttctggtaaagtcgtacaattttatcttaacataacaaaaattgatttttaagtcattctataactattttcgttatgtgagctactcagattaccaaattgggttcatgctatacacctagaatcaaattctaataaaaacatgtttaaattcagttcaaacttgctttgaactagttagtaaaatagttaatgttaatgctaaacatttaaaaaaatatcatactcattcaaattggatatatactcatttgcgtatttcataccatggtgtctcatatgagtgtcatatacatatatatacatacgtatgtatatatatatgtatatatatatatatatatgtatgtatatatatgtatgtatgtatgtatacatatatgtatatatatgtatatatatgtatatatgtacatatatacagagacatactatactagacccagagtgcataataactaaaatgttacccctcacgtcctaccccccaccccaccctaccacaaccctcccctgccccaccgccgccgcctacggccaaggagtggcggcgtgcaggcgacgggcggccgacctaatcaccgcccactcccaccgggggtcgtcgtcgggttgtggccgtatcggcgtgcggctccggcagcggcagttcaggaatgaggaggagcggcggcgaggcgcatccagccacggctcggagacgaggaggttcgggcggtgaatccg

SEQ ID NO: 58456 - DNA, 14539 bp, Oryza sativa
cccgccgcccatcgccagccgcccaccgtcgctccgtccaccgccggccaccacgctgcttcgctccgtcgccccctcggcgccgccactcgccattctctcctggctgtgtgagagaggggggatagagaggagagggaggctgacatgtgggaccacatgggccccaccttttttaattatattttgtgtagctgacatatgggtcccactatttttattattttttcgggataaaattgccacgtaaacgccacgtcattgccacgtggaacgaagatctagtcaaaggagtcacgtaggtgccacgtagacgccacgtcagccaaaaccgccctccatactgccaagggacctcgtttgcccggtttcgtaagttgggggacgggtcgtacccggttttgtggtcaagggacgaaaatcggactgaccgacaaatagagggacctaaagtgaacttattcatcccctatatggctggaaaaaagctcgtggcccattatagctcgctcaacttgtggctgacttggctcattttgatttcctaacaagccaagctgttgtttcagctcgttagcgataaggatccagctcaaactggcttgcatgagccgcttgtgatgtaaacgagctggtagaaaagagaagctaacagccatataccaacttggtggcccagtaggaggctggtgcatggcctaatatccaaatggcccaaacaaaacattctaaaaccctagcccccaatttcccatcttcattatttcctcagttgcatattataagactttctagcattgctcatattcatatatatgttaatgaatctagatacaaatatatgtctagattcattaacatcttcataaatatgggcaatgttagaaagtcttataatataaaacggaggaagtagtagtgttctgcaatatctagttccaggcttccagccgccgccctcctgcattctgccaccaccagatcccgctcacatcatgtgccagatgcgagccaaaatccaagtacgccaccatagccgctcgctctcgctgctgcaggcagcgactgacttcgtccatcgaaccgtcctcgctgccatggcatcgtcggtcgccacgctcgcccgcacgatcttgccggtcaagaacaccactgctggctacggcgctgtgggctgcagcctcgtcggctgtcgcgctcacccgcatgggctcgtcgctttgtgtgcgccgctgtgggctgctcttgcccctgccgcttgatctcccgctatccctacgccttgtcgcatactcgcttgcgctctcgctcttctcattagacatcttgccctttgtagcttgcaaggtaaaacaagctggctcgagctacaaacgagttaggacgagctgcgttttctgctcgtttagataacaagccaagcttagcctactcattatctaaatgagctaggacgagctgagcaaagccagctcggcatctacccctaacccgctatattcgactacaaaatacgtaattgtacgtaccacccccccccccccccttcatggcaagcagcaacgctctcccctcgccccgcctccccatgagcaacagcagcagtgatccacatgacgactaaaaacaccttcctgatctctcccaccgcccccaaaaatactgtgggcttctggatctaagcaatggtggtgagaagacagcacctcggcctccagtgagcagcggcggcggtagccttggcctccgatgggtggtggtggccttggtctccggtgagatgaggcgatggaggcttccatgtattgatttgtgttttagtttttgtgatgaatgttatgtgtgtaatattctaggatgattcttacttattgttgtttgatgtgtgagattttttttttcattttttgtatgtgttcttggctctaagcatcagctctgatttgagccggtggatcaaactgactttttttttctcattgctagctccttcgattctccacattagtgccgctaatgggtgtcagttggaaaatccagcacttatgtgggtttctaaccaacacccatgttcacattgcaattcaaatgataggacataagctaagctcaagcctgctgggacactggaatttaatttgttttcttgtttcataattaagaaaggaaaaataatttctatgattcatgcagaaacttaagcgtctcatctctgcttgttggctttgtcagccaaaaccaatttaaatgttactcgtagaacttaatttagttgattttgggtattatcatggtatattttccagcctggattgaaccatgaacaatatgtgtgtgtgtgtatatatagacacacacacattttgcctatcaattatttttggttttcattcatatgttaacattttgcccatgaataatatagcctatccatatgaaattttatgcgcgttataaagggggttaattaatacgagtttgtggagcttaattaaaatgcatgcaactaattatgggaattaattgcaggctttcagcctacgtacgtttcgaataaaaagaaaagagagagcagaagatgcttgacgtgcccaccggcaatcatcagcacccctgctgaatatatggcctgcagtaaacaagaagagaggctgaagctgtgcgatgacgtagaattgctgttttgcatggtccacctgaactcgatggtggactcccaaataagggtatttgtaatgctggttcctcgaggagtactatgcatgcaacagcttttttttttttgtctcttcttttattttaacagaagggaaacagctcctccccttttcattaaggaaaagtatcagttcagctaaaaaaaacagaaaaaaaatcatccaacacacatttgtgtaacccccaaaacaacttagctgaaacaagttcacacaagagggctattgaacctgcgatgcttaaaaaaaaactagaatagttaaaggccctgtttagatcccatgataaaattttttaccatgtcacatcgaatatttggatacatatatggagtatcaaatataaacgaaaaaataactaattatacagattgcgtgtaaattgcgagatgaatcttttaagtctaattgctccataatctgacaatgtggttctatagtaaacaaattctaataatggattaattaggcttaataaattcgtctcgcagtttacagacggattctgtaatttgttttgttattagtctatgtttaatactttaaatgtatgtccgtagtgacacaccgaaactttacaccctaaatctaaacacagcctaaaccgaacagaatgtaaatgctctctgccgccgttttctttcttgacacttcaacttctttatatctccagctggaaaaggcggcaaaacttgcgacttgttttagcaagcgatcaccccattgcagctcgtttgttcttccctccgaattccgatctctgcaaaatggaccacgatgaaacacggtgacaaatctgatatatcagatcaatgggatgagaaatccattttctctcaaaacatgcattatttatggctttccaaatatatacaccaaagtactgctggaataccaaccgcaatcagggtttgtcctttttctcaaacttttggaaccagtcacccaacaaatgatgagtgttaaggattttctcaaattaaagccaaatgaactagccaccacattccaaataaatgtagtcaaaggacaagaaatatgatattcttagtcaacagccaggtaaaactctagctttaacagggattttgaaattccataatttcctaaaggggaagtttagacattgtaattgtgaattattatataaagattttacagagaaacattttctcttatccaagtcccacattaatgcaccttctcattgttaaggacaacattttcacaatccctctgtagcttaccccaggcaacagcctttccttctatcaggctttcctaaagggtaattttaccatccttgataaggtacctggaggtgccatattttctagtgtaaaatttaatgcctctagctactaatacctcaaggtactaaaaattttagtgtaaaatttaggtatcttaaggtattttctcaagaactgtaatttttttctctcctaaactgtagcctatccagcccgcccttaaaaactttatctactatcctaatttttgacaaagttatattgtacaattctagatacatctcaacaagtgatgaattctctagccacttttcctgccagaaaagggtatcttcaccattaccaatctttttggaacagaatttcataaaatcgtctttaatgctcatgaacccattccagaaaaaagaaacaccaggtttgaaaacacactgtttaagggtgtttttttttaagtatttagccttcagaagactttgcaacaaaccctcttcattcatcattttccatagccatttccccagcctccctgctttttgggtctgtaaactttctaaaattgaattagacgatatttcttaattctctgatcctcctgccagaagaatctataccttaaataatccatcttatttttcactccctgtggcaccaggataaaaagacatcatgaacatggaatgctacttaagctagagattattttagtcagtctaccaatgattgccagcatcttcccctgccagcaccctagtttctaattctattccatcttgttttcagcaggttttcaatccttgttatatattcttttgttatctattagtataccccaagtatttcataggtaatatgcccagtttacatgttagcatgttgctataaatttcacttttctcactagcgcttcccaaaaaaaacacactcttgttaaagttaatctttaaactagacatttgctcaaacatacacagattgaacaccgcggtgaacgagcgaggttgagcactatcctggcttccaagatcatgcaccatgtgatttcctaggtcaactaccgcccgccatgtctcgctcgattgatcttgatgggcacgcacagcataagatcgagcaccaggggagcgagacatgaatggcgtgcctacatgatgtagatccaccttccatgttcgaggagtcaaccgccaacccgccagtggtggtcgagcggaggctcccatcaagccaagactagtggtagttaacactaggagagggcagcggtgctaagagatttgagttgaggagaggtgagggcagtggcaacccttcccctttcctgctgtgttatcagtagaacattcattggatagcatcctatttcttttagataatggattttcattaattcggcctctatatccacgagagatatacacagccaaaaggatacaagagcacttagggtgtgtttggttgagctgtagcttttaaaaaagtagttgtgggctgtgacttttcgaaaagcagctgtggaatatgggttgtggcttttggaaaagctcgtttggttcaacagctgtggcctttgaaataactagtccggcttacaagcgggccccacatgtcatacacacattgcaaaagagggaaaaaggaggggaaaacagaggaaaaaaagagaagaggcagagcgcggtggcggagtcgggcacgcagcgtcggcggggaggaggagcgcgcatcagcggaggaggtcttggcggcggcggcggggaggcctcagcgcgcgtcgcgtgtgagtggttgcgagaaggggatggggaaaaacaaatcgaactgttttctcataaccagtggcaggtgggtaatttttttgctcaaaagccattgaaagcatgggtaggaggagctttcaatttgtactagagcaaaaacaaaagcaggttcaaaagcccaaccaaaggcacccttagactcacaccacatcaaagaggagaacacacaaaaacctacaaccttggtatatccctcctccactgaaatgaccaaaatcgacgagtgcagattgtctagtcgccaccgccctagtggattgtcactgcaaaccttcgctagtgccagctttatccacttcaagtgagatgacgccacttgccgtcagtaagcccaccttcctctatcgtcgtccagacagaacaagacgaccagacacgagccaaaaggatccgcttccgcttcagcggattacaaggcctacgccgcccataaggccgcctccaacgttggaatcctcctctgtctctcagacacccagcccactgtcacccctagggcaccacctctaccagagtcctctgccgcctccactgaggatatatatcttcttcctcccggactccgaggcctctggtgcccctagagccaccgccaccaacgggatccgactcctcctcgccgagatccttgcaccggcacttagaccgccgccgtcccgggccaccgctgcccctagggtcgttgctgcctatggaacacctccgtcggatccgccttctccttgccgaggactgtctgttgacgcttaggtcccatcactgtcctccgccgtagcatcctatggatagttggttagtgtatggtcattgcaacttgcaaggcaataggccctgggatcgattcttgcccctctctgaattatatttatatattcttttaacttttcaactccatttttactctaactccattgaatcttctgtccatatttaattcaaccccattggatcatcattcttctttcttccaatccattcttaatttcctaattttcttttaacttcattgaatcttcattattttttttagttcttgccctttcttaatttctattttcttttgatttttcaactccattggatcttcttaatttaatgttttattttaactccattgaatcttatgtcttttttaatttaacttcatttggatttttcattagtttttcttccaatccatcatcaatttccttttgtttaacttcattgaatctatattctttttttaactctagtggatcataaattaaatggtacagtagatgccaccttaccccttggatttttaagttaatggcatattagatgtcacatataataatttcttttataaaatggctgttgtaatatgcaagcctctctccattggatcttcattttaatggtatattagatatcatctatacttttttagaaaaaaaaacttttgcaaatcataagcctctcgctttcatcgtcatgttatgaattattggagaaatcttggcacctctaatacccaaatcctagcttctcctttgagagggtcgtgaaggacaaaagagagagggagaagacaaaagatacatgtaggggcgtacacgtatctattccctctatttcaaattataagtcattttgattttagtcaaaatcaaactactctaaatttgatcaatcttgtggacaaatatagtaatatttacaattccaaattagtttcactaaatctataattaaatatattttcataatatatttgtcttgggttgaaaatattactactttttttctacaaacttagtgaaccttgaaacaatttaattttgaccaaagtcaaaacaatttataatctgaaaagttgtttctaagaaacaataccatctgttcctttttaactgccaaaaaagaccggcatatgtggactcgatccattaaagtcgtgcattcgttgtgagacttggtagcgaagccaagcaaaccgcaaagcactaatcagaagtaccttagacaaagatttgatcactgactcgatgaactctatcatattggtagctacatatggacatggagaccggacctgaaagtgactagcgacaagaaagatcaatcactaagccagcatgcatcaaccaatcatagtagccacataatgtccttagatatttcagattacgataactaattaaacagtgtaacatttcaatgttacaaaacaatcctctagagaagtggcagggatcgaagaagataacaacattatacttgatcctgggagaatttctcatgggattgtcgacaacaagtcctgtatatctggaggcaataccgcaaagtcgttacagcacaaatcatttgatataagagcgcaacagtgtcacacaaacacgctgtccagaaactttattttattgaaacaacccataattatactgtataaaaatagaaaattgtacaattggtaaaaataaagttgctgcgcaatctatggacatacatgttgatactttcatgcctcgtcacaagccatatgattttcctcgtgcctcctatttatggaaaaagacttcaccttttatataacttttctagataatggagaatttcattaatcaataaaatcataccttttatataaaattataaaagtagtccacaataatgatataaaggagcaatatggtgctaaacctttatgttcaatattatagctgctttgaaattttataaatgaaattatagctaaggcaatttccaacaatatagacttcactatttacaacattatataccttacattgtggtctaaactatctaacgtgtgtactaccagtttgatgcaatatgggttttttctaacacaatactctctccgtcctatatgtcgcacactcgttttaaaattcaaatggcataaacttttactagcaattagtgataaaagtatagtattgtaaacttcatatttggatgtactttattgatttcactatggataatcatattttgagagcaattggcagttaaagtttaatttttgagaccgtgccaacacttataaaaaacaaagtttctatacgaggacgtaggatgcaagtgggtcataactagtgcgtctacaaaaatcgagcaatatttttttgcatacggctcattaaagacctgcatgtaaaaatatatttttcatagacagattactagagggactgcatgcaaaaaaaaataagcttatttccccatgcgattctcttaaggagtcacatgcaaaaatagattttcacatgtggacctcttaagtggtccgcatgcgaaaatacccgcctattttcatagatattttctcccctcctctctcctttcccactcaacacttcaaaattttccacttcacctctcccttctcgcactctctctttctatcttcttcatctctctcttcctctcctctcttctctctttctctctctcaccgagtgggagcaggcggcgcggccgacgaggaggcaccgagtccggcgccgcccagcgtgggacggtgggcgcggactccggcggtggaggccctccctcgcccccgatcttgtggccgccgccctcccctaccccgatctgccggcaaaaggaggaggacaagacggcagtgacggtgatgggaggaggacaacggcgacagcgacaggagacaggaggacgatggtggcggctagaggatgaggacgacggcggcggctggaggatgaggatgacgtcggcggtggctggaggatgacgatggcagcggcggcggtgtattttttatttttgaattttttttatgatttttccttttcgcatgcggtcagcttaagcgcgcacgtgcgaaaattagattttcgcatgcggttgcgctggcagcatgtaaaaatcatacattttcttccatgcggcccgcccaatcgcttggccatttgcaaaaaccgattttgtagtagtgcaatcaagttatattttcggatggatggagtatatttgaacttagatgatagtagcttatgcggtgtttgcatacttttgaatagttgaacgtactcttaaaattattatacaccagcatcaaatgtaacatgtaaataattaaagatgagtacataactgcatcacttaaccatctaattctaggccatcttatatatatcatatagaagatttttcatggaaatagtcaacggtttatatcatataggagtataagattttcatggaaatactcaacggttcaatcttcaggaacaggatactttgactttaaggggtaacgatagaaaaacctggatcctctaacttcgagggagtaaaggtaagtgtagtgtatgagtgtagtgctacagtggttcgtagatggcacagcaggcggtataaataaaacaaaataatataaacttattatattacagctcctatttcaatatacttatcatagaaactgaaactataccaaatattttttaaatcctgaataatatagagtggagttgacacttcgctgcctaaaaattaggctataaagacccgccgctcctcggctctactccacacccgaagtagaagccgtaccaaacgggtctaaaactaaacgacatttactaatataagagcaagtacagtagcatactattagccagctataaacatattttagtgagataaaagatgagagagaaaaacaacgggctatagatctatagccagctacagagtacggactccaaaacacaatgcgtgtatgataggtgggaccatatattaatagtatagtaatcagctattgcatgaattgactgttatatcggctatactattaaacttgctcgaaacggggatactcgtagctatcagctccaagcactctcccttcggagtaacgactagtaataatggttgacataaagccataagcacgcatgatcagtgttggatccaatgcaaacaaggagaatgattggtggcttgtagagagaaatgatcaatgctggatcctgtggcaaacagatcacgcatgattaacacaaaactgattattaccacaccatctgcaatgacatccggggttggaccaaagaatgcaactgcagtggcggtggggcccggctcagcagggagacaaatcgatgggtgggtcccacgtgcagcacttgagcaggtgagtgcagtctctgttcattcttctcgtaccctccaattcttctactacaatgcacggattacattggctaaattattcagagccgacactaatcactgagtcatgttgcttgcagctgcctcttgcaggggtgacatggagggtttccagaaaaataatcagtcttaaactgaaaaaggaagatatattactttccaaaggaaccgttggtgcagcaaagaaattgttcttttttcctgaggataatacttttgggttagttatatgtgatatactagtatgcgtctaatgcccgaaaagtatagatcgaaagtgtcaatgtgaagatcaggttggggtaaaatctggtcgattatcgtaaatttttttctctaattaatggtaatgacaaactaaacacaatcgtggtaaaatctggagtatttgattaagctccttatagtgaaacctattcatctgaatttaaatattagatttgacacaggtattcataattataattaattattttttaatggtgggttcaaaaaatatcatggctgcccgtcgttcgataatcttaacaaatctcgtcttagtttttcaaatgtgctcttgggtgtagtggtttgtaaaaaaatcatatggccacccgtggttcgtcaattttaagggttgctttgatatgtaggaaaaatatagaaattttggaggatttcagttctatgaaaaaattctatgaaggcctttggaaagtataaaggattgaatcatatcctatcttttaaaatttttatggaatgggtaatcctatagggattttggagaaaagttagcaacaagtccaacctctcgaaaaaattcctttgagtctatctctctcatccgattattgtgtttttctcgtggtacaatcaaatggtcgttcttgtgtttttatgggttttataatcctctgttttacacatatatttctgtcgtaatcctgtattttttatatccctccgttttctattcctactgctcaaaaaggccctaagaaatatcagtctagttgtacagagatgtttataagagtagtggttcctcaatctctatatacgtttggtccaattttggtccaatcttgtattatataactgggtccacgcacacacaaaccacaatgcatgtgccatggctaatcccccctctctgtcttttcccatttggctcaccatttgggcgtgggttactttgtcgctagtgcattgattttcattgtacatgcttttagttttgacgcaaatgaatacgtcaattcaacatgcgagttaatgagagtttggcccggctcgcgcacggtttataaccacaatcaattttgaattttatattttagaattattaacagtgtttttaagtcgattttgttacttatccttgtcattaaagtagagaggaaatcgtgttcttgttgttgttttcaatttcaatctgattgttactcttacttttccaattttatgatttttgctcatttgtttaactgaagcttgtgcttgggctccattttcttagacgacttaacagtgtgaaaagccaaaataggggtaaaattatgtcctaatgcttgatgtcaaagcaaatgaaaaggcataaagttataggaaagtaaggacaaatctacatagagaacatatttttggcgccattatgtactagtaacaaattgaggggacaaacacaagcttccataagaaatatatatatagctaaagaaaaggagtaacatcgtttgattagaaaacagagacaagaatacaattgcgctgaagtggctacgaaaatatttttattgtaaaactattcttattattatttggacctctgctttgttcgcttatagcctagggattgccaaaaccagtgtaaagtaccgtcagctagaccgaaaatgggagcttcagtggccagtttttcgactaataattgtcagaaagacccattatgatcggaaaaacataactcctattggggacatactgaaaaaatggaagaagtgggtcttgcgcgcatccgctcgatatctcaccacctgtgtctccttcctgctccactcgcctccaccatcacgtctagccagcctcaatcgctattgccacagttagaaaagcatggatccatactaccacggaaagtcctcaatccgcctctcaaccattggcgatccgtgccatagccactagaaaggcctcaatccatgccgccacaggtctcgatctatgctactcattgacaagagatcttgatccgtattgcttccactgtagaagactcgatcaacctcattgttgttaacgagggatttacccctcgtacctctacgatgtccactagtattgattcgctctgtcaccgccgtctccaccaatattaatccacgtaggttacacctgagcttttatggttgccgccttaattctgtatgggcagtgattttgttggaatttattgccaaattctactgcatgttaatctatttttattgttggtttttaatttggagacttttctgaaaatgaatgttttactggtcatgcgatttccaaacgataaggatttatatgtttcctggtaatttcgggagacacgaacaccaaaacaggcccttaaagggaaaaaaaagaaaaaaaaaagggatatttcaagctgtttgtacccctgccgacgagagtagatgaacggttaacttccaacttgcacctttacagaattacaatgcacttgaggttaaagttaagcttcgcctagacgacgcaggttgaggacttaagctttgcatggacgatccaagatactacgtccatctatctatctatcactggtggagaatccatctttactcccggtttataacctcttgtagttccggttttctaaccgggactacgaatacaagactaaaaatagcgatctttagtctcgggtgaaataaccaggagtaaagatctcccggttggtaacaccaaccgggactaaagagaggaatctttaccaaccggtactaaagagaggggcagtcccggatggtccattttctttttattttctcccaaatcgagtaagatgtatataccatatcaaacaccaaatcctcaaatcgagtgtcatgcgtatacccaaatccccaaattaaagtaacatcccaaatcattcacatcacaaatacaaatcctaagttacatcacaaatcttaaaaaaaaatttacacacaaatcaaatgcatcacggatcgattatacatctcagatctatgcaatgagtcacaatttacaaaaagaaattatacatctctcaatcacaaattataaaaaaaaatggagaggagatctggcgcggtgccgcccaccgctgctcgccacgggcagtgcctgccgccccgtgcacggccccgccgcgcgccttgctcactgcctcaccaccggtgtgcgaggccggctccgccaccacccggctgccgtgtgagggcgcctctcttttggaagctgccgcctgagaagtggggaggggaggggaagggatggggcggatacagaggagaggaggtagaggaagagatgggaggag

SEQ ID NO: 58457 - DNA, 11940 bp, Oryza sativa
gtccggacgagctccgaccgcgacatggtctgggaccggctcaagtcaaattcattccagttaagataaaaatttcagaaaaaaagatctggaattcttatgctgttcattacatttttcaatttgttgattgctgatatgaacatgttgcaggttggatgaggatatgatcgaggtgctattcatgaacaattcgacagccgtggcgcctaggatggacaacccgaagaaagtcggcatgccgcaatttaagcaagaggagagagttcttgaccccaagaaggcacagaacattgccatcctgcttcgcgcgctgaatgtcactctcgaggaggttacggatgcgcttttagatggtaagcaataattgtttggcctctgtttactactctctccgtccgaattttaactttttgcttttaatgtttgaccacttgttttatttaaaaaatttgtacaaatataaaaaacgaaatgttatgcttaaaatattttggataataaagtaagtcacaaataaaataaataataattctaaaattttttgaataagatgaatggtcaaacagtacaaataaaatgtcaaaatcccttatatcatgagactgagggagtatgataatttagataggaaaaaaggcatatcttactaagggcaagtaatactagttgttggattctgttgtgatctattctgaactgtcctcagaaaaaaatatcatttgaactgtagggcagcagaccagcagtagtatgagtaaggttactaggagtataaaatactactacatgctaatacagcaatacacacctctcagcgatgcagaattggataaaaactataaacactttgcatctaattccagtaaccatatgttgttcatctataaataggtaatgctgaatgtttgggagctgaacttttggagaccttagtaaagatggctccaaccaaagaggaagaactgaaactgcgagatttcactggggacttatcaaagcttggttcggcagagcgctttcttaaagcagttcttgatataccgttcgccttcaaaagagttgatgttatgctataccgagcaaattttgagaatgaagtgaattatctcaggaaatcttttcaaacgcttgaggtattgcagttcacgttgtatttgtctctatcatgggttactgcattaacatatattgttatatgccatcatttactgcataaaactaatactccataaaacatatatggactagatgcttgaatttggactgcaccatggtaaaaaattctaatatattacactacctgaatttatatatcatcaagctgtgttagttttgaaaaatttatggactctagtgcacatttgagttacacaaacatttaaaatttcaatccgaaattagtatgtggtacactacttaacataatataaagttctttcagagtttttgttcatgatttacgaatctttctaaattctttatatcatggaaaattttggcactaaattttttttttggtgcttattaaatcacatatactgcaataattaaggaacttgacaatatattcatgcactcgacaaaaatggggtctgggaacccttgggtagcaatgtattttcacaagatattaggaagtttggagatttatattgcagatggttggtcaatccttggccaggaacatgcgtgataactattgtgtgttaacaccattttagtttgtttgcttgcttttcaagcgtactaacttttaccatatacagaaattattatgaagtccttaaagtctctcactggctctttttagtagcttaacacttctacttgcttttcaggcagcttgtgatgatttaaaaggcagtagattgttcttaaaactccttgaagcagtgctgaggacagggaacagaatgaatgttggcacaaaccgaggtgaagccaaagctttcaagcttgacaccctcctcaagcttgcagatgtcaaaggcgccgacggtaaaaccacactgctgcactttgtcgtccaagaaatcgtccggtcagaggacgcaaaatctgaaaaggctccagaaaaccacatcacaaacatcgcgaaagttgaacagctgcgtcgacagggcctaaaagttgtgtctgggttgagcaccgagctaggaaatgtcaagagagcagcaaccatggacttcgacgtgctacacggctacgtatctaagcttgaagccggtcttggaaagatcaagtcagtcctccagctcgagaagcaatgcagccaaggggtgaatttcttcgcgacgatgcgtgaatttctcaaggaagctgagcaggagatcgagcaagtgaggcacgacgagaaggcggcactcggaagagtgaaggagatcactgagtacttccacggtaacgcggtgaaggaggaggcacaccctctgaggatattcatggtggttagggacttcctctcaatgctggatcatgtttgcagggaagtcagccagcaggacaggacatttgttgggtcagcgaggtccttccgtatatcagcagcaaatgcattgccgatcctgaacatgcaagggcagaaaggaggaagagagagtagctctgacggagatagcccgtctatgtaggaagaggtcagacttcagaaagggaggcactctgcatttttggaatgaacagaaccacagcaatctttgatagaagaatactttgccaggacagatgaagcacacatgtaattttggtgagaagaattataggtgaaatccttttgtataattatggatggttcgaattcttttttgtacaaaataaataagttcttgctgagtaattttgtttaattttttcgataatggaaatcaacccagcctctacatccaggatgtttcaggccatgctgattaatttttttagggctattctctatcgtttctggtctaaaatcaaattatattttggccgtctgataaaacagtaagaaggaatcggtctatagcttctcaagttgcgcgattaaattgcaccacccactcataagttgctctatggacaacccattttgcttaaaggaaaatactcacaatattgttaaatttgtgtcaaaattatgcatccaacttcacctgatgaattctttgtagaacgaagaaagatgagaagggcaaggaaagtatcacactgatttttctcactgggaataaagagagacgaccagggaaggacaacaaaactcaaaagaaatcaatgataaaaatagctcccagcaaagcctcgtcatcatcatcatcgtaatcttctgccggcctagatcaccctcatttctctctacctttttatctgcaagcgacatctttgcgtagaggtaaagaaaaccgaagcatatatgattactgggcatgcatcgcgtacgtggatcatatctttctgcagaaaagttcagttgagtcgctcattgtctccttctcttagtatattttgctttgcattgacgcatccaaagaaccaaaaattagtcttctatgagacactttgagacacggatgggagcagggaaggaatgaagaatttgttgtggtcagattcggccatatcactgcaggccctatccgggaatcggggcagtctctctcgaggcaggctctactgaaaaagaaaagctggagattttctctgtagcttctgtaagaactttcacagtacgcttaggtgtcattcggcttgagccaaccaggtcaaagattcaactccacgtcggtctctctcgttgccccatgaagaacacggagccaagttgagcctcaggttccttgtcatgattagcatttctcgtgctaaaatagtggcatcgtggatcatgtatgcttctaagggcttgggcctagctagcaaccgacgcctagcaagtgtagtaactgcactgctatctccatgagaatcaaaaccagagtcctacgctccttactatatagctgagtgtgtttaattcacgttaaaattataagtttggttgaaattgaaacgatttaatagaaaagtaggaagtttatacgtgtagaaaagtttagatgtgataaaaaagttaaaagtttgaaaaaaaaatttagaactaaactccgctaaaatcaaaaccttctatcggcgatcgtgggcgacgattatgcacgattgtcggctcaaggaattggtgttgactgatgcgtgaatcatcagctaataacactccttccctcaccctttttctcatttgtttgaattgtttttggaactgctgtttttttatacagtgctccctgattggatgaggtgaactggttgcaagctgttccacggtgatattgctgttcacatcatgcctgcacacaggcacacagcctacagcctagtactaattagggcctatttcaaacctccgtattggagtagcatattagcaacatgtaaaacgtgtggcccgttttattgaagtagtatattagtattatgtaaaatggacggctagtatataattaattaagtattaactattattaaattaaaagatttatttgattttttaagaaaacttctatgtagaaaatatttgcacatatcatattgtttagcagtttggaaagttacattaacaaaaacaaataaggaagtaatagtttggaagttgtagtttggagttgaaatttaggactcggcattggcccctctagcttaaattctcttcacatatgaattgacagaggtgaactcctgtgggccaaaaaaattctaaacaataaccattactccctccgtttcatatcgtaagaacttttggttttacctagatttattcattgatcaatgtatgtgttttatatatgcgtctagattcattaatatcttttacggaatagctatctgtctgtcgcatgatttttatgggctgtatcatgcgttttattggccctctgatatgtttgagattcgtgcactcttttttttttctattttctttgtgggttttttagtatttttagttgtgggccttgggctttcacggttatgttggacctttttttctctttgtgggacccactgtatgttgtgtccatgagagtttatgtagggcccacttttactgttgaaattttgaaatccgcgccggagagagggtttgtctgaattacatcgtatttacactataattacatatgtaattttagtatatttacgatgtaagtctgaaaattatatatgtaattttagtatatttacgatgtaagtctgaaaactacttgagcccatttaaacccacgtgagctttagattgtccacgtggcccggttgttggtttggattttggttggatatattaatgtcatccgttagatgttcatctaaagggtaagaaatctgcatgataggaggctaaaaaatctatcacatgatgtatatatagtccctatcttttatggatctagacaatgctagaaagttttctactgtaaaacggaaaaaagtagtttataacgcttctttgagtagcggttgaatcgattggaccgacggtcaggctggcgtaacaggtcagacttattcagctagacaaaagcccgtctctcagccagtaaccggtaatggccacaaggcctataagccataaggcccggttatttgttgcacgctcttggaataagttcagtttaagtccctcatgctcacacctagtttaagttacatcctcaaaaaaccacaataccagatatacatcatacgtatctcaacttgtaaaaccagtgtgcccaagattataagccataaggcccggttatctgttgcacgctcttggaataagttcagtttaagtcccttatgctcacacgtagtttaaattacgtcctcagagaaccacaataccagatatacatcacacgtctctcaacttgtaaaaccagtatacccaagattctaggtagtatagtgtctggttttggttttggatgatgtgacgagtgagggggtgtttggatccagggactaaactttagtccctttcatatcggatgaatttggagtattaaacataaactacttataaaactaattacataaataagagctaattcgtgtgacaatttttttaagcctaattaatccataattagcgcatgtttactgtagcatcacataggctaatcatgaattaattaggctcaatagatttgtctcgcgaattagtccaaggttataaatggcttttatcaatagtctacgtttaatatttataattaatgtccaaacatccaatgtgataggactaaaaagttttatcccatttaaacagggtctgagacccacatgtgagggttatttcttctccctccaaccactcacctctctctctcaacctcctattcttctgtctccatcaccgactctgctcaagcttctcctcttcggtaacgcgcgaccgcggcctcgccgatgggcgcgagtcccttcctccgcctcggaccgccccatcgtcacccagcatccgctcccccttcttctctcgctcatcttcctttttccacgaagccgcggctttgcatcaccgccgtcctaccttgctcttctgactgatcagtcgctgccaccaccacagcaggagccaaagcccaaaagactgggaatgcaatctcggcagcagccatgctgcagcgtctccatcgcccactccatgaaatttctagctatctacctagccagacagagaaataaattccaaagaaaaagaaaaccaaacatatcaatcagagatgatgccaccaacattttactctgatcaatgtcgatccagatgatgcaccgttctccccaagattcaacgacctaggctagaatacattttgcaagcagaaatttgattggtgtggggagacaagatccgggatcaccattgtcggttgtggggagcgaagcggagctccccgcggccagaacggagccgcaatcgcgcatcatcgatctctcgccaaagtcggttctcctcccaccgagtccctttgtcaccacattctgggagctcggtaaactccgtttcacctccgcggccgcggccaatttcgagcaagacggaaatgcccaatttgatccgccgtcgggcgctctccatccaatcccctccacctggttgtcaccttgtcagtcaccttaggccggccgtcatcatcgaagctccatcccgccgctcccgccttcccgaacgaggacgccgccgcgtcgggaccgtcagcctcgcgcgcgcgtgcctcctctccactgctggtttccttgccgcacagaggacggcctcctcagcctccggcgaggccgcggccgctcggcgccgacgaggagcgtgagcagagtcggtgatggagagaaaagagaatatgagatatagagaggggagaggtcggaggaagaagaaatagcccttatatgtgggtcccactcaccacaccagctaaaaccgagatactgtacagtgtggaatctcgagtacaccggttttattggttgagggacgtgttatatctggtattgcagttaaggacgaaatccaaactccgcgtaaagatgagggacctaaaatgaacttattcccacgctctttccatcaattttctagggaataagttcatttccattcccttaactagtgattgaatctgattcgtatccgttaaccacaataccatatatcttgacccctcgattattaaaaccagtgtaatttgactcgatggttttgaaggacggtttcgctgacgcggtgcctatgtggtagtgttgacctgatccttgtcccacgtgactgttgatgtggtgcttgtggcagtagaattaaaaaagtatacgtgggaaccatttatcatgcacaaaaaaatatcgtgggacccactaacatgtaggccccacatgtcctcctctttctcttcaatccttctccctctctcccttatctcactctctccctattccccttcagccaggagtggggcgtcgcagcgcaagcagaagaacacggcagcacagggtcataaggaggaggctggagatgatgtccgcacgttgcacagcaaagatctcatgctcctcctgcaggatgcgcgcggcggagctcgagaggcggaaccagggtggtagtgcactggcccgacggactccacaaaggtggcagggaaccaccacaggaaggagatggcgcgactgtcgggagtcttgactgagcggcggagcttggagaccgtggaggcgggggtcagctacggcgagaggaggctggcgaggaacacgagcgaccagaggtcccgcgcctgggacagcactaggatgacattgaatgacgcgtccttcttccaccgcatcttcacatccacgtacgccatggatcggacaagccctacgagtggcggaaggggtcgcccctcccaccgttgtatcacgacggtcctcttgttggagaagagtagatggatagagccacggcccgcctagagaaggttcgtacctatagttatctcaccggagtcatcctcaaattggcggtggggagtggcagcggggcgagctgctgccgctccggccctcgctgcttgccgccagccaaaggggaagagaaaggggagggagagaagggaaagagagagggaggaggaagaagggaaggagagagcgaggggatgatatgtaggcccccacatgtcagtgggtcccataattttgtttttgtcaatgaaaaatgggtcccactcctacatatatgtttttaattctaataccacctaagcgtcaatgggatgaagacaaggtcaacaccatctcataggcgccacgtcagcgaaaccaccctccaaaaccgtcgcgggagtcaaattgtatatgttttaataattattaaggggtcaagatatcctgtattgcggttcacggatacaaatcaaattcgaccacaagttaagggagtcaaagtgaacttattccattttatggccctttcctcccttatggttgcgcgaatgtaccgacatagggctaggggtggtaatgggtcaaggctcactactctttcacaacccacctcaactcttaaatattttgagcacaagaaaattattaaatttcagcacaaccctttttggcccaaccatcatattttgtaggtcaagatgttaagcccattaccatcccaacatacggcacgccaccctatcagtccgtcatcatgggtggtgactgccaagcccactggacctctttcgaccccacatatgaaaattcattttcgcaatctaaatcagcgaggctaaatctagcacagtgacaaaccaacgaggctaagtccctcagctctctctctctctcagctagtccatctccatcacacctactccctccctcacacatctcctagggcagctgatccatccctctccctccagacctcttggtggcagacaaggcctgccacggcatccggtggcatcagaggcagcgacgggtctctcccccattcccgcacatcaacaccaaccacacccgtagccgatcagccttgggaggccgcgttaggacatgtacaatggtggccacaagcacttatggtctcaagttgccacataggataaggccacacaaaaaccacgatgtctacaaaggagaccactgctaagtgtatgttgtgtttcagcccctaattatttatgtgttagttcttattatatttgttattataaaattatctattttagaccttctaataaaaaaagaaatagatagatacccctaatctctatatgggcccactgtcagcccctccaatcttttctctctcatttattttctctaccttatcgtcatcctctccagccgttcgtgttcctcagtctcgtcgcctccgctttctctcaaagctgccgctcctctcccctcaacgccgcctccacctccggcctctcccccgcggcggagccccatggcggcggcgccggatttggccgccggtttcttccttctcctccctccctcttctcgcatgatcgacgtaccaccggcagcggtggatgccctcccatccccatgccgcgacggtgaggggccaccggcggcggggaggaggagttctcgacggtgagtcccatggcggtggcggtgaggaggagttctcgatggtggtggggaggaggagttcttgatggcgcgggctcgccggatctgacggagggaaccacaacagcggcggttcctctcctcctcccttcttcgggcggcggggggaagcagcggtggcggcggatctggcgactggacgaggcgacgcacgggactccggcttcgccaacgcgtggcttcgcccttcccgagcccaggcgtggcgcttcgggcggttcttctgcaagtgccgaatcggcctgtggagccacgatccccactgtgactggtgctcgcgtccgacgtcgaggtttgagaccacaagtcagggtcacgcgttgtacatggccttacaagccagcaggcttagaacgctatggtcgctgtgactgcatatgaaccctgacgatgacgatgactacgatcgagctcggggaaagcggatccgctgccagcaagctcgggagaggcgaaccctccgccggcgggcctggggaaggtagacccgacaccgatgtgctagggagaggtgtatccagacatgccacgcgattccctaggtggctaggtggggcgatggtgctcagtggtggggtgtgttggtggtggtcgatgagcgccagtgttggtgggcctcagcaattgcatgacgacaacgtccgctatggcggttgcgatggagggtgccggatatggtgaggcggtacttgggagacctctccatgcatgcggtccttggcgacttcttctcaacgacggcgacgaacggcaacatgcgtctaggtggcttcgttacttggcgatgacaacgatgatcgcggctcaatggctttgttggggagctcgcgatggccagatcctgttagttgtgctattgatggattgatctaattggagatttttgaataatctaaatttgtgagtgtgtggatttgtgaatttctgtcagtgtcaattggatttgagggctactgataaacgacatcggttgttgatttttttttagcgctaaaatgtgtttttgcatgcggacgacttaacttgaccgcctcaaaggtcttgaattgcatgtgaaatggcctggccacctaccaaaatctatttttccgcaaaaaaaccattttttaagtgctaagagcatttacaaagcaaaccatttataactactagcctcgatttgttcacctgcatttaaactactgatatgcaatggatggcactaatacaaaagtgaattttctatacgaggccccatcatttttccatgcagaccataactagtggcgtctgcaaaaatcgagggtcattttcccatacggctgcttaagtggccctcttaagagggccgcatgcaaaaatgagctcattttgcatgcggctcacttaagcgaccatatggaaaaatcgattttttcatacggaccacttaagaaagccgtatgcgaaaataaaaattgaaaaatttgaaactagtgtatctcactcatatgaactccaaattagatgatctttttcctaaatgtttctaaaatcatgctctatcatgttattgtgttgttactggtattatattggctattttttcttgtgactttgttttatcaattaaaaatttgaatttcaaaacttcaaatgatattttgaagaagtaaataatttcatctgaaaaagtcatcaataagaaaattgtataactcatcaagatctataacttctattttggacatttcttcatccgatgaagaaatttataagattgttcataaaatgtacatgtcttat

SEQ ID NO: 58458 - DNA, 9864 bp, Oryza sativa
  unsure (1)..(9864): unsure at all n locations
atagatcgtttttttggccatcttttttagtggaggagatcaattgatcagacggaacctagcgaaggctagaagtattcaaggttgaacagatagatacttcatccatccctctgaaaatatacctaatataaggtataatcattttttatccatgtctcgttatatataactctccaatcatattactttcatattatttgcatacatcgaggtgaccttactgaagagacgattaatttctttttttttaatttatgtgttagtagtgttgtgcgttatattttgggatagagggattatctatagctgctttaaaaagaaaaacagagaaaaatgggttaatttgatccatgcaactgcaagagtaaattgcaccgctagtgtatcaacttgataagtgggtgcaatatggtgtaagaacttgataaatgagcaatctagtgcaacaatttggtaggtaggtgcaatttagtataagaactttataagtgatcacataaatacaacaactttgtaaggtaggtacgattttgatacaataaattaagaagttatgtggcaactttattattgggtgcatatttatattggtatcataataactagtaactgaaaatcaattaaactgaatgtataaattattatatttagttgatatttgagaaggtgaagaaaacaaaaaattcttaaaaggtaattggatgtaaattatatgtgcaatataattcttaaagattacattcaatactataaggtaatatccgtaggattatgtaatgttatattgacatcgtgaaaaaaaaatcacctagcatatgcttagccaagttaatgcaccaaaatactacttcctccgttttatgttgtaagactttctagtattgcccatattatgtctagattcattaacatctatatgaatgtggacaatgctagaaagtcttacaatatggaacggagggagtaaattatcaagttcttgtattagaacgcacccacttatcaagttgttgcactcggacgttcaattctcaacttcttgcactatatcgcacccacttgccaagttggtgtaccatgggtgcaatttactccaattgcaaatatgtccatttcaaatatatgccattacaattcgtctattcgtaaccatgctaatgaaattatacaaaattgaaatcgtgccactgccgtcacattttccatcaatctcttttttcccgttttgtttcttctttctttcgtcttcttaccacaccaacgcatggcgggacctcggcggcccggcacgcacgaatccaatccgatgagtggcgggacctcggtggctcgacacgcacgccgtccaatgcaccgtggtctcaaccacatgctcgtggacgcggttgtccatcacgatgacgatctacaaggaaggggatacggggagaagggcatagaggaagcggggcaggcggggcagaggaggtgagttatgcggcaatggaagagtttccctgtcattgatcccgccagggctccatcgctggtggtgtcacctcgcctaaactctacccatatcttatgatagagagagcccccggctttaacagtggaggcggcggcaacgtaaagaaagaagnccaaagaaatggtnngtacgaacncngnccnccttcncttnttncccgggnttttggggcccccccccgggcccctttttcccggggccccgcgagacagtgggaggcgccagccctcttccctcgtcgcggtggcctgaagggctgcgcgagccttctcacgcacggtacggagcaaaacaatgatttttttaagtttaatagaatggttcacttttagtttttgagaaataaatctaggttttctcttgaaaatattagttttttcacttcctattttcggtttagaaaactcaaaaatagaaatttagaggtggattatacacttttgttggtgatgctcttacgctattagggtgtgtttggataatgggaaagagggtgggattagaattgagaaatgaatgaaaggttatgattaaatggaagagggtgaatgaacggttagaatttaaagatatcttttggtaggtgaaaaattatttcccattagccaaacgctgccttaggtattacagttctaaccgctcatatgctctatactatatgtctatatccaacggccctccccgatttccccgaaacgctactacccctccgccacagcgtccacacccgcgccgccgccgccctcaccctcgccgccgcgcatcccgcggtcccaccgtcgccgattccaccgctgccacggacaaccccgccgcccctttccttcctcgccgtgggagcgccccccccctccaggttggctagcagctagctccgccggccgcccttccccgatgggggcagcggcgtaggcgccgccatcagccgccgtacgtatgtgagcggcgcctgcgcacgcctccagctggtccgcgcgaggtaactgtgtggggtaaaattcctctctagtcttcgctttcgccatatcgcattttcgagaatacctaatgccgtagtaagccatacgggggtcgttttattgcttttatgcttaagtcacacacttcgagcaagtctattgaatctatactcgggtagaagtaatgcgcgctcatctccaacgcctattttgcaaaagaagaagaagaagcagaagagagaaacagtggcttttgtactactcttgcacatagaaccccttctcgacttgctatcaacagttggtttgaaacttagcatttctttgttatgcgcagttttgctgaaccagatgccgatgcagtgacgattcgttggccgaggatcgcgttcttataggcccgatttgcaaaggtactactgcagtggcggagcttgagagagattctagatggggccagctattatagagtggaaatgttggtaatggcagaagtagaatttgtagaagggctattcatattgtaaaataatttccaagcatgtttttgttaagaaaaaatatatgttatacctaagtatagctgttaaacaggtggaaaaggatcactcaagttataaaagacaacatatcaaagttattgtaaattaacaggttttaagagagctattttattaagataaaaatgtttgtcatccataggaggaaaatgatttagtaagcaattaaactgaagaaaaagaatggacttctcaggatttgaacaccaaacttccaagaaagcatctgccctcttcacttgctaatcaattgagcagaaaataaattttcttactagatacttgttaagtatatatgtgtttgctgccaaagctgagggggcaacacccaggttggcctccatgaagctccacctctgtactattagctgttgttggaactatattggtcgcatcaagcttccgccaatgtttgcagggttaaaatacttggtggtctgtcatgctgtatgttgatgttatgcattgcttttggtacaaccgagttcctttttcctgactggttccatggttggttgagatatggatgctatgtattgttctttaatgttacactttagcaaaattttcccagattacgtaagcaactactccatccattttatattataagtcgttttgatttttttcctagtcaaactttttttaagttggaccaagtttatagaaaaacataatagtattttaaacacattatattatcaaaatatattcaatgttagatttaatgaaactaatttggtgttttagatgttgctaattttttctaacttataatatgaaacggagggagtattgattacaaacatgatggctacttcatttgattttatttagcattagctgtttcaatcttggcaatttaccatttccatctgttgtgtggttttatttatgtaggagtgcttgtaaatccaatcataccatttcgattttcatttgaccaaggataggcaagaataggaggaaaaaggagagtggcatataatgacgggtggatcaggtgttgtggtgctagacaatgggggtggtcttctgaaggctggatttggtggggacatgaatccgactgctgttgtccccaactgtatggccaagccccctggttccaagaaatggctagttgctgaccagctgcaggcacaagatgttgatgttactggcatgacattgaggcgtcctattgatcgtggctatctcatcaatcaagaagtgcaacgggaggtgtgggagcgggttatacgcaacctactgcaggtggatcctaacaactcatcgttgctactggtggaaccacagttcaaccctccagcactgcagcatgcaaccgatgagcttgtttttgaggagcttggtttcaaatctctttgtgttgcagatgccccttcccttgttcacctttatgaggctagccgccagccatcgctgtttcgagctcaatgtagccttgttgttgactgtggcttctctttcactcatgcatctcccgtgcttcaaaactttacactgaattatgctgtgcggcgcatggaccttggtggaaaggccctcacaaactatctcaaagagctcatttcatatcgctcccttaatgtcatggatgaaacactcctcattgatgatgcaaaggaaaaactatgctttgtatcccttgatgtccctggtgatcttcgtcttgccaggtctgttgccattctcatcccaccacatatggatacatgcttgcctattgtttagggttcaaatttaacctgatttcaagtttatcttcaaggtcaaatggtccttcacacagaaagtcctgctaagaatgttttgcttgtgtaaccagcttaatgagatgtagatagcttagtatcttatctttggaacttagtgctgtagttgacaaaggtggctttgtgtttcatatgtatgtatgaagggttggtatttcctttattagaagctagattttgaaactttgaattgcacttctgggacagcacaatcactgattgagatggtaatagtttttcattaaataattagttggtccacgtgttgaatacagttgaggtttttatccatctaagtttcaattctaaatagtttttgtagtgtctttcctagtatctaagttacaaacatgctatgcaattatttgcaggttatcatctaatgacaacccttttagatgctcctacattctccctgatggtataacatacaagaaagggtttgtgaaggacttggatgaggcatgcagatacagctctctgcctgctaatggagaatcggttagaaaggatagttctgacagcgataggagcaagtttgaggataagaaaaagcctgaacttagtcaaaatgtaacatctcgagctataattacatgcttaatattatttggcatcatctaactgggttgttcctattcaggaatttgtgttgaccaatgagaggttcctagtgccagagatgcttttccatccaattgatctgggtcagcagatctactaaaatgtcatgtgtactttgagctgttcattgttgctctgttaatctcactactgtgcatgttcataggtatgaatcaagctgggcttgctgagtgcatagttcgtgctatacaagcttgccacccacatcttcaacctgtgctttttgagaggtatcatttatttattgtctgaattctgaacctatcttgacatttgaatatacatccatgttactatgtgttggtttgtttccactctccagaattatcctgacaggaggaagcacgctattccctcgattcaccgaaagattgtaagttgatctttttattatttttgtacatcagaaataccatctcaaggggtgtgggatttattgtttgctattcacagggaaaaggaacttcgtcctcttgtgcctgatgactaccaagtaaagataattgctcaggaggagtatgtaccactctatctcttttgcacacgtgcgctgttggacatgtatagtcaccaacttaccattaacatcctgttgctttgtctagcccaattcttggtgcctggagaggtggatctcttttggcgcacaggcctgattttgaatcaatgtgcattacaaaatcagagtatgaagagatgggttcaatgcggtgccgtcgtagattctttcactgaaagttgtgtgccagcagctcagtagaagtgcaatttgtaagtatgattcagcactatctagttcaggtcttgaagaaatactcattaattaggcaaacgagaagtttggttctagaaggtaatgatgcacaattttaacacgtggtcatttttttacataggaattagaagctattactccatgtatctggtcccccttattactggcaaccaattctttcagccttcctaccagctaaatatgcagatatagtccttaccagggaaaacctttgtggtctaacaccctcggaacacagttgctctgagataaatggtgaattttgcttttctgctcggtgaaaagttttcttaatttttttccgagtaaacagcgtgcatggaaatattttattagtcatttactctggcaatacctgacctgtgtacgccacacagagctttagtttagaaacaacagtatgcatgatcgtcttttagaagcataaatattagtatgttagtttgtatattcagtctctggaattttcgagtcttctgtccacctttgagctgaaaatgaccttgctgatcgtgtgattggcttgaatggtatattaactattgctagtacgctgagcctatgagatatgcacctattcacttgtgagatatcctctaaaaatgtctttgttcaaaaaaaaaaatcctctagtgtttactgaaatgcacttatgtcatcaaaattttacgagcaacattgctggcacttcacgtagcaaactagcaatgatttccagataagagtcacaaaggaacaacacacacacacacacacacacacacactccgactgctgatacagaatcttacagatgtcaccagcaagagttcagccacaagaacagaaccactagtacgtagataacaagtgcagcgacatgcatggtaacaattgaattgccaactctcagataacaccaggactcccctcaggcaaccatggttaccttcttcatccctcatccctcaaccttgtcgcaggtgtctctcaggcgtatcttcggacctcaggatccagtacttctccatgggatgatgggaatgacctcctgagccttcagaattttgtgcaatgttcctaggatagaagtcggatgtattccttaccatcgaaactgcacagtttatgaaaccaaaattacatgtcttttctagataatcgattaattagcgtataaaactcgaatacatgtagaactgattggtgcataaaagagggtcagttatgtacatacccagtcgctagcaatgtatcagctggacaattcagagtccatctccattggtcgatctcccctgtaaactctcggcttgttaggatgcttcttgcacacagctaccatgctctccaccacggagtcgacgatgacatggccaaagaactcaacctccttgagccttgggagcttgtcaatgccggagatgccatctgcaggctccttgaggacggcgagcgtgagcctctcaagctcgggggcgcctccttggaagctaagctcatcaaggttgggcatattgtccacgatcagctgcttgagcctcgggaatagcttctcccggaagtggagctctctccccatatatgactggtagtagagcttgagggagaggaggctagggagcttgcctagctgctcgatgacctccttgccatcaaggaagttctctcggagcgagaggtcgaccagattgccgaggtgtgagacccaaggaggcaacatgctaagcttgccccagaggaagaacttctcgaggaagatgggtggcgagtctagatctaggagttcctcgaggccagcgtcctcatttaaccagtggaggatagacaagctgcggagggagtagctgagtttgttgagggacacaatgaatggcttccatttgttaggccccttttcacagttcatgacgcagagcttggttaggctaggtaggtcacccaactcgcccatggcgatgccgctcgacgtgacgttggcatgggcaatggtttggagggactccatggcgctcaagccaggtggtattgtcatggcctcaaatggctcaaagagcttgacacggtggctccttgtgtagtatctgtacctgcctgatagaagatgcctcatgtgtcctagccgggtgatcgtctccggcaactccctcacatcggtttccctgacgtccagtgtcatgagctgtttcagtctcccgaccgaccgtggcagccgctgcacgcctgtgtccctaaggcttaggtacctcaagagggagagcttgcagatgtcgtccaattcacggctgcttagccaacgacaaccttcgagatccagcaccctgaggagctttaggcgcttgaagctaattgatggcagtggtttctcgatgcaccggagcatcaacagcgagcgggcgcaagacaagtctacggacgacaagacgtcgtcctgaccctcgccctcgcccttcttccttctcctcctaaacctaaagatatcctcatcaccaccaccactcctagattgttgcccctgcggcatgtgggagccatggacagatagccgccggatcttgtcatgcccagtcgtcgtagccgcggtatgttggtgacgcccgtagctggtcacgctccccaacaaggagatgaagttctcctccacgcacttggccgtcatcacctccagcatgatgtcgtgcaccttacaacacctaaccacgccattggtggcgacccgagtgggtgtgacgatgctcctgccaacgaactcgtctatgtacttgccggcggcctcctcgggggtccactcccgcccaccgccaacgaacccctcggcggcccatcgccgcaccaggggcccccgcttgatctcgtacccctcgcggaagacgctgaggtagaggaagcaagccttgaggtggtagggcaggtcgtggtagctcagcgacagtatccgcctcatccccctcaccgccgcgctcgtgctcagcccggagcccagcttgccgcacaccttcgtccactccaccggcgtcttgttctccgcctgggccagcattcctcccacactgactatggccagcggcaggccgccgcatttggtcaagatgtcaccggagatgccctccaggcttcggtactccgacgggcaatgctccttctggaacaccgtcttgaagaacagctctctggactgatcgtttggcagaacatccatgaagtgaacgcgatcgccgggaagcgagcagcagctctcagcaacctgacggttccttgtagtgattattattcgactatgcttgtcattgtcgggaaaggctggcttcaagcttgcccagtcctccagactccataagtcgtcaacaacaataaagtatctgcacatgaaaaggaatgcattacatattcatacttaatacttataatattgtgatttttacggtttctgaagagatcctgaaaggcaccttctttgtctgatgttagttaatttatagcacctccagatttcttaacactagcaagataccgatggaaaccaaatctacactaggaattgtgtgatatctcctactagttgctcatggatagtaaaagattctcaaaatatttgacaaagttctgacatcccctaagtgattagaatccaacc

SEQ ID NO: 58459 - DNA, 28994 bp, Oryza sativa
acaccattttgctgctgttctgccaaggcttatgcttaattatatttacctgtatgaatcgttgtcaaaccttatgctggttaacatcgaaggagcacaagggagcaattacagaaccaagttggacaacatcggtgtcaaaattgcaggatcctaaatggaatttcccttttcacgtactggactaatttaaattttttgaagaaaaacattaatccgtttgaatttgtttctcatatataaattccagtatgaccacatcttgtcgacggcaagcactcttacatcgaaacaaatgaatcattcaaacaaccaacaaaaaaaaattacagatcgaacagttccaatccgactcgcacaacaatcgcattcgaatcatcatcgattcaaggtgagaaggccagatcagatcgccgggcgaaggcgccaccaacttctacgcggtgggcttgtagagcttctcgaccatcttcctgaactcgtcctggttaggccagagggcggcggcctgggtgttgaggggggagtcgttgttgggctcgccgaggaggctctggatggagaggaggatggtgcggacgtcgtaggcggaggaccacttgtcctggaggatgtcgaggcagatgttgccgtgggcgtccacgtttgggtggaagcagggggtttcgaacctcaccttgggcggcttgtacgggtactcgccggggaaggcgagagaggcggtaggaggtgccctcgtacgccgtcgcggcggacccggcgatggtgcccacccagctgaagatgttgtccccctccgggaacgcggacacgcccgggtcgccgcccatatcagcgccatcagctccgactgcagccgccgcaccaccgactgcccctccgcccccgccccccgcgcctgctgcttcccggacgcggcgccgtccccgccgccgtggacgcggcggtggcgggaggaggcacgttgccgctgccgtgcgcgccggtgttgttctcgcccctcgccatcctcctccctccttgcctggatcgagagaattcgagatcggtggaggcgcttcgagaagagagagagagagagagagggaggaggaggaggaggcggcgcggtggggagtatataagggattggtttagtgaccgttgctgcagggttgcgtggatggggcagctttccggcgcggcgcggcggcggccccccaacggctagtttccggagaagcggggcgcgttcacacttgggggtggggaggcggaggtgtggggcccacgtgacaggttgcgtacggtgggccgcggcggggggcggcctggtccgcgcattggcccgctcgccagtgagtccgtgataggctgatgggttgatgaaattcatgcggattttacgctctatgtcatttttggtctaaaattattttaaaaattatgaaattcgatattattaggattaattttaggggtttctttattgttttcattgttagagcatcaccttacatagtctcaaaatagatcctaaacccaaaattgagggtttttcttttaaagaaaagatcaaatcgaatagtcgacctggttagatgtccaatgtttggaattcccaactttggttttttttttccgttctccacatatagatttgatagacctccagatactctacctatctttctctattttttatttttttagcgaaacacaatacaaatgaacttgtgtttcgctaaaaaaaataaaaaaaatacaaaaagataggtagagtatagatagatactaccagggtttccaaactgtttttttgggtggttaccgccaccctacggtttggcggttgccgcgagatataccatagttttaaaaactgaaaagataaccgtacacgataacagtggtaaccatacggttaccgcatgtttttttaaaccatgaatactgttgaatggttatcctacttctataaatttcacacaatcgctagaatacgaggtaacagttctataacaaaacttagggttcatctattataaaagaattaaagtcttacatattttttcaacatcaattttttttaccttcgagcaaatttatccatatcagattatttgtgaacgaaagaaaataacatgtagaagaccctattcgaacgaacctgatgaagaagaatattacttcctccttttcacaatgtaagtcattctagcattttccatattcatatctagattcattaacatcgatatgaatgtgagaaatgctagaatggtttacattgtgaaacagagggagtaagtaagaacacgtacacaagaaagtcattatcatatgcttatttgagttttaatctttacaaatttgatgaaaggaagatttatttgatattttaaagtaactttcatttagaaattttttatacaaaacatattagcagtttgaaaaataacaacagagggcgaaagaaatttgaaatcctgaacgactcctactcggctactccgacctcgcggaagtcggtttgacgccaccgtttctactcacccaagccgccaccgcacttcgcacccgaagaagaacaaaccgcctccaaaaatctagggtttccacccgcgcgcgacgcgattcaggtgggcgccgctccctctcccgctcgatccctcctattcctcttcctcctcctcctcccgcgcgcacgattgcacgaatcgctcacgatttccgatccgttcggccgcgtccttgcaggtgtagcagcagcggcagagggtgatggcggcggcggcgccggcggacgcgaaggcggaggcggccaagatggacctcctcgaggacgacgacgagttcgaggagtttgagatcgaccaaggtatgcgcggcccgcggctccctcctatgacctatccctcccccaacctatcgtcgagtcgaatcgccgtggtactgtttgcgttctctagggtgggggaagcgacgccgattcgccgcaggttgcgttcgtggccgagaccttcggtttgggcgagttggtttggttggtcaggagaccgtgcggcctgctatctcgtgcgatctggtggattctattactttttttggggaaaatctgtgctcttttagtttcgcataatgcaatgtatgttctaagttggtttgcttttggtattgttgttttccttatcgagttaattcatgctcgcttgcttgcgacaattgtgacctgtgccttgtgtgctttcgtatctgtaccggtttcttcctctcactggcatatagtgtaaagattcacatattagaatgtagaaatttagaatgataaacccctaagatttttaagtgtaggggcatatgaccgaaaatgtttccattggtgctgcctgttgaggtgaatcataacaattgtgagcagttgatgaaattttgtgttcttttgcaagtccattgaacaataatttgtagtttagtttttagaccaaaattttgtctttaaaccttttcatgataggcatcccaatttatttttgtaattatcctagtccatacctgctcccttcctcctctaggaacacatgatatcttctctctctcttcgaggcaactagtccatgaattgtgatggaggccattacattaccaaggttggttccagtcctgttgccacctgcaaatgggggtggcagtgttggagccagctattgcacccctaccactaccagtacgcttgggcactagcctgcaaagaagctgttctgaaagcacgctctatgttgtcctagcctcttagggtctatagtgatttaacggatagaagattttatcgctttttgtccatggtttatcgagtagagaaaaggagatatgtactcaacatatgaatgagataaggacttctagcttgtgctactattaatggttttatttttaagcgaaatggaaatgtacagactaccttccccttactgggaactgctcttcttgttaccttattatcatggcttttcttccattaaaacccttcttgtgatttgtgcttatgggcctgtttagatccatttggaatggcaaatggcaaaagatttggcatggagttggtgtttagatgcatcctagagttttgccattttagcactagagagagagagcgtggtcccggagcacttcttggcaaaatttgctaccttgggctagcaaatgacaaatgccaaattgccaacttttgctactagtgtttggatccaaaatggcaaaactaaacaggccctatgtatgatttagtggctaccaaacaacgtagaggtttccacttcttttgtcatttatgtgttggattttttatgcacattgtactatatgtggtgtgttttcttctatttaaaatgagcagataacctaatattttgtgacatcacggggttatatgatttggcacaaacttattgtttggtgcttcttccatgtattgagctataacatctcatattgggcaactgtctgtatggttcacagggaaaaaaaaacttctatagttttaggatgtttctattggcttcctctctatatggtggtaatagctactttcttgaagttgagtttagcattttgatttattctttacagtgccttatggtcagcaagttgtgcttcacactttgatttttggcatgcggctgtcacttctgtgttgcaatctgtttcccccattttgtacattcttctgcaagcaatatgcgatcctagggtgaagttgtggatctggtgctacaatgttattatgtaaggcttgcacttacccattcttcctgctttcttatattttgtagaatgggatgacaaggaggatggtgatgaggccatccagcaatgggaggatgattgggatgatgacgacgtcaatgacgacttctcgcttcagctgaggaaggagctggaggaatgcaacacccagaagatctgaactacttttttttcccagttatgtttagctgtagcacctatgctgggtcaggcacttttgtaccctttgtgccccattgctttctcaacctgcaatgttcctactatactcctacttgtgtgctgaaacctgcgatcaaatttaatttgtgaaagggttaaaaccaagttggtggaaaaaatatggttctctattgttggtaacttcgagttcgaaaatcggggctaataagcgttgtccctgttggtcaaatccaggtcgtctgatgcaagatgggattttttttttttggcctgttgtgttgagactgtttgagtcgagaagatgtttcttggtgcaacagttattaccggcaactctaagagctcgtctacctggcatatgtttggttttggtttagggatgaagagctcgtttacctggcatatgttttggttttggtttagggatgaagagctcgtttacctggcatatgtttggtttagggatgaagttatattttttgggatgatcccatatagatgtttgctgctggcatatgtttggttttggtttagggatgaagagcacgtttacctggcatatgtttggtttagggatgaagttatattttttgggatgatcccatataggtatttgctgggcgatgtctaagggggtatttgtccacattcgctgatgtctaagggggtatttgtccacattcgctgcaaaattgagtgggcccttatttgttacaagagtgggccttcaaaattgagtgggccctcatttgttacaagagtgggccttcatttgttacactctagatctgtaccagattatatatgaccctgctgggacctgcgtaagtttatcgattaagacagtgcgctctggggcacaatgcacatgtgatcagaggtgatattttttttgattcacggtatcatgcaatttctgatttttattccacgcaagttgatatgaatagggaggacacgagctatactacaagtatacaaacagtactaaagaacaatggaaaaaaaaaccaatccaagcttgagagtaaacaaacacgcaatcatatccgacattaataatgtatatccgacattaataatgcgcggcattccacactagctagattaatcaaattaagaacaatcatgtatcgatgaactcagaggctatctggtcgatgtcacgctcggcgtaccactacggactaacacatgtcggctagctagtcgtgcccggctatctgtcttgctcgccgccggcgccggcgagcatcccatggtgcaccctgtcgatgaacttggaggccctccgatcgatgtcacgctcagcgtaccattaccgcccgtagtagttgttgtcgtcgtagtgcgccggcgagcatccttcggtgtacctgttgatgaactcggaggccttccggtcgatgtcacgctcggcgtaccactacggactaacacatgccggccagctagccgcggccggctatccgtcttgctcaccgccggtgtcggcgagcatcccgcggtgcaccctgtcgatgaactcagaggccctccggttgatgtcacgctcggcgtaccactaccgtccgtagtagttgtcgtcatcgtagtcgctcggccgcactttcgtcgtcgtcctcccccgttcctgctgctggtggccgtagtacctctgctgctccctctccgccaccgccgccagctagccgtggccggctatccgtcttgctcaccgctggcgtcggtgagcatcccgcggtgcaccctgtcgatgaactcggaggcccggtcgatgtcacgcttggcgtaccactacagccccgtagtagttggcgtcatcgtagtcgcttgaccgtaccttcgtcgtcgttctccctcttcctgctgctggtggtcgtagtacttcctgttgttggtggccgtagtacctctactgctacctctccgctgtcgttgcttctgaacaaaggtattttgaaagcaaacactgacttctctctccccatcacaggcacaactagctcacaaacaagatttgtttggttggttgtgaggggacatggcctatagcctagccaaccacatgcacgcgcgggcatttgtccacattcgttgccattgctcttaaacccaaaggtctttggaagcaaacaccgaacttccctctcccccatcacctctgctgctccctcttcgccgccgccgcctcatccttccttacaccattgctgctaccgttgctcttgaaccaaaggtttttggaagcaaacaccgacttccctctccccatcacaggtatagctagctcaatcttgatcagaaaccagatttgtttggttggttgcgaggcgacacagcgaggccatacgtatttatagcctagctgaccacacgcacgcacgggcatttgtccacattcgctgccattgctcttgaacccaaagtaagcaaacaccgacttccctctctattataggcacattccataagcacattcgctgccgttgctcttgaacccaaaggaagcactccatcataggcacattccataagcacattcgctgccgttgctcttttaacccaaaggaagcaaaactgacttccctctccctatcacaggcgctcatcacaggcacattcgctgccattgctcttaaacccaaaggaagcaaatgctgactttcctctccccatcataggcctcttaaacccaaaggaagcaaaactgatttccctctccctatcacaggcgctcatcacaggcacattcgactcttgaacccaaaggaagcaaacactaacttccctctccccatcgcagacacagttgtttggtgggttgcgaggactcaatcttggttgcgagggaactcaatctttgatgtttggttggttgcgagggaacatggtgagcatcacagacacagttagctcaatcttgataaaaaacaagatttgtttggttggttgcgagggaacacggtgaggccatggcgtatttatagcctagctgaccacatgcacgcgcgggcatttgtccacattcgctgcaaaattaaatagggcccaggcccctactggtgatctctataatcactactacccttttacgaactagagcgtagtgattcgtataatcactactatgcgaagaagtgccaaaaacatcccttcaaaaaaaaaaagaaaaaaaaagacacattcgctgcaaagttaagtgggggctaggccccctactggttatctctatatagttttctaaggtgcttgggaggcatggcggccgttaagtgggggcctaggcccccctactggttatgtctagagatttctaaggtgcttgggaggcatgacagccgttgattactttcaatatgacgatagataagagaatctatcgtcaaaaccaacatggaggtatttaaaaatgtgggccaggtattaacttgaacataaaaatgaaaggttagatagtaatttgtagtagtaccacaatcaatggcgcatgctaataataaaaatctatgtttctcctaattgaatctgctccataatctcatcaagcagtagactaagcaatgctgccatcacagccatggtccgcgcaaatcaactgtcgatgctctagtacgtagttacttatagatgacaaagcacgcaggtgaagaaatacgacatgagaaagacgatgcgaggaagctaacctggcaacgtttgatgggcagaagtaacttgctatcacgatggttgatcatgagttataatgttcagtaaagatatcaataaaatttggttgtgcaccggtggctccacgtacctaagccatggttgatcatgagttataacgttcagtaaaaatataaataaaatgatatcaataaaatttggttgtacaccggtggctccacgtacctaagccatgattatggaggagaataatgtggtcctctcagttagtaattcaattttagatgagaatcagttgtggaggagaataatgtggtccgattagatgagaatcagttggggaacctaagccatgattatggaggagaataatgtggtcctctcagttagtaatataattttagatgagaatcagttggggaagaagatattagtttgatgagaatcagttgatattagtttgctaagtgatgagaatcagttgatattagatagtaatttatatatatatatatatatatatatatatatatatatatatatatatatatatatgtcgcagaattcacaaagttagcgacaaccatagttattaggaccgccggtcctaccggaaaaaatcggaaccaggggctcagccggtccggtccagtttaaaggtccgaccggaaaaaaaccggaactaggggctcagccggtctggtccagtttaaagatcggccatgcaatcaacctgggaaaaaccgattgaaccgctagtccggtctagtttaaagatcagccatgcaatcaacccgggaaaaaccgattgaaccgccggtttttagccagaaccggtgaaaaaccgagcagataaaccgctaaagaccggccacacgtgggtgagaaagtgccagtgcaggctgaaaccatgggggagcgtggggggatggaagaaaataggagaaaaatatgggcagaggggttcgaaacctcccctttagactcaagaaaccccaccactgagctatgcatgcttgtgtgattggactatatatctcagtttatttaaaccgtcttgggccggcggttgaaccaatcaaaccgtgaaccgaggtttcgaccggttcgatgtccggtccggtcctaataactacggcgacaactagcgacagatggctatgtaaagattatgtggagagaaaaaaaacagttaggagagaagtttctccagttgataattgataaaaaaatttaacaattactaaactaccatgtaatgttaatttctatctctataaactaccctttaacagatcaatggtggatgtttaatagcaggggaggtacttaggatacctccaagcactgtaaaagctctcatctctataatcactaagagttacgaaaaaaaatccctttcagaaaaagaaaaaaaaaagagaagaagaagagatacgaaaaagaaaataaaaatcttgtgcagttcgagatattagcgtcgtgtcgccgtctcaccgcgcctcgtaactcgccgccgccctcaccgcgcggctgctctccgaccgatccaccggagccatgagctgcgcggcggtctgggtcccttccccctgctcgccctcccccgtgccgccgcggcaccggcgggggcgatggcggcgggggagcgcctcctcctcgtcgtcctccgccttccgggcctgcgcgggcggggacgcgtccggcgaccgcggccgccgagggcggccggcgcggatggtgctgcacgactcgctcgagggggcgggggtgtcgaccgagcacgcgagggcggcgagggaggggttcgcgaagcaggtcgggaggctgacgcggctggacgccgagaccagcatcgccatcagccgcggcgcggacctcgcccgcgccgcgctctgcgtcgccgccgaggacgactcgctcgtctcccactcctccgtgccgctccccgtcgaggccttcgtctcccgcctcgacgacctctccaccggcttcctcgccgacggctacctcccgcccgccggcgcgccgccccaggtcttcctcgaccacctcgaccgctacctctacgtccacaaggtacaaatcatttcgcacaagcacatattcttcttgaggtcttttagtgtgcttgagaggtaccatgggtacctccctttctagtaaatacgcaccgttgattcaatgataatattttgtaaataaaattataaaaacatgggtagtttagtaatagctcttagccataactgccatctacttttcaggcatccgttgctcacctaaattaaattaacctgcatctccggctcatggatgaaattgatcgttaatttgttcccatttcgagtgagcataaggcatgacaaattgatatgagaatattttctttatctgggaacaatactagaatctgatcgtatagattgaagggaaatacacaattattgattaattacttagtttatcattaattatgcatgatcagtgtattaaatacgttgttcttttctttacaataataaaatacgcatcaaccaacttgtgtttcctataaaacaacaatttagtattgtttgactatactagataatcaactggtatttatcgcccgttacacaatctacatgtgttcaccttttttttttttcttgtgaaagttttaagcattcacacgtttaagtgcacttttcccccacaatcaacggacgtgaaattttggaatgtagtggcacaacatagtatagcatactatcaaaagaaaaaaatacatacaccgtgatttgccttctctcagttatctaatttaatttgataagaggcacacaattacctatttaaccttccacctaatctacaaattaagtacctgtcccacttttttgctacctttcctaacgtacctttgtttgtataccgttagattttaattgatcaatggactagataacttccaagcaccggagaatctctcattcttctttcaatcgtttgacttcaggctcactctgttagttcgattccttgatataaaatcctgaagaatttcttgctgtaccctctaatcgtacagtgaattgatgtgctaaatacgttattatgtgactttcgattcaggggtttcggagaaaaaatggatcgtcagatgggcgggcaatatatcttcactcggtaaagccttactgtaccttgtccgtgttgtatgtgtattctcttctgacttacttgtatgtgattcatctaaatttgtgttgatttgtacggtggccaggttctgacgtgccggttgggatcagctctaatgctctcgttgatatactccgagatactgaagatgctacgattgtatggcttactggaattcaatgtggagattttctttccacatgatctcaacagtctgcctaggggttatgacaaacacaaaagcaagttgggcgatgaaccgcatattatgacatcaaagtcacttttggttgaggtgtgtattttttctatcctcagtacccatgttccatttttaactgtaaatatgttttttgtctgctacatgctatttgtatatctggtagcatttaccaccaattaccaattcataggagcacgccagccatagtggcaatctcaacaactttcctacagcagggaattttcatgttgttctagcttgcttcaggggaaccatttcctcaagtacctttaccagcaaaaagattgtttgcatttatgcatcagattactgaacaagacttgaattggattcctgcttgaaaatttccatatgcaatttcctgtcaattatttttgaacgaatttcctactaatttccataagtacagacatgaatttatggtcatttgtttatacatacaagtacaacacttatgaacaggcctaaaaccttttataattgttctttggttgtctgtataagtcctttcagaaataaagaagggagttttgtagtttatagcttttcaggtggttgccataagtacttccatgggtttgtgcatgctttgtacacggtacacttgtcaattacttcttgtcctccgggaatttgtttctccctgccatgcttgagaccttacagttcagtgtacaccttcttggtcatcaagtagtcctaagtaccggagcataacgattttggaagtgccacctgatccaagcataattcaacatctctgcaagtcaacttgtaattttatctggaactaaaccaaaatatcttggatttggagttgtataggtagatatatactgttgaaggtttcatctgcactttagaatgtagcattaatagtttccttctttttgtcagacatgtcgctcctgctctttatattagttaatgtttttggtctgtgttctgttgaaggtggtgctatgagacttcgaccgttaattttttctgatgagaaaacatttttcgcttactttgacttatccttttcagattttgaaaactctgaagaatacattttggcctttccagtccaaccagtctggtagcttatttttaaatgctgtttctgcaaaccaacatggccctggtaatgtaggtgataatcaaacaacgccacatggcaatataaggtttgttctaaacatgacttgcatagcaaagtattttttgttgttgtcatatattatctggagtgcatgataacagtgacatgcaaccattgacagtaccatagagatggctgctgcaaaagctgctcaacataggttgatgcgtggagtatggactaatgtccggtttggtgatatgcggcgtgctttagcaggtagaacaccttttttctgttttaatagtgaacagttggttattttacatatgatgcactaccatagcatctcctaaatgagaagtttaatgtttcaaccataatctgggagttgtatataacacactgcaagtcattcgcgattttggttacaagtcacctatctattttttggcacctcatccacttcctaaatgtgtgatccttctcctttaaggccgtaataatttgggtaccatataattggtcattgttttgcctaacgttgttttgcactaactctgtgttcctgcaattcctgcaaaatacttgcttggcatttcagcagttcctaaccagagattcgtacctttcatcttcatggcagcatgtgaacgacttatcctactgaaccacgatccccgtgaactgagggattatgccgcccttctctaccactgtgggtactatgaagactgcctgcaatacttggcatcataccaaaccgcagtggtataatacatcttcaaatgcggtacgttcgatcgatcattgttgaaatcacagcacctctaaatgtcgctctatttgtttcactccaaggctgggcagcattggaacaatccgctggagatcatggaggacgaagcggtgaacaccctgagagcgcgggtaagcttgattttagcagaggatggctggagcagccgcagatcacctgccacgagttactggacgaagaactccgagccgtggtagaattagataggacgatgcgttacatgtgtatacggttttactgaaacaacacgagcttgtacatataatttcgatggcattttcgcaatcatttgtactggatgaagtgagctcatgaatcatgatgatgctaccatctcttccctctaatggttataatgctttctaaattcgctccgcaattgtaaatgaattacagaaggtggtaataatcaaactggagtaccaactatgatcaacagatgcaaactggctgccgcatttcgtgcaccaggcccaccgacgtgtttccacgagcccgtacctggttgcaatccatgaaaatttatgcaaacaggaggatttaggttgaatcacacgaatggaaaaacatggacgaaaaaaatagagaaatagaaaaaagatatgattctaatagaaatgtaaatgtaaaatagatgattgcaaaatacaaatgttattttatagaaataaccgtttaattgaataacaggaaaaacacagaaatcgaataaaagagatggactcaaaagaaatttttcaagagattgaagctctagctaagtttcctctaaaatatacagataacgagccattcgatatgaatttatatgatttgaaaaacttcaatctttatatcaaatgaccaaaaaagaaaatttcttataggatttaaatcctacgaaactcagggccctagcatggattgcagcattcagattttgcctgaaaactgtaaaagttcctgagtactttttttttacgcgtgtccgcgtgtgtgcctggagatgaaccgctcctagtattacgggcttgcatttcatgggccatccaacgtaacggcagtcaaagtgtcaaaaccacgtcgtcaccccacttcctccaatcaaactccgccacgtggccacgtctccccgactttccccaccctcccccaacccccgaagcgcgcccccgcggtcaaacaaatttaattaaccgcggcaaacaaattattactactactaattaccccacgacccgcatcttatatatataaaccccaccccctcacccgcacacacacacacacatcgctctgcagtttcaacctcacctcaccacccaagcgtcgctcgatcgatcgtgccatccatggcgccgccgatgatggcgacggcagcaaggcctcgcgacgaccagccgcggcggcggcaggctctgctcctcgccgcctccgccctcctcttcctcctctgcggcggcggcgctcctggcgctggcggcgtcgtcgtggcggtcgcggcgacggcgtcggcgacggcgacgccggggctggtgttccacgtcggcgggccgcgcgggtggcgcgtcccggacgccaacaccagctacacgtggtgggcgatgaacaaccgcttccacgtcggcgactcgctctgtgagtagctttgcttccactcgtctcgccattgccgccgcctgcggacctcgccgctgtctgttgcaggatgtggatgatggattcacggcgagttcttggatccgtgtgcttgcagacttcaggtacggcggcggcgactcggtgctcgtcgtcgaccgggaggcgttcgacggctgcaacgcgacggagccggtggccaggttcgccggcggcgccaccaccgtgccgctcggccgcccgggcttcttctgcttcatcagcggcgcgccggggcactgcgacggcggccagaggctcatcgtgcgcgtcatggtgcacccggcgcctggagccccggcccccgcgccgtcggccgcggcggcggcgacctcgcatcctggcgcctctgcctccggccccggcgcgtcgtccggagccgccgcggttgccgccggcggcgccggcgccgccgtcgccgcggcggcgatgggtgttctcgccggcctcgtcctgctgcttcagtgatcagttcgcttgcaagtagttcattggctaatcttcatttaggctgcttggtttgatgtttatctgtcgttagtaacaacttgattaattagattgtgtccagcatttaagtaggtattattactgcttaatcatgccgtgtaagacaaatataattgtttgcattgtgtattcctttcgctggttgcctctttgatcctctccaagggaagggatacagaggatgcgtgttttagcagtatctaattctaatgttatttgttcaagttggtttgatacattcgtcataaatggatcaatctacgtgatttgaactcacccggagcatgatttgaattttgcaaaaagtttagccaatatgcatggattgttctaaagtaactgtgttggatctaatccactggacggttcagatccacataaaggcagttcatcttctgacctcttcagtcccgatggacttcgttgtcgccctagccaactaaacttctttttgtgtgtgtgaaatagagattttcgatttaacctaaatccaataaaaatctttcaaaaaatagagatcaggccattcgaatgtccaatgtaaacgcgaccaacgtatgaacgtatgatctacgaaggaatgctcctatcagtccagatgcacacaagcatgtgtcttggagtcatcgagttaaaatagaattcggacacaagtcacaagcggcaaccaaaaacaataagcaatatgtgtggctcattcaggcaatttgcaaagttattttgcaaaacgaacgactaaaccattgtattttattgacattatataggcgatatttaactttggcattcgcaaacattgtttgcatgccaataagctacagttcactatttacacagcggtatagttcgaacaaacaattggacaacagatcaacatatgctcagtaactctatagagatgtcagaggtgcaatcaccattttactggcataactatactttaggtgtttatactagtagcatttcgatataatttcatcaaaaaaacttttgggctgctatcttgttttctttctgtaagtatactgggaaaactatcgatttctatcatttatggtgtattgcccctgaatagagaggaatggggcagctatcagaatgagtaatcactaatcagcaacatttgtcgtcatagtctatcttccatcatcccaccctggaaggtttgcggtagcctcgtttaccatctttacaagtgtaacctgcattaagaaaatatataggttatggctaaaaataaaagcatgaaacctgaattctcagagacttttcgcaaacaggataatggtacaatttcacaagcatgatattaacccttgttagtgcaacaccattttagctattcttttttataggaacaacgccagctactgggagtagcatttgtaaattcaagaatatcaactaaaaaatctgagccagaaacccaacttgaccatggaataaatcaaacaaatgtcagcagacaacttagaaaaattaaaaaaatgcatgaagcatctattttctggatattttctatcagaatccgcagaacatcttaaacaactaaaagatatgtacattttgcagttttgctgcggaacatatattgcattcctttggaacacttctcatcttcgcccagtttaataaaggtgaatttcggaagctgcaccagtagcacattttctgtagaccctgggacacattcatttggcatacacagtttttgcagggccttgtatttaattgtcagtgccagacaggatctggtacgaatggggtaaactggggttttgagggtgctgctgagaagttttcttagtatattggatactcatctttgcagtgtttgaattgtatcatgaatttatgtaggagtactaaagttagacatcgattgactctaatgcatagataacttccctaccatattttcctacatcctagattatgtataacattattcaggtaagccatatggccagtccaatagttatcattatgcacttctcctattgttctgttcacacaattattcaggattggcataaataaagtaatgctaacaacaatttgttaggtaaaaggacaattccaagccacatgaacccaccgtacatgaaaaaaacacatggttcatatgtgatatactaatactccttatgtaacaatttactagctgggtactgttgtgctttaaaatttgtgcagtactcagatgtaagcatataagctaagaaatctagctaacaagtagttaatgatcatgttggaaaggaagagagaaaattgggtgatgaacttgacacgggaatcacatagtttagtatttgctgatgatggcaatgtgccagcattgtgtaagcaacttaattatgtattcaaacttccagagtggatgccaccatcaatggactcaaagtggcacttgaaaggaaaaagatggcaaaccactctgacttctaagcccaagcaaaaggacaatttatgccaagaccatcatgcaatcaatcatataaatcaaaattatgccaattacaatatcttacaaataattgggttaaggaggaaattatacagataacaattgagttatataataaaacagtgccagtgaagcattgctctagtgtattaacatggcatctgaattaatttaaatgagaaaaaatatttttctgtctagcaaaaataaaacgttgtgttttgtactagcaagactatattatactaaaaaatacaagacactaataacaccttaacatcttaaaggttacaatatttcttttacgacataatgaaaattttgtattttacaaattaatttgctagtaaacataccacactttctggtactcctggagggggcaatgtaagatttcgtggcggtggcctgtcttggtatgctctcttgtcaaatctccattcaccaatttttccataggttagtacaccctgaaatcatttgccagtgtaatgtcaattacattatgttagcaaaacaaaaacaatagtgacttctttactttatcgcctcagaaattttagcttccgatgaatatttatatctgtagaaaaacatcacagatctgggatttcaataccttgagtgtatagtcacatccgtaagtgaagtggataataaatgtatcccaagtttggtatcaaaaggtggctgcaaatttttactggaccatcaatagcactctcatcatgaaactcaacacaactactctgagtcgggcaagtctgttgtcaagcattgacaaaaaaacataaacaagtagagcacctgaatcatgaaatcttttcgaaggatatgttgaaccccatggagtgcactagcaacagcatatgcatacctagaagtcaagtaaaaacaagaacctggaatcataacaatgtaacaagcaagtaaatgcattatgaaaatatacacaagcgtaattctcacatttccaagacccatccaaaagctttatctgtctcctgatcttctttcatttgaatcgatacattcatccatgtaggggcaatcttctcaagttgtatctaaaagtttcctcagatgataagggatagagttaaaaattgaagctcatcaattcaaaacattaataactagcaactggcatgtaagtaatgtaaaaataaaatccaaggaaatactcctcatgcatgagacttcaaggtataccacgtcaattctgcaatatgtgttaccttcttaatgattacaggggaattcccaatagggtcgatatttgtgacagggcctctttctttaggataatatttcctgagaacactttcatgttctgatggtgtaatgtaaaagaaagggaatgctgctggatcatcgcgggctaaatttggtaaaggtctcacaaatatatgatctggttctgccatcaatatgtatctgccatgtttcaacaaaacagaaaattgaaaacacatcagaacatccacattattttagcacaaataaattaccaacgccaacaatgttcttcatctcaaaacccaacaccaagaaaataattaagctattcacatgttgttaaatcatgcatgttgggattctagatatgcgtccaagtgtccatcagagtaaggttaaatgtcaaaaccacaaataaagtaactcaacgaaatggcagataaattttaactcactcttcttcaatctttgctttctccagccactgtacaaatgcccagggcctatttagtacgacatagccctgcaaacaattcaaaacaaaaaaaaaagtttggtcagttaccaaattgactgatcatgtatgtatactctgcaaagtgatttcggcgcaaatagttgcgtacaaaagtaaaacacgccacaaatcctcataaaacacacacacacaaacacaacaagcaaattcaatgtacaaccgaacagagaatagtacccacatgggaaggcaagaaaaggaggcataagttcagacaagtgggtcagaaaactgaagaaaaccttcagttatgatattattgttctgtgaagtaccattgaaaagtaagccatgactgttcacttctcacgcaatcttcttgccgaaattcacagacactatctatccggaagctgttctcaaatcataatgttgtaaaaaagaacattcggtttgtcattaagagttgcatagaagcggtcattttcatccaaaaaatgaaggggaaaaaaaaacttagtcccgtctaaaattcacaagcacatgtgttcttctgaacacctgctggaccacaatgccactgcccccacattgcgcaacagacaaaactgatgaaacgagagagagagagagaatttggtttgatcgcttgcgtacatggtccttgccggcggggagggggtcgacgacgaaggtggggatctcgcccatgagggcgtcgggcttcccggagtggagcacgcgggtgaagcctcccatgtcggcgccctccggccgcgcctgcatccgcttgtaccagtagtacatcacccggcactgccaccggctgtacgcggcgtcggtcgccgtgagcgccacgtggaacggccgccgccgccccccgcccgccgacccagccgcccgcatccaccccggcatcgccaccaccgggtccctctccctccccgccccggtggccgcgccgccgccaccccggagcacgatggccaggaggttgtaggagatcaggaacgcccccaccgctaccaccaccagcaccgccgccggcagccgcgccgcggcggcggccttccgcgccgccgcgttcatctctctgggaattttgggggtttggattcgaggggcggcgcgtctcctcctccctaacgagggaagcgaataattaacaggagaagaaaaatgggtattacgtgtaataatacattaatactcctcctaattagtaattaatacgcgtggattttaacgagtgagacacgatgcacacacttacaggttacagcgcgggcctaccatgtgtggggccgagttgtcagtgggatttagaagcggggtcgtgagggggtcgccggtgagaatgttggggggatgggagtcaacgggattttgtttgtacctaaccagtggcgtgtggtagcgtttgacgcagctgcgtgctgccaccgtgcaccagttgacttggcccactgagcaatgtcgagtttattattattattttttttttggaggggggagggttggtggtgggggcttcgatttttttagctgccggatgtgttttaagattattttttcaacaaccggatgtgttttaagattagtggtagggagggacaaaatttgttagatgcgtgaaactcataacaagggaacacaagcgcttaacgctaatccgtgcgctagtacgtgtttttaaggtattcatataagttactatatagaagttacattatacgacaagcaagatggataaaggagccaacgagcttctcgatccaatcatatttcctgctacgccacctagcctacatcgacatgccacctctctcctaccttctttttcttcctcctccctccctttgctctcttgccacaaacgaggggaagacaggatcaatgacgagcttgactaggggcccatccgtttgactgagctcgagagaagtggggcaacaacaagcttgattggagcctgacctcttggctaaggtcggataggatttttgagtggccgcaagcagatgaggaactggacatggatcagagctttgtggacatggacatggtgcggatcagccctccatgccatctagatttgtcgatggctgcttgtgatctaggagtctttccttccaaatgccacaagccaagttgcaatgcttcaatgctctcctccacgaggcctttgtcatcgtctcctacccaagctttgctaccacagcgagccggccccgagcttcgctatgacactcctatccaatattcgtcggtgccgctctccacatcaagctcgaggaggtcagctttcattggtaagctcaatcaatggtgaattgtgaagtgacattgattgattctaaatatcggcatgtgtgatagcattccattatgggcaggactttgtaatgggccatggcccccctctagttttctcaaatggataaaaaaaggtccatttggcctccatcaactatatgctgagtttaatttgtgttctttaaccgcaaatctggctatagaagaacctcaactatttaaaccaggttcttcactttaataggatctactagtttctacatgcaaagccttagagcaagtacaatagcaggctacaagttagctataagcataaatggaataaataagagatgagagagaaaaaaacgggctatagttttatagccagctgcaatatggattccaaaatatatgagaggtgggaccatatattaatggtgtattatatatttataactaattattatatcaataagctatttgattgactatagacgatttgaatctattagttggctgtttaataaacttgctcttacgcgtttgggttttggtttaacagcatgcatgtcaacacgtgtagcagttcttctcacaaattgcctttggtttagctttctccaacaaaaaaaaatttgggccgtattgccttcacgtacgtgcgtactcgtgcccgaccggagctagacctacagtggttagcttgtgtgtcgtggttgagtccgactcctgttgctgcgtgcactaaaagccacgacggtaacaaactagaatcgagcgctgggtgctcctggaataaaaacgaagttggcgatcccgtctacaccgaatcgaattgctcggggagtcgtacgtcctcgtgccacagcttgagctcgccgcctaaagcctaccggtgagttgaattgctcgatcgttccggtgcagagggtgatgaatcatcagtcacgccgcggagatacatcgtacgtgttgccctctagcaacgcgcccaggcggctcgagttccgcatccttaagcgcggcctccgcaactagtggcggacgcaggatttcgagaatggagtagaagttaagaaaataaatatcactcaaaaataataataaagtcctatgtaaatatagtgtacattaaattattaaaattacaaaatacttaataaaattaaaattatactcgatcggaacttttttttttgaaaaatgggacattatgtttttacaatgaatatgtagaaaaaaaagttgttttcaaagaatttaactaactaattattcaagtttttttatgtaagttatatttcttatttattttatatagaattagttgcaatattctgggtacaaaatataaaagcccatggacaaatcatcacaataacatttagatggttcaacatattaaactttttcagaaaatttaattctttgaaggctccatagataaaatattcagcaattttaaaggttctataacctaaagtcacatttagcctataaatttcttgttgccttgtagttgtcatggccattggttcgtgccagtgattaagtgcaggatggactatggagggtgaggtattaattggactgaagtactaatttaggtgcagatatattcattttaacccacttttggtatatgtatgaaatataccatatgtatattgttctttttgcaaaaaaaatttgggggtacagctgtaccccatgtccctatacagtgtccgcccctgtccgcaaccacaccggcagggtgagccgccacctgacatgtaggggcggagctagaacaaaataaaagagaatgtcaatggcttaatttactctattttagatcaagtttaagctgatgtgggtgtctcagtttgtattgagagggtgcacaaatgatgaaaatcggtaaggtataactaaaaatttttcttgactgggttcctgggcaccccctccaatactctacctccgcccctgctaacacgtagctgcttcggcgtgcggtcagtcgtccacaaccgctacgtccagaagacgcgctactaccactactgcgagctagtcatgtcaattaggctgtgttcggcagccctttttctcaacccctcttccttgttttccacatgcacacattttgaattgctaaacgatgtattttttgcaaaaagtttctatacgaaagttgcttaaaaaatcaaattaatccatttttttaaaaaaattagctaatacttaattaatcacacgctaatggaccactccgttttccgtgcggagggaatgagttcccatccggtagatgctaacacagcctcacagctggttgaggcagacatgatggggatagaacggtggccggggaaactgttttaaacactcgagtggacgttcacccatcttttgcatgtcaattaaatgattatgtaaaaatttcaaaaaaattgacaagatgtattaatatgtaatatatcacttcacaaatatacaattccaaattcaacttctataagttgtaacaaaaataataaatttaatcgtgaatatttttttagataatggtttttcattaatccagcctctatatccacgagggatatacacagccaaaaggatagaagagtacttagactcacacctcaataaagaggagaaaacacaaccaaaaaaatgaaaaacctacaacctcgacacatccctacatcctgacatcgtcctctcctgaaacggccacaaccgacaagagggagtcgtctagtgccactgcccctagtgtgttatcgttgcgaatctccactaagtgccatcttcatcagcttcaagtgaagtaatgccactcgctgccgggtagcccaccttcatccatcatcatctggtcagaactagatgaccagacactagctgaaagcatttgcttatgcttcgccagattcctaagccccgccgcccatagggccgccgtcgacgtcggaatcctcctccgctcttggactaccagcccaccgccatctctgctggagttagaggactagcctccgtctctgcccaactccgttgtcgcccaccaagtccgtcggtgacaaaggaggggatagaggactcgctccatctccacccagcaacgctgaccaccaagtccgcagcaccgtcgtgataaaggaagggatagggggctagcccccatcatcgcagcccatcgagtcatccagtgatggaggaagggacggaggactagcccctgtcttcacccaacgccgccgctgctaaccacgtccggcattcgctgatcggagcgcccggctgatcggcaacctcctccgctatcacggtgtcaccaccctcggccaaccggcaccataaccaccgttgcaccatcctgccttgccgccgctaccaccttcaacatcaccaccgctatgctgcttaccggagccaggcgagacccaccatgccgcccatctctaggaaggggactgaggaggaagcctcgtcgccaacccagcggacctgcaccctccggtgacctactccggcggtggcaaggttgaaaagcggtgacgatggtgaggatttaccagattggcaacaagccaactgcttgggactggatctgagaagaaaaggtggaaaagggagaagagagaaagggaaaaggtgaaagggggaggaggaaacagggaggaggtgggtggggacagcgccagcaccaccgccgatggtgccgatggtggcgaggggagaagcgccggggtcaggtcatcctcctcccgggtggccccagagagtgacacgggagtcaaggaggcgtgtcaatttttagagtttaatttatcttgtcattttttttgaaatttttgcataatcatttagttgacatgcaaaaatgggtggaggtccacccaagaaattagaatccatcttctggtggccggggtacgtggaggcgaggccattgtgccagagggtcagcgacatctacttggcgctcaatccggcggcacacaaggcgtgcatgctactagagcgctaccggaggatacaagcgcggcgcagggcggcaatggaacgctatcggaggatgcgagtgcaacgcagagttgatgttgtgcagtggcggcgaaaaaagaggttggtgaagcgcgcactcatcttcgtcttgccggccttggagacggccatgcttgggctcaccctcctcaggaacacgctcgtgttggattcgtacaccacatgatggaacttgtgcgcgtgcctctcgtatgttgcatgggtctattgctttcgcttatttgtgtgcatgacaagtaaactttttgtattattgattgttgattgattctagatacagcatcatgcagtaagcatggtcttcttcagagaaatatggaattactacatttcttcggtttgaattcaagctgagattatcagttctcttctcccaaatggaatcgaccaattggctgcacattaaatatcagaatattgacatctatcctcataattattttttaggaaagggcaggagctctgccaatttcaattaagtagggggagaaaacacaatttttacaacatatagcctcaaggctttggggggtcccctggagagaccaattgaggagggagaggggaggaggcacataagttaagaaaatgcaaagcaactaataacaagatgcgctggaaactcatccaagttacttggctgcattgaactccttgcacatgtctatgatggaatcaacaacctaaggcacaatattgtatttcccattaaagattataccattcctttgcatccagatgccccaagccgtgtagatgaaaacgccatcgaagttacgcctttggtcttttatcatttctcttctgcatgtttcccaccaacctagcatatttcctgagaaaaggaaaggggaagggcggaaggcatgtggaggccaagtttgctctatatgctgctccagacttgtcttgcaagggaacaatccatgaggagtggtgggcagtctcaggttctataccacagagggggcaaatctcactcttatcccatccccgaatctggagtttgtctgcagtaaggattttcctgtgtatcaatgtatcatgagctagccgaagaatttgcaaaatcctgttatcctcatattttctaaaatgtaaaaagataatgatactgtacactacacaattatgtcagctatggttcgatctgctatggttctcttattagtagggttgaaagtgattcggaccttttttcggattcggatagtttcggttggacatatatgaaaattttcgaattcagaaatgaattcggatatttttttcagaaataaaaacgaatatgatataggtgatatccgtcgaaaatcggataacgatcggatactatccggtatttttccatcggatatccggaattcttatgcaaaaacatgttttacttttctctacttaggtggaacaaaacaaaccatatgaataagatacaaggaatagcaattaacatacaaacaaatggaaaaattcaattctgaaaaataaccactcaaattttcaaaaactttcaattcaattatgaaaattttaaaaacttttaattcaaaaattgaaaagtttcagttcgaattcaaaactctcaactcagatttaaaaaattcaactcaaattctagaacgtttaattcaattttgaaattctcaactccaattgaaatgttcaacccaaaatttaaaatattcaaccaattttcaaaaatttcaatgtgcctgtgaaaatttcagtggtacacactaatttatttgtttcatggtaacataaatttgtatggaaaataaacacaacattttctatctcccccttgcccttacaaatagagataaaatttgaaaatattaatgtgttgtttttgaaaactaatggctacatctcttcctcgatttaagaagcttactttgaggggtcttgatatttcgataattattcgttaccgtatttgtttcgattcgtatttgctccgtaactatattcaataatattcgattccgttttcatatccgggtttccgattccgatttcgattccaagaaaaaaaatatgaaaatgaatatgatagagctagtttccgaccgtattcgatccgttttcatccctacttattagtggtgtgcatagattctccccatgcattgccaaaaaggcaagaacacacagggttaaagctggaactttgacatggctgtatttggtcaagatacaagacaaaattccataaatattgctgcagtgctatgctgcatcttcatatttcaggaacaagaaaaagagcacacattgatagatagcgcttttgacacattg

SEQ ID NO: 58460 - DNA, 7836 bp, Oryza sativa
ttttttccaacattttaagactacgtcaagctccaagaacagagtcgtaatcgagataattggatgttaagggcagctccagctctagttcgaagccacaattcactgttaacatcgatttgtagaaccgttagccgtctccgttaccgttagccattgacgtgtttaaaaagacatctagtgtggccactagatgtcgcgatgtccacacgcggccacactcagagctttttgcgttcagcgaccctgtcgagtagtcctgatttccgtgtccaacgtttaactgtccgtcttatgtgaatttttttttataattagtatttttattattgttagatgataaaacataattaatactttatgtgtgacttgtctttttaattttttttataatttttttaaataagacgaacggtcaaacgttggacacgaaaatatagagtttgtcttttttttttcttcgaacggagggagtaggtgtcgtgcagcgcgggtacgagggatgctcctcaagctcaagcaacctgtgtacatggatatgacgacgtcgctgggagcgagagagaaaatggattctcgggaatataaagttgatatatgtagcacagtgataatcaacaacaactactcgtatttaaaaacagatgccccttcgtagctgcattctggaattccttgcaaatcaacctgaacatcacctctatgcaggagcttcacaatctgcccagaccaagccggattccgaccaaacacttcgaaatcttctagtacctccgcttctgggggctgttgaatcatcggcagacgtcgtcttcagaaagcagaacccctccggcctccaccgcccggctaatttcaaaatgtctagaagatgcaaacctcaggacggaaaggttaaaatgcgccgacaggattgcagtagaatctggaaagaaattctttcctccttgctgcaccccaatgtaacaaactaatcatatgtattgtttctccctttaatgaaattcaggtgggaaagctcttcccccgataaccagttaaaaaaacaatggtgaagaaatgctctttactctcggtttagaaccctctgtagttcggtttttctatgaattcgggattaaaaatcgctatgtttagttctggttcaaatacccatgactaaatatcgatctttaatcctgattagtaacaccaaccgggagtaaagaggggaatcttttagtcccggttggtgagggtagcgccacgtctctggtcccattcttctctttttttttccatattgatttcacaccaatctcaccaaaatcatcacaattccaaatagagatgctccctacatctccagatcaaagtaacaataacacaaatcataatattcacatcacaacttgtcgaaaagaaacatcacaaattctaaaaaaaaattacatcacaaatacatcatagatcaaataacacagatccaataaatcataaattcttaaaaaaaagaaaaaaaaagaaatccggccgcagcgagctcctgtcgcgccgccgcctcctcctgcttcccgccgcgggccgccgcccccatccggccgccgccaaccataccccgccgccagcctcgctggccaccgctcgctcctcgtcggtagcaactgtgagaggatgaggaatagaaagagaaggatagaggacaagagtgagagagaggatgaataggagatagaaaattttgaggataagagagcaagagattatacacggtatattgatttttggtcctgattgggaacaactactaggactaaagttaggattttagtcccggttaatgttaccaaccgggactaaaaatatctgggacctgacagcctctgacacgaggtgaaccgggactaaagatcatcttaattttactcccggttggtgttactaaccgggactaaagatcacacagtccctttatatttataaactgctttttagtcccggtttttaatggaattgtaactattgtggatttggattgaccgactaaagatggtttctcttactggcgtccaaacacaaacaacaaattaagcttgatacatgcatgttgatgtaaaaagttttgaattggtttcgagtgtccacaaaaaacaaataagatgccccatggatgcctgcctgcaaacttatactgtctgcttggatgatttccttggtgcgatcctgttcttgttgtgatccaattaatttggcagacaccaattttctgcacgcgtacatatatatcgatccattgttactagtcaaagaaacccaaatgcatatgtatacgagtatccaaaatgcacgaaactgaggatagatccatgtctctttcttcttcatccattcttcctccgttttgctagagaagaagaacagctctggcactagtactactactactacgacaaagcctgaatttgttttttggtacgaaaggagtatacacgaaatgcatggcctgctttctgacatctcgtctataaataccctgatgtgcatcctttccctacaccaccacatcgataacattcgatcacattcggctagtaaccaagcagttcttacgctagagctagctcgagcaatggtgaagtgggcagctgtgatggagatgcttctgctgacggcagcagcgacggcggtagcggtggtggcggcgcagtgtgaccctgagcagctatcggcgtgcgtgagcccgatcttctacgggacggcgccatcagagtcgtgctgctccaacctacgcgcacagcagaaggaggggtgcctctgccagtacgcgaaagacccgacgtacgcgtcctacgtcaacaacaccaacgcacgcaagaccatcgccgcctgcggcatccccattcccagctgctaggctcgatctcccgccgccgccggccatgatgcgtacgtggcatatatacgcgtggtgtgtacgtgcgcttgaagaaaagggcgtgagtttgaattaataattatccagtacgcgatgtttgatcgatcgatgatgtgccttttttttttggtatttgaagtttgaactctgaatttcatcttgtgttaattggagtatgatagctgtgtgtacattcgttttggaggtagaggccggtttaattcattatctgttctaggcttgatcgccgcctcccgttggtgcggccatgatacgtgcactagtggagaagtgatctttactgggacatgcaaaaatcatattagtccctgttcaagtaggaacggttcaaaagtccataggttctttttatctttagtcccaccaaaattaaaaaaaaatcgtgaattgctgccttgaaccgtgcgcctcgtccttatctcctcctcccctctcattttctcaccctctccttcccctctcctccccctccccctccccctcccccctcctccgacgacggcgacgccgggcggcggcctcccctccgccagatcctacggaaggggagggcaagcgacagcctggcggaagcggccgcggcggctggtggtggcctccccttcgccagatccgacgagagaggaggctgggaggcggcgcacggttgggcagccggcggcgactgtggctgtggatttattttttagattttgtgaatgattcgtaaatattgttgtagatttttttagatttggtgacgattttgtggatgattttataaatggtttgtggattgtggatgattttgtggatgggcctatgaattgtgaatgattcgttgtgcatgatttgtggggatttagggatgacgacgttggtgcttgaaatcaatatatgactttagtgaactaatgaatgaaaaaaacaatgaaaaaaaaagaaaaaaaaactctagtggactggctagcgttaccatatttattttaaccacatctttagtccctaattggacgttccagtttgcaaaccagaactaaattaaaaaagattgtaaaccgggacttaaagagccctcgccgagcggtgttggcatagatactgtgtgcacttgaataaaacgatgtgggtttggattaataattaacgatcgattataactttattataggtgggtgtccagctaacgaataggaaaaagaagaaaaactcatatcatgagagagattaatgattgtgtgaaaacttaaaaatatgtaagattttttttccaaacggctgtttttagggtatttttccatgtcataaaagaattataactgagaagaattcttacatgcttccaaacttcaatcactactataacaacaaatacccctaaacggctgttgactggaatccagctaaaatggagagagaaaaatcctacttcaaaactcagaaattttacatggatttcaattcctgtgaaattacttcattctaaaaacgacctcatgccctaagagcgaagtcctgagatagatcaatcactatttcattactccctcagtttcagattatagtcgttttgactttgatgaaagtcaaattactccaaatatttgactaattttatagataaatatattaatttttacagcaacaaattagttttattttaacatattttcataatatatttgtcttggattgaaaatgttacaatttttttacaaatttgaagcagtttattttgatcaaaattaaaacgacttataatttaaaacaaagatagtactatagatttgattttttggaggagactctcggtaagttacggacagatataaattctctcgcctgcaacaatcgctctctaagggaccatttaaggagccacattaatgctagtagtaatagatgattcgacccaatattttgaccacaaagcaacaggccaaacataagaatgataacttgacaagcttgagttttttcaagtgaaaacacttactcctctatttaaaataagttaacttttagctataaatttgtagctataaagttagttttaattgggacggaggatgtacgcgagatgttgatgatgtgtattgttatgtccaaacgccttcagttcttttctgtagagcattgagagtgcaatgaaggccaaacagattaccacaagattgatgagtgatgacccatttattggtgctcatctgcccgaatttatttgctagtactacatccgctgtttccgttcaacgttcgggcttggtattgaaagctgcagtgcaaaatgtccgaaacggcacgcacaagtggaagtggtagctgccactatcaaattctactaaaggctgagtttagttttaaatttttttttcaaacttccaattttttcatcatatcagaactttcctatacacaaactttcaacttcaaccaaacttctaattttggcgtgaactaaacatatccaaaataggacggtactgcagggtacagatactgattcgtcctaatctgatcctaggtcgctatatagtgaaacgaaaggggtattttataacggtcaccagcctaccaccttataactactcacaacagaatactagttttctagtgatatagtataataactcatataaatcaactgttaaaatcatctttaatgaatgataatgttgataatactgagagcatcgtcgtaaagttaccataaaagtgtttttacggttcgtaccgtggtaacagagcagaagtgtaagttacttcctccgttttatattataagactttttagcattgtccacattcatatatatgttaataaatctagatatatatgtgtgcttagattcattaacatctatataaatgtggataatgctagaaagtcttataatctaaaatagaggtagtaaacattatagggcctatttggagagcttctagctgctgcaccttttcatagaattataaactctcccaaactctagtttctttatcaagattctaaagttgtagaattcaaaaaataaactaaaagctagatgctgggaaactcatagttccgatttccgatcttgtgggagcgtgaaatgctactacttcagagttcactattctgagatgatttatggtgtcaagtttgcgatatctcaactcaacaaaatcgtccaaaaatttcgcattgttggacatgttggttatgaaaacagcaccttcaatcgataacaacagatacttcggttgtgttcttttggagggtaaccctcccctcaacaaacggagcaacaaattcacacataattaattatgtgttatttaaaaactttgaaaaataaattaatatgatatttcacgtctacttttctatatatatagggggtgtttagattcaggggtgtaaagttttaacgtgtcacatcgggtattatatatggtgccgcatggggtgttcgagcactaataaaaaaataattacagaatccgtcagtaaaccatgagacgaatttattaagcccaattaatccgttattatcaaatatttactgtagcaccatattatcaaatcatggagcaagtaggcttaaaagattcgtctcgcaaattagtcgcaatctgtgcaattagttattttttagcctatatttaatacttcatgtaggtgttcaaacgttcgatatgacatggtgaaaaattttagggtgggacctaaacagggccatatttcttaaaagcacactatttagtattttggaaagcgtgcgtgcgaaaaacgagaaagtgaagattggaaaccttaagttaagaaaggggttctgaatatttttgccccttccatagataaaaaagaataagagtttcatatttaatattcctatttaatttttttaataatggattaaaccccggaataattaactatatgctactattacgagtggtgctaaattatttaccactggatctacatgttatggacacatgaggactcacatgtcatatacagcctctacatcccgtaggatgtacgtagccccaaagagacatagtctgagcatttaagcttgcaatacaggttacaaacaacatagatacttcctccgtttcataatgtaagtcattctagtatttctcacattcatattgatgttaatgaatctagacaaatatgaatgtgagaaatgctagaatgacttacattatgaaatggagggagtagaatacaaaatacaaatcaactgtctgtgattgaaatacgagtgtaattttgtgttacccataattaccagtgaaataaatttcccttggtagacaaaccgtttgttgggtgatggatgttacctagcatatggaaatattgaagagtgctaagctaggatccaaaatcaattcatgaaatagtagagcaatgaacattggcaacgaagcaaactagaatcaaacaccgcagatgtaaaaatcatcaacaaaaactccaatccaaattcaactggccataactgcttccatgccttgcattggtcgagagacgagaggatatgtccccagtggcaattgatgttgttgctgttgtcgccttggaccatatccctctcctctgatctctcctctgcagccagccagaacgtacggtgtctccggccgtcgtcacagattaggaaggggagatgcaggcggcggcggcggcggcacggacggcgagagggcaaggcgagactcctgggcagtttttttccctggtagtaatgggccttttccgacggattgtaatccgatcacagcccatccaaacgcacattttcagcccaaatggaaaaaattacggggcggtattatacacctgttttaggcccagaatcagtcataagttgggcatagaccgtgtcgacatggaatccagctaaaatggatgaaaaaatgta

SEQ ID NO: 58461 - DNA, 6320 bp, Oryza sativa
ggtttatgtggttggttgccttgtccatggcaggttcattacatgcggtgatgaagttaatatacatcaggtacctaacaggtccattgctttatttgtctgcaaagttcagaggagtctagttgccaggtcggagcgcagctagaggatcctaggtaatctcctgacgcaggcacaattatgctctgatttcttccccaaacttcatccgcatatctgtgaatggaacaattttcttttgttgtcttttagctagaaatttttctttgattaggggggagattgagaaaaatggtaagattgaaacacattattgaggtatgaatctgattacagtaggtactaggcaagattttcaccgggcaggtactaggcagaatattgattattacaataggtactaagcaagaaaatttatgtctcttcaatttggatttttctctcttctcccttctagtctgcgtccctactagatctgatcatctatgttgcagcacaacagaagtggagaacaatctgatttgtacaacaagaaggctgaagcgatgccatcgtcagcccttataaacaacaaagctaaagttcagtttgcagaccttcctgaggtatgtttaccaaagaggaacattcttcagatttctgtttgcaaaaagttatcttatctaaaataacttttatcatgtccctcttgtgcagaatttgatgtgattaagtctcagaaatgccacagaaggatgttgtgagaactgatttattgtcaagttaatggaggtgcatgcatgtggacttgttgcacgaaactttgacttgatggtgttatggtgtctagcgataatattaatgcagtcttgcagcagcactctagtttggtcgaagagtttgaggtgaagtttgaagttgacagcaagctagttgatcactcaatggtttggtcgattttgctgtatcatcacaggccaataaagttgcttttgatttagagcagaggccttccttttttttttctcggatggattctcctgtgtttataaacggcattgccgtggagtaaaatatttactcagacagtaatattgtatcatgctgtgtatgctgattgtaaaaaaattactattctcatattgtcgtctagtggaacattcactacgcgttaataattgattgtgaaaataattactaatgggtggatacatatgactgagcatgcaaaaacacttggcagaaaaaatattactaagacatcgaattagtgagaagtaaagatcattactagtctgtaacatcattattaatgggaatatttagctgccagtaacatcgttactaatagtagctaactaatcgtaaaatttttactcactaccttaaaaaaatgtttcccatacaaatgactttagtaaatgatttactgataagtctacctgtcaaacaaaaggtgcggacggataaactatctaatttcaatatatagtaaatagtttactctatcatgaactatgccaaaaaacggaggtagtatatgttatgtctagattaattaacatctatattaatatggacaatgctagaaagtcttataatatgaaatggaggaagtagtatatactagccagaaatttcaagaaaacagtatatactgttccaaggaataagtagcatatacttgtaacaaaacagtatatactgttccaataaacagtatatacttatatatagtgcaggatgaatgagattccatggccgatggagagtgacataattggctcattcacatgcataattgtatttattatttagatgtaatgtttggtcatgtattttttatggattggacgtgacattgatgaacttgttattgtttaataaatgcaattttgcttgctaattacaaaagtatgccacgtatgttcggaataaacaaatactattcaatatcttttcatggttgaacaactttcaaaaatcagtcttttgggaaaaagacttctggtaaagtcgtacaattttatattaacataacaaaaattgattttactaaaaagaggttagtaatcatttaactaaacagaattctgaatttgttgtgcgggatggttaccaccaaaagtggacgtggggttgagggggtgggtggtgggggagtggggtagggtgggggtgtatctatgaggatagcgttttagttataacacactgggtgtggtttagcgcatccgcatatatatatatatatatatatatatatatatatatatataacacacacggtggcgctacaggcgctgcgcgccacgaatctaaatggcgcgactaacagcgatcagcccctgccgtgttttcggttttcttggccccatccgatcccctcccaccagccgagtaaaaaaattactttcctttctccagttccgcatgcatcccttcctgagtaaaaaagaaaaaaaatacttgtttgcttcagcgaaaaaattactttcctttgcatccatcacccagattcgtgagtaaaaaaattgtactgggagagtaattgttttactggtgggtaccttgactcgtgagtctgatcgcaggagcttctcctggacttttagttttttctccccattgaacgcaattttatctaataactaagattcgtccacgtcatcactagttaaaatttaacttgcaaatttacttaggagtaaaaattttactgggagtaaaatttcacgagttaaaattttactgggagttaaattttaactcgtgatgacgtggacaaatatcagtcgttggatttattttggagggccgagattcaccctatgtaaccgcgtgacatgccaacatctgaatccattcatctctcgtccatcatttagttatttttctactggcaaatttccaatagtaaatattttacttcacaaattacatataatttttttttactctgccaatatactgatatgtgtattgcaatttggttgcaagatatctagatgcatttaatcatacagggaatcacatgtattagaagctaattacacacacataatacaataacaataatcaaagtcacaggacaatgtccaaccaaaatcaggcaaaataattgatgggcgttgctgtcgaccctagcagctttctagtccttctagatccgttgaataggaccgagctgccgatggagagaacaccggcgacagtggtgctcctcactaggtcaccgcctccaccggatcagcatcagatcccatcggcaagagagaggagattcggtgccgcccatgattccgcccctgcatctcaccgtccagtgaagggctcagaagaagacgacaaccacttcgtggatcttggtcatcgtgatggagaatcctgccggaactcgtcgccgccgtcgagccctcgcaagcgagcaggcagatgtgtggcgttgagaaggagacggttgtcgctttctcccgtcgctaatcgccatcaccatcatcggtaatctcctctccgttgaggtttgctctagatccggaaaaaacgggatgaggaagagaggaatggctggatacggtgagatggctggctatcaacggtataaatactcatgcgttagccatgcagtagtcaaaaaataactcatgagacatcgtatgtgttgtagtggagttaccaatacgtggcggtgtgggggtgggactgttgacgtgtattagtcaaaaaatgactaacgtaatcaccgtgcgtggcaacgggaggggagtgaggggggtgggcagcaggtggacatattaaactgtgtcaggtgccgtttaatacatggcaccttaaggtgccatatagtagttctatatatatatatatagactgatatttttttcttctctgaggttgtcttataattagttctagtattctactcatgagaaaagaaaactttcacaaaatcaagctttaatatattttttgaatacttacactggatgaaaatcatatgtgcattacagtggatgttgatctatatgtaaatatatgtgtttgaactactgccctgtgattgaacttactgcattttgttattaaacacctcactctgagtttatttgtagaattttccaatctaaacttagatatctcttgctctaattagcgaagatagttttagttgtaattctgttagtttgctgtaaaatacaccatgaggcaactttaaactgtgggaagaccaagaagtacgtaatacattttcttttgataaggaacgttcagtgactcaattttaaccaggattttattttgcttatggaaaaatgtgttctatcaaaccgattgttggtgtgacctatattcgttatatgtaggggatgcaattgttaccaatgggcatctgctagaaagaaaaacatcgtgtaaactctgtggcgttgcactccaagtgtttgtggttttgccttatgtagtagttattttgctttgcgatatggtgcttgcaggggctgatcactggaggtgtgattttgtttgccagttgagggaggaattcacacgcttctgttcactgaggacatcttctcaacctattgcttccaccgatcatctttaatgatagattagctttctgtgtacctgtatttcatgtggttagctctcaaccaaagtggagtttactttttgtacttctatactgtaataagaagtgccttgtattattttaatttggttttgtgtaatttaatcttgagaacaaaatgtgttgcaataggactcacttgagagattcatatggttcagaagtatacatatgattgtattattttcgccgttttatataaaatgttttctatatctctgaatttatcaaacccacctttttaagactttctcaaacgcatgtgatttctgaatatgaaggtacacttattgaactggatgtatgaaatagataactgcccatctattcctctgaaattatactgaaaaatgaattaaataatcatgcatgccatgtcccaaacaaaggactcttcccctgaattgcggtcttaaaagtattgcatcacagcaatacacggaacccttttacaattagaggacatccatgagtggaaattatttacttttaaaatgcgtgtgaatcatttagattatttttcttgactatgcaaatataaactttatagagaattatcacctttttactctgccctatttcaaacctaggaaattgcatgcgtttctgcagtaactgaattgcttaatgtatatttcttttgattagttaataacagtataagggtgcataatttatatttctgtgcaaacactgttagaagagtttgtgcatgcgataatagcatatattgataggagatagaatcggtttctattttctttcttatttcacaagatgtattctatctctaattgtcccagtttgtacacgccacgatgagggcttttctcatctatattaacacgtaacgcggcctcgagagaggtagaacgcttctgccaaattacatggtatcagagcctcgctagccacgcacgagattgcatctacggcgatggcgagttcctcctctagcggcgcgaatcctctctcagggcaacccgtcccagagaaacttaccaggaataatttcctgctatggaagactcagattcttcctgctatccgtggcgcacgcatggaaggatacatcaccggcgcaaagcaagccccagctgcagaaattgacgccaaggaaggtgacaaggtcgtcaaggtgacgaacccggcctacgaaacatgggtcgctgaagatcaacaagtgcttgggtatatcctggcattggtatcaaaagaaattctcacgcaggttgtcaatacagagacagccgctgaagcttggagagcgatcacgacgatgctctcgtctcagtctcgcgcgcgtgctctcaatacgcgcctggcactgtgtttatggaaaacacgaggcctgggagatctgcttaactccagtgcaggtccaaaactcgccttcggatgtacgagcgtgccagttgatttgatcctataattaacaagaaacaaagacaaagaaaccatgattaaatccataaatgatagccgatcggctagatgccgatgacatatcatttatctttgagccgatgtcatatgtgaatcgatcggcaattattaaggaaacaagacggaactaaatctgctcgatcggctgtagatatcaatgatatataatccttatatcgacatatacttaaatcaagtgattgggatagatcggtcaccttgccgagacaatataaatcacttagattgaaatatatattaa

SEQ ID NO: 58462 - DNA, 6883 bp, Oryza sativa
gatctagtatgtatgggctaaaactccgatactactttatattaagatattaaagcaaataaaatatactaaacagagatctaatatacttaaatgccacaagatcttaacatgaagggcagatctaacatattaattgagcatatagagcaagagcaactagatcagataagatcggctgaaactccgatactaccctaatcggcaaccagtaggcaggctagagattgaaattctaaacacgacttaatagatcgaactcaactgatacagcattaagtatgaaaagaaggacaatatctagacaatcaagccgctggatgtttcatagggtggtggatatctcatataatctaagccaacatcattatttaacctaatcggctgtcttctggtagcagatgttagctgattgtaggttagatgacgatattgtcaaagattatgcaagatatatgataacttgacggattacataaacaagattagagtatcataaagatgtaagcactaatcttgagaacacaagccgtcataacaagttttacctcttgttgaagatcgaaaccgatgcagctcaacccgaaagcaagaactcgttgaaataaaactaaagcaaaaagggtggcgatgcgccgaaattgtattgaacgtgtgtgttcctcattacatagggctcggggactatttatacccgagaattacaagatatgtccatattggacacgactcttatctctaacaaactctaagataccataagtctttgcggcagacttttgcccacatttatttctaaggaatttacataaaatatcctaattaatagatacaattgccttcccaggactctatccttgtgtggcaatcatcttgaagcacatcaactcaaacccaatgtcgcacacgggtcgtattgtcggaatcggctgtatcacttaaccagtccaactcagacttagccgatcccagtcgtagccgattcggactccagccgatccttactctgtttccgcaacaatcctcatcttcgattccgcttcgatcccatctttatctccgatactgatattaccaaatttggtcgttaacacatgccccccaagtccgggatatttggtaatgttccggatttgccgtgtatcgactccgagcaagtttcgcaatcggccgtttccgattgttaccctagcgcttcaaatactaaccgttatccccgagaaatctcacaccgtgacttccgtcttcaccgcttaagcgaaactttaccctctttctctccggcgattccttcgacgcaccaggcgatttcaagacgattccgtccccagccagatctccacccgcggtaatgtcaacttccaccaatctatccgccgcgccatcggccgaatacgcagaggtaagcacccatcagttagatcccttttttccgcagcagattgattttctttcgccttatcttgttttcttctcttccatccctacctgcatctgtagcatctgtccaacctggttgcgtttctgagtctgtcgcatgagaaccattactttctcggcccaatcggcaaccttgaccctactgattttatcactggtgaaaccaacagaattccctttagattagccaaccctaatctgaatcattggaagaataccttcaagtcttggccatctcttgagaaaactgcccctgagaagggttggaccacatggtacaagcgtgtatcggcgaataaagcagcacactgggatgagatcagaatcagcccagcgcttgcccttaccatagctaattctgctaaggacgaacctctaatggctgccgccacctatttctagtccaacgccatcaatgccttcttattcaaccaagggccgatgaccccaactctcatagacatcattatgatcacgggtttggatgtcacctcatcggccaaccctatgagcctgaacacgaagaatcaatatgacttcaagaccaagagcataggcggttggtcaggctatgtagcagcatacatgggtaaagggcccgtcactcctcgagagcatgtagcctttctgctgatgtggctagaaaaattccttttttgtggatcaagctgtagccctactaccaattggcaatttgtagccgaagccctagaatcaaagaaacaatttctcttgggcaaaatcctcctcggctatctatatcaaatgttgaataatgcatcggccaagatagccgtcaactcagtagttggggcaggtggaccatggtggttgttgcaaacctggctaaacttggtagttatgaaagtcgtcaatcggccatctgtgacagaagctgaatttccaagattagagccgattacagaagatgacgaagaacgcactcatcgccgatgtatgtcatatggagaatacgcatccacaccgactgatgctggagcaaagttatcagccgaactgctcaaagattggttctgcagtctctacgaaggctttcaaaaagatgctcaagtttggtttccctatgaagattcagcagaccttgaactcccatcagattttagatttgaagacattaatcatgaaagatttcaaacatccagagaaatcttcacagctgcaatcagcccatgtattcttccagtcggcatccatcaaggaagaaatattcaagcctcttacgagttctatcacccagtgagttcagctagacagcttggaatgggccaactcccaatcggcttattctttgctgacaagatccaatgccgaggagaaatttcatcaaccttgatgatggatcggctgctcaaccttccaggaccccctctgggcagcattgaaaatctggagctagcaatgttcaggagcaaaaactttgatagatggtggggtgaatggaagttgcatctattccaccaaccagcttcaatgtacatgatagacctctttccagatgttgtccctcaagtaagtctctgacttaacttgatttcatttgaacaacttcctagccgatttatcttaactaatcttttctttgatttgtagacaacagaatcctctcctcctcgtcaaagcaacagtggcaaggatatcacctacgccccaggcttaattcctaatggaggtgggccatctcaccctgtcatcggctatgatgcccccaatactttagctcttctccaagggcttatcagagaaccagccgatgccggtaggaaatggaaaaccagatcatcgactgtagatacttcagccccagctccaaagaagaaaatcaaaaagaaagctaaaccagctgatgatctgcctgccctagatccatccattgaacaagctctggatgaagaagaaatcggagaagacgttgatcaagccgcaaccgaagtaagcgatactgaaagaacaccatcggcttcacctaagcagacccctccaactccttctgctccaactccctttacaagagtaagcacccttctttaaccatttttgtaatcgtctcactttatggccgattgctcacattcttggtaattgcagaaaaggaaggctgctgtgaagaagaaatcgactccaatgacatctaaaccagctccaccggtacaataatcttacttctttcattaattaatttcagctgattttatataacatttgtctattttcagcctccttcccctcctattcaacaagcatcaagcgatcgaaccccatcagctgtagggagtcatcacatagaagaagaagttcaaccaattgctccgactattccagtaaatttcttataactaacatatgcagatcggctatgcctgtttaatctctaaccctcttaaatcattactgtaggtcttagccgatcttttttcttttgatatcagagattatcttgatgaggagacagaggttgacactactagcaaagctctagctcctttgtctgacgacgtgaagaaaactcttgaaaatatttctcatcggctagagacatcatcactagacagcctagtagtcaactgtggatcaatcaggactcggcttcatgaagtccaggctcaaatccccgatgagttagctgatattcttactccagctgtttatcttgaacaacatcaatataagctggaaaaggccaagctgagattagccgaacgcagagagcgcaaagacattgaagcaacaatccaggcaaatcggcaacttgttcataaagaaaaaaccagactcgatcaattatctgaaggcccgatcaaatccaatattgaccggcttgaagctcataagattgaactcttagcacaactttaagaatgcaatgccgaactggatttagagcacaagaagttagccgatctcccacaatctatcgaagaacaaagagcaaagttaaaatcggctatcaagaacgttgctgatatgaccaaatctctgaaggtcattcctggaaccgatgctcaagacgcccaagccatagaagaagtagaacaaattagacagagagctatatcggctatccagcgatacttatctcaataatcttaatatgtgatatcactttgcttaaaaatgcttaaaaattttgcactgtatatatgcccccctagttttacaatgtcaaaagcattgataaaaatatgaaacaactaagggcgatataacaatattggccattgtacatcggcaaacctcaaccgattacaacaaaacaactaagggcgatataacaatatcagccatctcaaggcgatgcaaacgcaccggctatcatgtatcggtaatactagccgatcatgcgttaacccaaacacttgggtgatatttcttcaaatacttgccattaagcgctcgcccaaaaacttctccatcaagtccttgcaacatgtatgctcctttagacacaaatttatggatttggaatggtccttcccaattcggcgaccacttgccgaatttactatcacgagtaccaatcggcaaaatcaatttccatacaagttctccttccgaaaaatctttaggtaccactttcttattataatgccgagcaacacgttccttatccctagtaactttagcaagtgctcgtaatcgcgactgaaccaagtcctcccgttcatcggccataagattatagtactcgtcggctattaaatcactttgcaactctgttcttcgtgagccgattcgaacttcccatggtaaaacagcttcatgtccataaacaagcttataaggaggaacttggattgatccatgataagccatccgataagaccacaatgcttcggctaaacgggtatgccacttccgaggataatcagaaattttccttttaatcaacctgatcaaactcttgttagatgcctcggcttgcccattagcttgtgcataatacggtgaagaattcaataatttgatacccatactatcggcaaattgaacaaactcatgagacacaaagattgaaccttgatcagttgtaatagtctgaggaataccaaatcggtagattatatgttcttagacaaactgtattgcatctccagaattagccttcttcaaaggaatcgcctctacccatttggtgaaataatcagttgccactaatataaacttatgtcctttactcgatggtggattaatcatgccgatcatatcaattccccatcctctgaatggccacggtttaatgataggattcatagccgacgctggcgctctctgaattgcactaaatttctgataatcttgacaacccttgtaatatctgaaacaatcttccaacattgtcggccaaaaatatcccgtacgccgaagtaaccacttcatcttatgagccgattgatgagtaccacaaattccctcatgaacttcgccgattgcaactttagcctgatcagtgctcaaacacttaagtaatactccatcaatcgttcgataataaagctcatcatccaataaagcatacttcaacgccttatatcttaacttcctagaagccgactgagatggatttcgtaaatattgatgcacatcatatctccaatcatcggccgttatggcagcaacttcaacctgaacatctttgatcatcggcttatatcccgatgccccttgagctaaatcattggcctcaacattctgctctcgagacacatgcttcaaagtcactagccgaaacgttttcatcagtccttggcacttctcattataaaccatcaacgtatcattcttgcactcatattctcctgccaactgactgataactaacaaagaatctcccataatttcaatagcatcgacttcaacctccttgagcaattgcaaccctttaagaactgcctcattctcagcttgtgtcgcgaccgagaaaatttgcattttcacgaacgctagtgtattaatccccgtcctatgaaaagccggggtacaccacacaaacatgatacaaacgacacatctttattatatcgataatatttacattattacaaaggcacttcaagcctgacaataaaaaataaacagcagcggactagttggcctacggctccatcttcataggcgctcaactggggtataagccaggactccacctaagacttcttctccaaagcttctcttactgaagggggggggggaatatagagcaagaatgagtacaaccacagtactcagcaagtcacaccgggagatgcatgattaatgcaaaggaaacaaggggtaataatataggggattaggttttgcaggacagcatttaaaagacacttagttgcccaaagctattttataaagacgattctagagatacacagtattattaatcaaggccgtggacccacacgaacctgccttaacccaaggcctacgatga

SEQ ID NO: 58463 - DNA, 9754 bp, Oryza sativa
  unsure (1)..(9754): unsure at all n locations
ccagccgtgcaggcggaaacaccggtcgacggcggcaaaggcaggccgacggtgaagacgtagacgccctacatcggcggcataataggccagccgtgcaagcgaggacaccagtcagcggtagacgaggcggccggcggtgaagacgtaggcgcccaacaacggcttcataagccgtgcagacgaggacaccagtcagcggcgaacgaggcggtcgacggtgaaagcgaagatgcccaccaacggcggcataaaagaccagccgtgcaggcggaaacaccggtcggcggcggcaaaggcagtgtaacgtcccgccttcccccaggccgggcccgcttatatctgatagctttcataggtcatataacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagcggtgcaggcggaaacaccggtcggcggcggcaaaggcaggccggcggtgaaaacgtagacgcccaacaacggcggcataataggccagcggtgcaggcggaaacaccgtcggcggcggcaaaggcaggccggcggtgaagacgtagacgcccaacaacgacggcataataggcctgccgtgcaggcgaggacaccagtcggcggcagacggaggcaggccggcggtgaagacgtagacgcccaacaacggcgacataataggccaatcgtgtaagcgaggctgatttgcatgtagattcgtctctctgattttgttgacatgatgggcttggtgcagccaaccggccttagaggtgttgtgtgtggcatgagcgaacgctgcatcatcaacatcagtagtcgagccacgcactatgtcctggcgtacccctctcggcaacatggttacagtaggaagcattgcaccgacggccatacatgcaataaaaaatcatgagaagattaatatgcgttagtaattaatctaaatatataaattacaaggaggtcaggaaccgcagcactgccaaatcccatcactcgttaatgaacgattttttgatctcaattgccatcctgggcatgcgaccaaccatgcatcgctccagtatacatgcaaaataaacaaatataatttgattagccttaaaatattacatgcttaactgtgtaatacatatatcaagctagggtttgatattaagccgtgcatatcagttgatctgcatgtgaagcactcaattgctgttgatcccatggacatgaattgttcccgtgtcgtatgaaggttacgccggtacctatacagatcgtactgggcgacgagaagacacaccgggacttcgtcttgatctcagccggtgcgtgaaaacaagaaaaagaaaggtaataggagattagtctgcagttagagaacaatctaactagtgaaacgacaaagccaatgacattggagattgaatcgatgaaatcaccgagattgatcccttcggctggattgaatccgagatgaaaaagacatgcttgatgaatctggtgatgtcgcacattggttccatcacactcgtgacaggaaactcgatgctcccttacctgacgcgccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatctgccgggtgtagtatagatctgacgatcatacgtgctcatgccccctagagggcctcctgcccaccttatataggatggagggcaggattacaagatagaaaccttaaccaatacggtatcggtttcctaaatctactttacaatcttatcgaaccaggactttaggccgttccgtaatatacaaggaaacgtaatacccaagtcatgatctattacatatttcatagatatatgagttatcccctataactagtcggataaacatgccgtgtgagtatggggtacccataatctacacaggaactttttgtgctggaagtctggaacttggtactgttgaggatttccactggtgatgctagataatgtttcattctgtaagggtttggaacttttgttcttcttcgcagcaatggtttggaacactaatgtaatgcttgtgcactttggcttgtgatttggtgctgctccaaattttcttgcagcacaaataattttggagatattttcttgtactacgatattttctatgtacttctgaatcggaatcacattggtaacttcgatctttaataattttggagtttcaggaagcagaaagaagcctagtgttccggtaatgggctgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaatcgaatcgtttttcatattgcttttaattttctcttagtttgtccatctttgtcgatttgcaccgaaaattgtccaccgccgctgcgagagtgcgacacccctttgttggtttatcctgaaaaccttccgttttgcccacgagacgggtagttatctagaaatcggctccgctagccggtttagttatcaaaacccatcttggtctagcttttggctagatcgaggtggttggcaactccaaatcaccgcaaggcgtttaggtgctgcgatcgtgcttgtcgacttttcacaaaaagttgccaacacgaattttggcgactccgctggggaaatccgttcaacgccatctcaacttcgacatcgccatgacgaagcctccatcaaccaaggcggaggtggatccatccaatgtgctgccggtgatgatggagagtcttgatgaggaagcacgcatggccttcgatgaacacatgaagaagtatgccgacgagcttttaaagacatgctcaaagacccgtcatggcgtagtcttcaagccggatttggtgtcttcatctacttttgacaaggtaagtattgaggaattatcacaatctcttcaacaacaagttgctcatacaatagatgcatctatggttgctttcaataacaaattagaagcatcttttgaaaataattgtgaaaagtttatgagaaataaactcggccctctcgtggccgattttgtaatcaaagataaagcctctaccagtgctagccaagctcctatagatcaaataaatagtaaaaccgatggagcgaagacacaacaaatcggcgagggctttccggcgcaaactgctgatcagaccgggccagataaagccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggcctgataatatagagcacttgattagtggaattattagggataaattcaggattgaagctaggaatcgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatctgttagaccatatgagaaaaagcctaatgttaattcaattgattactttgaggctagtgatagtgatgatgagggtgatcatgacatatatgttgctgagtggacatggactaacaaaaataagccttttgtttgctctaatttaatgccgactcctcgtaaagatcggcaaagtgagattaagtataggtttgatgtggccaaatgtgataagatttttgattatcttttgcaagaaaaacaaattagattacctaaaggccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatctagcgttatctctgatctcgccgggcacgagttcgaggaggaagactaccctgttgtcgactacgagttagcacttcagactgccaagtcgacaacagatagataggctaccacaaatattgtactggtgtgattatggtgaataagagcaacgatcggcttcggccaacaggatgtagggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttcggaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatctcaaaggtcatgttgatgggaagccagtctctaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatggaatatccaatgcttatcggggagggatctttctactatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgagatgccaggtcttagccgtgagtttgttgagcatcggcttccaatcaaaccaggttttaggccttataaacaaccacctcgtcgttttaatctttgctatatgatcgagtcaaagaggagattgatcggttgttgaaggcggggtttattaggccatgtcgttatgcggagtgggtttctagcatagtcctggtggagaagaaggggagtggtaagattagagtttgcatagattttagagatttaaatanagctactcccaaagatgtatatcctatgcctatagccgacatgatgatcaatgatgcctcgggtcataaggtgattagttttttggatggtaatgctggctacaatcaaatctttatggcggaagaagatatgtacaagacggcttttaggtgcccgggatttgttggtttgtttgagtgggttgtcatgacttttagattgaagaataccggtgcactatatcaaagggcaatgaatttgatctttcatgatttgctaggtattatcttagaaatctatattgatgatattgttgtcaaatcggatggtatgaagggacatatagccgatttgaggttagcttttgagaggatgcgccggtatggtttgaagatgaacccacttaaatgtgcttttggtgtgtcggcggggaggttcttgggattcatggtgcatgagagaggggttgagattgatcctaagaagatagaaaagattcgtgatttcaaagcgccgacatgcaagaaggaggtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctt

SEQ ID NO: 58464 - DNA, 1174 bp, Oryza sativa
tttgttcaggactagattgagcaccgagttaatccttacccattagacatgtggttagtacagtagtgctttgcaacagaggcccgaagaccggtccttatagtggccgaggtgctactagcaaaaccctgcacctcaagcccagcctaaaaccattttgggggttttgaatagaggggggaggtgtgtgttcaattccatcacaagccaaccattccacagtgtccaaatgatatgagaattcccgaagtctaaagttataaaaccacctactgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcagagagaacggccttccgaaccttcggcgacgaccgcaaaccatgcttcgagaaccttcggaacgatagaagctacgcgaagcacacaagcaaagctacaagcctataaagaagcaataacaatacataaaaataaagcacacggttctttaggttataacaaacattaggagacttgaacgggtcgattcggggttcgtatgaccaagatatgatcatccgaagtttaatgctgttacatggagatttacggattattgtgattaggttttgcaattataaaacgtgtgtaagcgctagcctggaaaagataggaagactgtgctgttgacatgtggaccccacatgtcaacctaagggaccacagtagaccgagtacacagagacggtccacaggtcgacggaagcggatcccgtgtgtcaaccgaggcaagcggtcgacaaacggactccactagacaccacacgggctgcacacgtggaaaccacgcggctaccgagcgggcacactaacacggacactacacgcacaagcaaacgactaccgacaccagtacacaggtaccggggtcgacaaccgcacaacaggcacgggcgacaccgaaaggactaggacggggcagcga

SEQ ID NO: 58465 - DNA, 51075 bp, Oryza sativa
gccgcgggggcctccgcctggacgacgacgacgacatcgccgacgcggcggaggcggaggcggaggcggcgagcccaagctaggtttagcgatctggtgagaccaaagcgcgcgggcgccggcgcggcgccgccgccacggatgggcgcgcgcctggcggcctggcgggagctggccagccgggaggagcggcggccggcgggaggagcggcgggagcgccggagtcgcgccggcggccggcctgccggctcacgtcacggtcgccgggtcgcggcagcgccgtcgccgtgacgccgtcgagtgggaggggagagagcgcacgggggagacagccagactggagaagagttagggttttctttgttttgatgggccaggcttttttcgtgggctaaaaaaatgaatacttggggttctctgggtcaaattctagggtagtcctgggcctacctagactacccattgggcccgcccctggacggccggacgacgcggcgggacggagagaggacgcggccgcgcgggcgctggcgcggctctgccgccacggatgggcgcgcggctggcggcctggcgggagctggccagcctggaggagcggcgggagcaccggagtcacgccggcggctagcctgacggctcgcgtcgaggtcaccgggtcatgggagcgccgtcgccgtgacgccgtcgagtgggaggggagagagcgcacgggggagacagccagactggagaggagttagggttttctttgttttgatgggctaggcttttttcgtgggccaaaaaaatgaatacctggggttctctgggccaaattctagggaggcatataattatgctagtcaagatcaaatcagtacagggagatatgaacgcagaaaggcactcaccgtggtggaacttgtgaccgcatcgctgccatatgggttctactgacacataggcgctaccatggcatgccacattagcacacggagtgagttggagcccatttagacctatatgacacccaagataagttaaggggcccaaaagtgcattctgagagttcagggacctaggtgacacacccgcacaagtttagggaccgctcgtgcactttactctattctgaaatatacaggacattatatccatagcaagtgtaaattatcattggttccatgaataattgtgtttactgcattagtttttttttctaaacatgtaaattataacagcaccatattctttgttcttatccattgcagcatatgtgttgcttggattaacaaaagacagatcgatatttgagttgctctaaagggtagattagttgaactcaattattatagggccaccaaaaaattcggccgcacagagcaaatgttagaccacaaagccgttacaaatttgtcctaacctaatcagaacagaaggcacaagcaaagccccagaggagccgtaactgatttagccacaccagaggaagcaggagtcacgggggcgagctcgccgggatccctacgaagcccgcggagcagcctctcctcctcctagaagtgtggtgatattgccaattgaggttcctgagaaattattgcttgtcaagctggctgaaattattttgaacagatataattagacagggttgtatatatgcatgcaattctaatacgaaatatcagagactattcttgaaaagaatgtgaagaaaatgaactgaattactcagattctgtggatagtttaattaaacacgcaatatctttctttcagttaattctgacttcatgcgttcttaataggaaaatcattcacactgcaagttaaactaaaggaagcaatgaattgtccgatcatgttggcagtccattatttctccgccgtgttcagcacacatcacgtgcaggaggaggagactggaccccaagccaacacagtacacgtgaaccctttgtagatcaagaaccagattacattgaaattgaatactcctaaaaaaaccattgttggatctaataacagtgccaaattaatactcctaaaaaaaccattgttcgatctaatacattgtcataagaatatacattatattatgcttcatttggttaaacacacaaccgaactactgatgtttgagagacaataaaaccgaagtacctgatatcttatcacctaccattttcttagtgagaaaaatgactcgaagttcaacaggacactacaaagtatgcgaaccatacaccaccgtaggcgggggattgagataagacctgaggggagtagcctcgccgtagacctcagtagtgtcaacgcagaccgagcagcaaattgagcactggaccactgtcactgacgcgaggtcatccccggcgaggcagctgcgcgtggcggggatagggcatcaaagagggtggaggcaatcgacggcggcggtgatggcgaggcgaagggcgatgcgcggaggcgcgggctgcgtcggcgcggagacgcgggcggcgttggcagagaggtgaagggcgtcggcggcagcgcgtgagaggggaagaggagggattagggttgggggagggggcgcaggtcaccaggtcgggctgtcagggtggggagggaggtggggtgaatccggagcgttggatcagagtgaggtaatctggaccgttgagtgaggaatgaaagaatgagtgatgagtgaatgagtgaaagaatttgcccttgttgaactatagggtagatatttgttgaactttagggtagacgtgtcacgctatatgagtgtactgccgatttttcataactttcatatacctaaatcaaatggttgagacgattattagtaaaagtttagtaataaaaaaaattagtccgtgtagcagtgctcagtaaatgaatgcaaactgtgaaagccgtggaaggggtcgttctccggcgatggctccggcgacggctctggctccggcggcttgtccttgtccttgatgagctccgccgtgcgctgcgcggccacgctgagcatgttctccacgtccatcgagctggcctccagcctgagcatgtccgtctcctcctcatcgtcgctggactcgccatcatctaatacctcctcttccttgccttcagcttcgtcgccggcggcgtgcttggcgcagtactcgaccatctcggcgaggggtttggcggcggcgcagccgtcctcgatcagttgccgcagttcccgcaacagactcgccgccctctctgccattgatgatatctccccgtcggagctcatcatcttgttgatatcttcttccgccattgatgacgacaactgtccagcgagctagcgaccggtttgcacggagaaatcaattagtaatatgctttgtcgatcatctattttattagtatatattaattaattgcatgaaaccgatctaatccgagtctaatttcaacttattacgaaatcgtaaaccaactgttgcgatgaatccgtttctgaaacatgcacacgcgtgcagttgagtggatttgctctgatccagaggggtttgttggcaacttttcgtaaaaagtcgacaagcacgatcgcagcaactaaacgacttgcggtgatatggagtcgccaaccacctcgatctagccaaaagctagaccaagatgggttttgataactaaatcggctagcggagccgatttctagataactacccgtctcgtgggcaaaacggaaggttttcaggacaaacctataaaggggtgtcgcactctcgcagcggcggcggacgatttacagcgcaaattgacaaagatggataaactaagagaaaattaaaagcaatatgaaaaacgattcgattgattgattgtagattgattagttacaattgaaccggccatgtcccttatataggggttggtcttgccctctacaggccctcctccacgtccaactcggggtagaaatcaaatgaaacccgaaacatgccttcccgagcaaggaaacctcgagacccgacgaaacacagtcggactcggacctgccggtcagaccggccacatgccgccggtctgaccagccctaaaccggcggtctgaccgcccaacgcacggcggtcagactggccctactcggaggaaaccggcagacttccaaattttggcaattttttctatttaatctctaggtgccaaatttgggtgtaaacacatgccccccctaccttttttatgaacaacgtgaatccaaaagcatagaacatgtttttggtcttagggcgataatccaattactggccatagcacctcctaagcgtcttgccaaacgctcgggaagtatttcttcaagtatttcccgttgattgctcgctgaaaaggctccccttgaagtgtctccaaaaaatatgcgttccctcgaacaatgccgcatattcgataaggaccttccctactaggagaccacttaccgaatttccaaaaaatatgccgcatattcgataaggatgccgatacaaatttccagtatcttttggtttgaacccaacctgctccctcattacatcggcaatcatatcagcccatgatgtttgctgaggtactccttgtgtttgttgctgcattagctcaaactgattgaactgaggagcaaactgaggttgaggcgatcctgcctgctgatactaaacatgaggtgacagaggctgatattgataattcaaatttcttccttgatagttctagaagttcggttgaatattacgtaccaaatgttcagggataatctgaggcacaactgattgatcggcctgtacatgatggaccaagtgttcaggaataacttggttcacagtatgctgcattggccgattgtcaggtgttctcaatctcgctgacgcatgttgtaagttttgctgctgagtcggatgaactgtctgctacctcggctgtgcttgctgagtcggcaacggctgtgttgggtcggctattgtcggatttggcaagaacattgcagcaacttgctcctgagtcagccgattgacattttgcccagcatgttgtggttgttctctggtcaacaatctggggttaaccatctgtcttggtgctgattgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgaataattaaagtgacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcactgtaagtcttccagggtttctcgtgaaccggtccttaattgccatgggtgcgactcgcaaaaccatgcacccacagcccaccattcagtcgtattttagttggataattacgaccatgaaacatggccagacgtctcgagcacgcagctcaacaagatactagaatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattaggatcaacatgctcaaggggaatgtgtgacttgccttgcttcttcacttggatcttctaaactcttttcctcgcgaccgcggacttccgaaacgacggattctacacgctggcacgcaaaacgaggaaaaactctaataaaaaccaaggaaacagtacataaaaactaaacaaacatgtagagctcaattttagatgaattttgcaagttgaatggctcaattcggaattcgaatgaattagatatgaattttggaagttttgagccattttaatggatttctagaattattaccgatttattgcgcaatttaaatcaattatgacgtcatccgacgggggagaggtggcgccggcaagcgggccccacctgtcggtgactcacgggtggcgggcacaccgtggaccgagtccacgcacgcgctggtccgcgggcgcaccacgtggcagacacctggcggccacgacggacggctagcggaggtggcgccgacgtggcgccacagaggcaccgactcgggcggcacgggagggccacgtggacggcccagatcgccccgaagggggatcgggcggccacgggcgagcgggagccggctgaccgatcggccggccgggagcgacggcgcacggcccgatggtcgccggcgacgaccaccggcgcgacagcacgcgcgggaggcgacgaaaagaggggaaagggagaggagatggagggggtcctcaccgaggggcgccggcgacggaaggcggccggcggagctcgggcggaggatggcgtcgctgctccggcgacaagcggcgcccgggaggaagcggacgagggcggccgcgacctcgcgtggcgggaacgggcatcggcgacggggagctcggatgaggggaacgccgggcttcctatcgacgctgcgatgccactggaggaggacgtgaggccggaaatggtttggagcggcggcgagtggcagccggaggcggctgctatgatggcggttcgggtggtgtggtggagtgacggttccagcggcggaatggaggagcggaggggatgccggggtacgggacgacgcaacgaagccgtcggtgacagttgcgcggagcagcgacggcgggagtgacggtggcggccggctggagggcgctggcgggcggcggggctcgggcgcgcggtgcagtggtgtttcggaggcggagaggggaaaaggagtaggggccggggtgcggcacggcacggcgatgccaatgatggtggcggcgcagcgcgggggcgactggagcggcggtggcgtgcggctggaagcacggcgacgagcggcggagctcgggttcacgcggggagagcgggagaaggcgcgacgggcccgggaaaattggggaaatgggagaggagagcacagggatcgtttttatagcctcgagagggtgggagagagcacgagcgaggtggatttggggcggcaaccggcgggaagcggggtgtcgacgtggagctcgtggcggggcaaaccggcgccgttttcttggggggaaatgggggaaacggtggaggaggtggtgggggtgcagttccaccacttgggcgcgagcgggaggggcggggtggtgcggattttgcggcggagtgggcggcaaccgccgggaagcgtgggcggcatcgtggggtgtgggtggcggttttggaggggagagatgggggaaaacggcgcggacgtgggcggcgaggtcccacggacgaacgcgcgcgcgcggggtggaggaggtgggcggaaacggcagcgtcgtggggcggctcgggcggccatggcggcaacggcagctgccggcctgaggttggggatgacaggtggggtccacgggtcccacctgtcggagagagagggagggagaggccggctggggaggcaaaacagacttgagggagagagagagccgagcgggccgagggaggaggccggcccgagagggagagaaaggaggggttgggccgaaaggggcccaaagagaggaaagaggattttaattgttttctttttattttaattgatacaatgatctttgtgttattaaaattatttcttgagctccgaaaattcacggaaaattccggagagtattttagggcacaaaggatattacaaaatattcccggccaatgatttttaagggaaaattttaattctcccaataattcacttgattaagttgatttaacttttatttaatttctagaaaatgcattatttaatgatttttaatcccgaacgaaaatcggggcgttacactgatgatgtagcttgtgcagaagttgaagctgaagccatcggctgagccggtaatgcatgggagacattcgactgatttgctgtgaccaatggtctataatttggaaaaacacctcctggtaaatagactggtcctgaagcttgatgttcggctatcgaaccatcgacaacagtctttaccatattggttaaggtattaactaatactccagactgattgatcaaggcatgttgcacggcatagtcgatcctatcttgaaaattattgaattgcagtggctcttggttgccatctgcaccaaggtcttcaactgtaccatcttgaggaatatcacttttgttacctgagccagttgcagtacctttgtcaccctgagatgaacttgggctgacctcatcggctgcgaccaccttcaacttgtacttttgtacgatggttcctctgcgggtctcctgaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaagagagtgttgatgtaaaaacacgaggcctgggagatctgcttaactctagtgcaggtccaaaatcttgcctttgaggttcatgagcatgccagttgatttgatcctgcaatcaacaagaaataaagacaaagaaatagtagttagtccataaatgatagccgatcgaccagccgccgatgacgtatcatttgtactcgagccgatgtcatctttgcatcgatcggctgtgcgaggcaataataaagaaactaaatctattcaatcggctgtagatatcaatgataaataatcttcatgtcgatatatacttaaatcaagtaattgggatagatcggtcgccatgccgagacagtataaatcacttagaccgaaatatatattaacaaggaaactataatcattcacagcatagctgatcaaatagatctagcttgtatcggctaatactccgatactactctaccttaagatattaaagcaagtaaaatatatcaaacgtaaagtttaacacacctaaaagcaataagatcttaacataaagggcagatttaacatatcaattaagcacatgaaatataaggctaaattaggtaagatcggctgaaaccccgatactactctaatcgacaaccaagaagcaggctagagattatagttctaagcacgacttatgagatcaaactcaactgatgcagccataagtatgaaaagaaagacaatatttaggcaatcaagctattggaagcttcataaagtggtagatatcctatataatctaagccaacgtcgatacttaacctaatcggctgctctccagcgatagacactagccgattggaggttagatagcgatattgtcagagattatataagatatatgataactcaacaacttacatagataggattagagtatcataatgatggaagcaccaatctcgagaacgcaagccaccataacaagtcatacctctagttgaagatcgaaaccgatgcagttcaacccgaaagcaagaactcgtcgaaacaaaacgaaagtaaaagggtggcgatgcgccaagattgtatttgaacgtgtgttaattgattacatgggactcggggtctatttatacccgagactacaaaatatgtcctttgtcggacacgactattatctctaacaaactctaagataccataagtctttgcagcagacttttgcccaaacttatctctaaggaaattacataaaatatcctaattaatagatacaattgccttcttagaactctatccatgtgtggcaatccatgtgaagcacattaactcagctcgataatgtaaaccgattcatattgtcggaatcggctgtatcggctaaccctatctgacttggactcagccgatctggtcgtagccgatctggactcttctgttccctgggcacaaatgtccgaattcacagctaattcggtctttgaatcaattgcggcgtgccccccatcgctctgtccagaatcggtcagaccagccatacaagaccgatcagaccgcccggggtggctggtcagactggtggcatgtggccgatcaaaccgcccctgctcaccggtcagaccggccgtgcaacgccggtcagaccgcccctggtctccagttttgccaattttgcacaaaggtttaaaaatcaagcaccggctcttctagtatcagaaataatcccttcttcacattatagccagatgcttgttgtgccaaatcatttgctctagaattatcgaaattagcaataatgtccaagcatgaatcaagatacctatttagtgatccgtccaaacatttgtagattccggcgacttgttgcaccaccaattccgaatcaccaaaagcttccacgtgcttagctccaatcatctccatcacttgtaagccgaataataaagcattatattcggcttgattatttgtacaataatactccaaatgaaccgatgcctcataacacatgccattaggtgaaaataaaactacttctataccttgaccttctttgcatgaagaaccatcaaaataaatcttctaaggtataacttcaactaagcaaaccccttcttcataagcaatatctacatgatggtctactataaaatcacatacaatttggcctctcatagatttcaacggttcataatccaaatcatactcaatcaaagcatatgcccacttgccaattcttccacttagaattggccattgcaacatgtgtttaataatgtcggcttgacaagcaactatgcatgtactagataacaagtaatgcctcaatttggtacaagcatagtataagtatagacaaagtctctctataaagacatacctcgtttcggcatccaaaagatggcagctgaaatatgtaatgatatactccttgccatcttcctcttgcggcaaaacagcaccaatgactttatcctcggaagcaatatacaaccaaaaaggctttccggctttaggcgcccgcacaacgggtggagtagataaatacttcttcaacccttcaaatgcctcttgttgttttgccccccaagtaaaatcggcttcttttttcaagcggagtataggaacaaaagcatcgattttacccgctaagttagaaataaatcttcttaaataattcaccttacctagcaacttttggacctccttcttgcatgtcggcgctttgaaatcacgaatcttttctatcttcttaggatcaatctcaacccctctctcatgcaccatgaatcccaagaacctccccgccgacacaccaaaagcacatttaagtgggttcatcttcaaaccataccggcgcatcctctcaaaagctaacctcaaatcggctatatgtcccttcataccatccgatttgacaacaatatcatcaatatagatttctaagataatacctagcaaatcatgaaagatcaaattcattgccctttgatatagtgcaccggtattcttcaatctaaaagtcatgacaacccactcaaacaaaccaacaaatcccgggcacctaaaagccgtcttgtacatatcttcttccgccataaagatttgattgtagccagcattaccatccaaaaaactaatcaccttatgacccgaggcatcattgatcatcatgtcggctataggcataggatatacatctttgggagtagctttatttaaatctctaaaatctatgcaaactctaatcttaccactccccttcttctccaccaggactatgctagaaacccactccgcataacgacatggcctaataaaccccgccttcaacaaccgatcaatctcctctttgactcgatcatatagcaaagattaaaacgacgaggtggttgtttataaggcctaaaacctggtttgattggaagccgatgctcaacaaactcacggctaagacctggcatctcatgatactcccatccaaagcaatccacatactccttaagtagctcgattattttaaccttataatcggctctcatatttttgtttacaaaattcggccttggctttgttccatcacctatgtctatttcctccaatggatcggccgatgtaaacccttgtccaagcttctctacttcatcaaaatcttcaatagtttcaccaatatcgttctttgtagaccgatattcttgcaccctcttttgcaaccactctaaattagcttctttactcattatacaaatttatatagcctagccgtgctacactagccggctttacagagataagtacaaatttgccatcggagatactaatgaaatcatagctagaaagatccctccccgataagcattggatattcccatgacgccattcaaatgtagcatcggccattgcaacctcggccgatgtatccgttttaacaatctcaacatcatcgccgtcccattgaatcaaacattgatgcaaggtagaaggcacacaacaattggcatggatccaacaacgacccaaaataacattgtagttaccttgcacatcgactatgaagaaagcggttggtagtgtgttgtttcccacggtgagctccaccgaaaagatacctttcgcctccattggttcaccattgaagccattgagaaccatgttggtcttcttcaattcattatcctcacgccccaacttcttgaataatgaatacggcattaagttcacggcgacacctccatctactagcatcctagagactggcttcccatcaacatgacctttgagatagagaggcttcatatgacggtttgattcatcgggcttctcaaaaaccgcatctttaggacctagtgaaaattgagcaacctcggcttcatccatagcacaaaactccataggcaacatacacaccatgttgatatccatgtcctcctttggagatgactcatctttagcaaccgattgttcttctttctcctctacaacaaccggttcttccctctctacggatttatgcctccaaaaggtggtggtcgcaattcattgaacctcttatctctttgctcttcggcctttttctctcttatctcttgggcccgaagatgctgcaaccttctcctttgagtagccgttaaatccttagggatccacctaggtttcggctctgttccaggaggtaaataatgccccctattgattttgcttgaagacaatgaagcccctgcactactcctttcaaacctcctgtcaaaccggcgttgaagcccggtcaaaccggacgtagaccaccggtcagaccggctagaagcgccggtcagaccgacattgggtcggtggtcagaccggcctgatggcccggtctgaccggtccgcagagctacggtcagaccggccagagggcctggttagaccggccaactgcgatgagctggtcccaatttcggatttgttgcttgatgacttcccaactccatctccagaaggtattggcatatcatgagatcccactttgatggtaatcacctccgaagtccttgcctccaccttaacacgctttccttccctcttttcttcattaacccgattttttccataaaaccggctattatttggtgaagacaagcgctcatgaattggcctccttggtcctccccacccttagttgaattgcattggaggcatatggttgaatattggcggtgttgccccccatggcatgtagtaaggataaggataacccggtggcggcattggataaggtccccatgacatgtcttgtgaatgatgatatggaggtgattgcgaccgttttggtgaatgaccaaatcgctccctaggaggtgatcttggtctttttcctttgttgcgagttctctcaccaccttgcttctcatacttctccaaaagcatgtccaaagtcactttagtcttcctaggtgctttagaagttgaagcctcactcctattctccttccatacaccaacctccagtttctttggcactatcatctttggcctaggttcaccaatgatcactccctttcctttagtagattcggcttgctccggccgaatcaacaccttcttatcattgaaattaattgtattcaccgaaaaaggatcatgatcaagcttcatcttggaaccatcagtgaacttcaattgtccttcatctatggccgattgaacctgtcgtcgaaacacattgcaatcattagtagaatgagaatgagaatcatgacatttacaataagctcgacgcttcaattcttcttgagatggtatgatatgtgtcaacgtttgatgtcgcgattccggtatttgcatagtatggggatcgttggtactaggatatacgcgagattgaggtaaaagagatagacagggatttttatacaggttcgggcccctgaattgtcaggtaataaccctacatcctgttggccgaagccgatcgttgctcttattcaccataatcacaccagtacaatatttgtggtagcctatctatctgttgtcgacttggcagtctgaagtgctaactcgtagtcgacaacagggtagtcttcctcctcgaactcgtgcccggcgagatcagagataacgctagatccctacagccggcctccataggtaccagatagggtcctcctaggcatatctctgatgttaatatccggcggcttgtcctggcgtatgttggcttctgttgttccttctattgttgcgtgtcccctctcctcctagggggtcttgtatttatacccataggtgtccccttgtccaagtagaactagggagtccaatatggatacaatccgactagtccttgccgtttccatatagaactctagttgtctttccttatccagaacttcctccaactcaaagtcagtttccgtataagacatggtatgtggtgggtcctgccgagatttagtcaactactattgggtatgtggtatccataaccctgacaatatggcctttaggtaatctaatttgtttttcttgcaaaagataatcaaaaatcttatcacatttggccacatcaaacctatacttaatctcactttgccgatctttacgaggagtcggcattaaattagagcaaacaaaaggcttatttttgttagtccatgtccactcagcaacatatatgtcatgatcaccctcatcatcactatcactagcctcaaagtaatcaattgaattaacattaggctttttctcatatggtctaacagattttttattatccttaacccggctttcctgagccagagccttttgcatgagttgactaacatcaataaattgttggccatctaatctctctttaataggagtaattaaaccattaaaagcaagatcagccaaatctctatcagttatgttcaagctataacatcggtttctaacatctctaaatctcttaacataatcaatgataggttcattatacttttgcttaaccgatgttaaatcagataacctaagctcaatttcaccagtatagaaataatcatgaaatatctattctaattgagcctaagtatgaatagaatttgtcggtaaagaagtaaaccatgtaaaagcagtaccggacaaagacaaagaaaataagcgcaatttaaaagtatcactattagcctctccacattgctctaaaaattgacctacatgctcccatgtagtcctactatcctcaccactaaatttggtaaattcgggaaccctataattacgaggatatggcacattatcatagtaatcaagatacggcttttggtaaaccttagcacgattcctagcttcaatcctgaatttatccctaataattccactaatcaagtgctctatattatcaggcctatgttgatttggtggtggatttggtggcctaataggttgatgttgtggcgcaatatgattatattggccttgcctagtatcaggaggataccccctagaaacatcattataagcattaggaacatgtgggggaacttggggattacttgcagcagtagatacaggaggaccaaatgttctaagataatacaaataactaacattagtcattgaatctatcccctgaatcggcactattgtgccgatttgaccggtccagagcccggtctgaccggcgtccataggcgcggtgagaccggcctgagtcccggtctgaccgccggggtgaaacccggccagatctggccggtctgaccggcagtggctttatctggcccggtctgatcagcagtttgcgccggaaagccctcgccgatttgttgtgtcttcgctccatcggttttactatttatttgatctataggagcttggctagcactggtagaggctttatctttgattacaaaatcggccacgagagggccgagtttatttctcataaacttttcacaattattttcaaaagatgcttctaatttgttattgaaagcaaccatagatgcatctattgtatgagcaacttgttgttgaagagattgtgataattcctcaatacttaccttgtcaaaagtagatgaagacaccaaatccggcttgaagactacgccatgacgggtctttgagcatgtctttaaaagctcgtcggcatacttcttcatgtgttcatcgaaggccatgcgtgcttcctcatcaagactctccatcatcaccggcagcacattggatggatccacctccgccttggttgatggaggcttcgtcatggcgatgtcgaagttgagatggcgttgaacggatttccccagcggagtcgccaaaattcgtgttggcaactttttgtgaaaagtcgacaagcacgatcgcagcacctaaacgccttgcggtgatttggagttgccaaccacctcgatctagccaaaagctagaccaagatgggttttgataactaaaccggctagcggagccgatttctagataactacccgtctcgtgggcaaaacggaaggttttcaggataaaccaacaaaggggtgtcgcactctcgcagcggcggtggacaattttcggtgcaaatcgacaaagatggacaaactaagagaaaattaaaagcaatatgaaaaacgattcgattgattgattgtagattgattagttataattgaactggccatatcccttatataggggttggttttgccctctacaggccctcctccacgtccaactcggggtagaaaccaaaggaaacccgaaacatgccttcccgagcaaggaaaccttgagacccgacgaaacacagtcggactcggacctgccggtcagaccggccacatgccgccggtctgaccggcccgaaaccggcagtctgacagcccaacgcacggcggtcagaccggccctactcggaggaaaccggcagacttccaaactttggcaatttctcctatttaatctctaggtgccaaatttgggtgtaaacagggtttatgtaaatcttatacgtttggggcatttgcaaacttgtccattgtttttcttaatctaacttacaactctggtttttatgatattttgcaagaatgctattcgaatgtggtagttttgcaataacaatttaaaattgtggcaaatttgcaattgccccaatatatttatcagcccattaccggaacactaggcttctttctgcttcctgaaactccaaaattattaaagatcgaagttaccaatgtgattccgattcagaagtacatagaaaatatcgtagtacaagaaaatatctccaaaattatttgtgctgcaagaaaatttggagcagcaccaaatcacaagccaaagtgcacaagcattacattagtgttccaaaccattgctgcgaagaagaacaaaagttccaaacccttacagaatgaaacattatctagcatcaccagtggaaatcctcaacagtaccaagttccagacttccagcacaaaaagttcctgtgtagattatgggtaccccatactcacacggcatgtttatccgactagttataggggataactcatatatctatgaaatatgtaatagatcatgacttgggtattacgtttccttgtatattacggaacggcctaaagtcctggttcgataagattgtaaagtagatttaggaaaccgataccgtattggttaaggtttctatcttgtaatcctgccctccatcctatataaggtgggcaggaggccctctagggggcatgagcacgtatgatcgtcagatctatactacacccggcagattcaaatccccaaacaggagtagggtattacctctcattgagagggcctgaacctgtctaaatccttgtctccgcatccatccacttttaggtctcgtgcgctacccccttttattattgccgaattcatgtttcgacagttggcgcgtcaggtaagggagcatcgagtttcctgtcacgagtgtgatggaaccaatgtgcgacatcaccagattcatcaagcatgtctttttcatctcggattcaatccagccgaagggatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacacgattggcctattatgtcgccgttgttgggcgtctacgtcttcaccgccggcctgcctccgtctgccgccgactggtgtcctcgcctgcacggcaggcctattatgccgtcgttgttgggcgtctacgtcttcaccgccggcctgcctttgccgccgccgaccggtgtttccgcctgcaccgctggcctattatgccgccgttgttgggcgtctacgttttcaccgccggcctgcctttgccgccgccgaccggtgtttccgcctgcaccgctggcctattatgccgccgttgttgggcgtctacgtcttcaccgccggcctacctttgccaccgccgaccggtgtttccgcctgcaccgctggcctattatgccgccgttgttgggcgtctacgtcttcaccgccggcctgcctttgccgccgccgaccggtgtttccgcctgcacggctggcctattatgctgccgttggtgggcatcttcgctttcaccgccggcctgcctgtaacatcccggcctagggcttaataggattaatagaatactcatatcaacaagttgcaactttttttccggaagccaatctccaaagaactccagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttacaaaatggtatcagagccgactctcgcggtttcacgggcgcgtgtgtcgcagttgcgcaggcatggtgcgcatggctggtgtagacccggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttatatgacctatgaaagctatcagatataagcgggcccggcctgggggaaggcgggacgttacactgcctttgccgccgccgaccggtgtttccgcctgcacggctggtcttttatgccgccgttggtgggcatcttcgctttcaccgtcgaccgcctcgttcgccgctgactggtgtcctcgtctgcacggcttatgaagccgttgttgggcgcctacgtcttcaccgccggccgcctcgtctaccgctgactggtgtcctcgcttgcacggctggcctattatgccgccgttgttgggcgtctacgtcttcaccgtcggcctgcctttgccgccgccgaccggtgtttccgcctgcacggctggcctattacgccgccgttggtgggcatcttcgctttcaccgtcgacaacctcgttcgccgctgactggtgtcctcgcctgcacagctagcctattatgccgccgttgttgggcgtctacgtcttcacctccggcctgcctccgtctgctgccgactggtgtcctcgcctgcacggctggcctattatgccgccgttgttgggcgtctacgtcatcacggccggcctgcctttgccgccgccgaccggtgtttccgcctgcaccgctggcctattatgccgctgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacggctggcctattatgccaccgttgttgggtgtctacatcttcaccgccggctgccttcgtctccgccgactggtgtcaccgcctgcatggctagcctattatgccgctgttgttgggcgtctacgtcttcaccgaccggccgcctcgtccgccgccgactggtgtctccgcttgcacggctggcctattatgccgctgttgttgggcgtctacgacttcaccgctggcttgccttcgccaccgctgactggtgcttccgcctgcacggccagcctattatgccgccattgttgggcgtctacgacttcaccgccggcttgccttcgtccgccgccgactggtgtctccgcctgcacggctggcctattatgccgccgtcgttagacatctacatcttcaccgaccgaccacctcgtatgacgccaactggtgctatcgtcttcacggctggccacgtcgccgccaccgctaataggcgtcgttatcttcaacacaagttgtctgcgtctgctgccgactggtttcttcacttccatggctgcatgattatgatactattgattggccttatagtcttcaccgccagtcgtcttgtctactgattgactggtgtcctcgcctctacggctggtttataccgctaccactactgatggacgtcatcgtcttcattgctggctgccttgtctgacgccgactggtttgttcgcctccacagctacatgtcttcgtcaacattgactggtgtcatcgtcatcaccagtttgcctttgccgccgcccatggcgtcttcactttcatggctggcctattttgccgcggttaaagaacgtctttgttttcatcatcactctacttcttcgagcaacttcatctttattatcttcggcaccggcaaactctattgcctttacttcgcaagctttgctacttcgccgaccacgacgtctacaagagcctcaacatctcggcatgcgtcaacaagtataatgccgtgttattttactataacaagtggtgttccaatattcaagatttttactcggacatcttctatgcgtatcttcactcaagcaatgactactcgacgacaagaagctacaattctcgactctatgttcagttgtttctcaactaaccaaagagtcgggggctacacaaatacaagactctcaaaattcgacaagctttatgtcaagatgaagcaatcaatcaatcagccaacgagttctatggaatctacttcgggagtcatcagtttggtcttcacttcagagcagacgttctacttcagcaactcttattattacaccggcaattttggcttcttcacgccgccacaatctgctccaaatttttccaagtatcaaagtttgagattctatctacatgtccgggagtttagagttatcaaccaatcagctcagttttgatgagttggataacagtatttacttttcttcaagtgaagcatctgcaacagctacaactccaagttctactaccatctttacaaatcaaggggtgttgcatcaatcttcgttatgcacacatcaagaaaattacttgagctttgatatcttcttaacagtttgatggattattgtcactgacttcatcaccagcacctctacttcatcggccctgacatctctgtcgttgctaatggatgactacgtcttagcctccggttgcttccgtcattgctggcttgttatttcgccttcacggttgacctactatgcaaacgctgatgagcgtcttagtcattatcattggttgctacactgctattgactggattaccgacatcgtcatcttcatcaatatcctgtcaagcctcttcaacatagcctattctactgctgtttgatgggcaacttcgtcatcatagtcgatcatctttgttgctgctaatcattattactgtcggttgcgtttgtcgtcgccgactattttcttcatcttcatgattggtggatttcgtcatcgcctttgatgcgtgtctacatcttcaccctcggcttgctttcgtcaccaccgaccgatatcctcgccttcacggatgacttattatgtcaccgctaatgggcatcttcatcttcttcaccagctgcctcgtctgtcaccgactgattattttgctgccatggctatgcaactttatcgctgggcgccttcatattcattgctggctgacctgactgctatcgactagtttattcgcctccacggctgtgcaacttcatcacttttgattggtatcattatcttcactaccaccaatattttctatgctcaaagactggactatttattattccccgtaagggttatcaaccgaatacttacgccagtcgggattcaattattatatctatttgggagtatcccataagggataatcactcagatcataagctattcatatgagctacacttggtctatatcacccgaaagatttattactcgggagcatgttacatgcgtcatcctttaaaggatgtcgaaggcatattttttggcctaggcctaatatgtctgcagcccatattttcaggtgtgacctgtcacgttcttttagggacttaggcactttttgcttaggccaaagtgcgcgtgatcaagtgcccaataccttaaaatctttttataccatagttactcaactttttaggagttggtacaatgcattttaaaaggtgcccaacagtgaagttttttatagctaccccgctgacttttttatatagtcaaggcgctatttgggtttatcaagcaattgattggatacaatatcattgctttttgccacgtaagtgtgcatttttattgaccaatattatggcttaggctgattatatattgtggtcattttccaggcggttggtaaatccttatgagtttatttactcggatgttacaccacatatgccgtatatttccaggtgtggtgaaaccatgtgtcttttaaggacttaagcacatctgttaaagcagtgtgcgcatggtgtatgcccaatactttggaaatttctttattcactgcattcaagcttttttatagctgttttgctaagtgaattttcaatgatgtagtcaactttagattgctcgcatcaatttttacaaagcagtcggtatatcacttggatcatgttatttggggattcataccgcatatgctatatattgatatcaagtcacttggttaactataatgatcaaaaaccactcagttggttggattatttattccctgactgtatgcttggtttattcaattaaccacatagtcggggctacacctattaggtgcatctagtcgatgcacctgactttgtttttcagccctccacggtcttctgattcggtaaaagtactcgggagatcatagcgaagatgattgaagcactcggctttggaataatctagttcgtgagaagattatcttttcgactgcgaaggtcttaggggctactgtggagattatgggtaccccatacccacacggcatggttatccgactagttataggagataactcatatctatgaaatatgtaacatatcatgacttgggtattacgtttccttgtatattacggaacggtctaaagtcctggtttgataagattgtaaagtagatttagtaaaccgataccgtattggttaaggtttctatcttataatcctgccctccatcctatataaggtgggcaggaggccctctagggggcatgagcacatatgatcgtcagatctatactacacccggcggattcaaattcccaaacaggagtagggtattacctctcattgagagggcctcaacttgtctaaatccttgtctccgtatccatccacttttaggtctcgtgcactaccccttttattattgccgaattcatgtttcgacagttccagacttacattatatagctgacaatgttatgtgacgcatgagttgcacaatatatatatatctttaggctaaattgtactatgaatgttgttgagagttgtttcatgattgacttcgttagcggaacgccttggcattgcaatttactttaccttctcttagcgatcaagaaggcgcatgatagataggttaacactagtttccagaaccgaaaatcggacgatcatttaatcatgtcttttgctttagtaatggtttactaactcactgaaattttattagtaaactcttactaacactaacactaatgtgtcatgtgtgagtacatccctggaatcctgaatgaagaagcgtcggcttgcatcaaccagtgatctatctatcatcttcgttttgttgtcatcaagtttttagccatactgcttgtgtgatttaactacggtttattgactcggcataaatggattcctcatgaaagcattgttccctgaaaatttgccttcttttttatactggtcaggaaggcacgtttatctgctgagcgatattattttccaaaacctgataaacctaaaaaaactggcgacacatttagcaaatccgttgcaaaatactataaatcattaatcaggattcaaaatcttttacaaggaataaaaaaatctattgctaattactctgaataataatgtctttaactaataataaataaacaaggaaaaggctatacgtattaacattttcttactaaaactgacgtgtcacgctatgagtgtacgttgattttttataactttcatataactaaattaaatggttgagatgattgttaatactccctccttccataaatgtttgacaccgttgacttttttaaacatatttgaccattcgtcttgttcaaaaaattttgtgaaatatgtaaaactatatatatacataaaagtatatttaataatgaatcaaatgataggaaaataattaataattacttaaatttttttaataagacgaacggtcaaacatgtttaaaaaaatcaacggcgtcaagcattttgggatggagtaagaaaattattttgggatggagagagtaagaaaatttagtctgtgtagcagtgctaaattaaactagcctcgtagtcacgctttgcgtgacttttaatctgtttaagaacttttctatatggtctattagtttaggtaagctttgaagaaggctttgatataataagttaattttattttacaaagtattgatttccaagttgtactatatggttataataagagaaatcactagaaacctcatctttcttctctctttatccccactcatttttatcatgtgtctagaggaggtaacagaaacctccggaaatttccatatgtttagcccatttatgttttttttaatacatgtatccgtttgatccaatggctatagtttacccaaaccctttatctgatggctattatatttgtgatgatgtggcgcattctcgtgtaatatagcttgctgcttttactatatatactatataataagatggttgagatgattgttaataagaaaatttagtctgtgtagcagtgctcaataaatgaatgtatactgtgaaagccgtggaaggggacgttctccggcgacggctccggcggcttgtcctagtccttgatgagctccgccgtgcgctgagcatgttctccacgcccatcaagctggcctccagcctgagtatgtccgtctcctcctcgtcgctggactcgccgtctaatacttcctcttccttaccttgagcttcgccggcggcgtgcttggcgcagtactcgaccatctcagcgaggggtttggcggcggcgcagccgtcctcgatcagttgccgcaacaggctcgccgccctctccgccattgatgatatctccccgtcggagctcatcatcttgttgatatcttcttccgccattgatgacgacaactgtccagcgagctagcgaccggtttgcacggagaaatcaattaattgcatgaaaccgatctaatccgagtctaatttcaatgcgaactgttgcgatgaatccgtttctgaaacatgcacacgcgtgcagttgagtggatttgatctttcttttttttttgcggggagtggatttgatctgatcgagaggggtttatgtaaatcttatacgtttggggcatttgcaaacttgtccattgtttttcttaatctaacttaagactctggtttttatgatattttgcaagaatgctattcgaatgtagttttgcaataacaatttaaaactgtggtaaatttgtaattgccccaatatgtttatcaacccattaccggaacactaggcttctttctgcttcctgaaactccaaaattacagatcaaagttaccaatgtgattccgattcagaagtacatagaaaatatcccagtacaagaaaatctatttgtcctgcaagaaaatttggagcagcaccaaatcacaagacaaagtgcacaagcattacattagtgttccaaaccattgctgtgaagaagaacaaaagttccaaacccttacagaacgaaacattacctaccatcaccagtggaaaagcaacaactagttaactacacttgcatccagtgcagtcacaccctactatcagatggtaatgcagctaataactgaactacaaaacgactgcaagtgttaaactagacataaagaccaccatgaggatctcctagatttctaggccaagttgcacaagtctctgctctacatcacaagggggcaatttcagaagaagctaataagagcagagcactcgtgcgtgtgccaatcactggccgtctccgtctgaatagaacatgcttggatacacccagaaggcctgcagctgactgtaccagtttcttttgaacacaaggttatcatcagtggtaggatcccacacagcatctgcatcatcacccaacccatgaaggctccatggctgggagtagtgagcatagtacaagcagttgctcctccctccccagcgctccgggttcttgaaagcaaacggcgggcttctcgcatcacccccgataaagagtgcccagttctccagcttctttacctccacccattttgcaggcttggctgacatgtccaggcggtacggtctgtagttgactggtgctccaaatgacaaagttatgtagtggtcaacaatgagaagcatgccatcgcaaaccactagccatggtctcaaatatggacattcactcatgtcatcccaccacagggttttcatcttcttcaggcgaagcttgggggccaactgcaaagtgtacagcttgtattcaatcacggcgatgagctgaccattgaattccacaatctgatcgacccgattaacaggaagcttgagctcagaccaggagtcacttccaaccggccaatcgaacagagatgaccggttgctgataaggagatgtgagttgggtgacgtgataggagccgtcagagtgccacaaaagtagatctcctcatggtccttgctgaatggaagacgtggtggtgaaacctcagcaccggtgaacacatcaacaacgagacagtaaccactgcggcagcatatgagttgaccatgagaagagcctgcaaaaagcatcttctgcagagtttctcgaggaatctggcagcggagcggggtgtttcggttggctagatcaatgacctgacatgagcgtagtagcttgtgaggaccattgctggtagaagggatacaaggggatttgacgcggacattgggtcggacgaggagtggtgggagtaaggtgcgaaaggcagattttgatgggtatgatgagaaggcagcacgccaagaatggcaggtgccagcaaaggcgagaatgtcgacgaaggagcccaacagaggaacaatggagtgaagcagttcttcttggaacctttgcgcacagacgtggcagggggcattgagccagaggcatcagagatcttgctggggctttgcatgatggcagattgccgaactccctgcaacacataacgaatttgatcacaagttagaaggatgaaactgactaatctggaagcctgctagaatttcagctaccaaatacatgcagaagacatctaaggctctgttcgaaagagcaggttgggaacgtttggctctggcacgaaaaacggaacgatccattagcgcgtgattaattaagtattagctaatttttttttcaaaaatgaaacaatatgatttttttaaacaactttcgtataaaaactttttacaaaaaacgcatcaaaatagtagtttgaaaaacgtgcgcgcggaaatcgagaaggagaggttgagaaccatcacaaacgaactgagcctaaatcgtcattatacaatgggaaagaagatttcaattcaaccaggtgcatttttatgttcagggagatacaaatatacaatatcatagaggaaaagggctagtttttttctctaatcgaaatgttttcctgcatagtacagttttgagcttttctatggagcacttcagtactgtgtaatcaaataacgcgcataaaaatgatctgagtgtatttttgcgtactgattcctctctccatttgtacatcaatcaactcatgcttggcttccaaatttctattaaaaaaatcaacaccgctcatccaaagagtactatttttctattaaaaaaatcaaccccaaaagtagaagaggcacgttgatttacatgacacgattgataaacccacctaatcaaccatatcaatctagggttgttactttgttagcaagcacatctaacaacaaaaatccagtggaaattccaaccctagcgaacgcgcccgtttcttggttagggttggatgacacaagagatcgagaaatttatcaagaaaaaaaaaagaggaacagggtttaggcgcgagaaggcgggagggtagagagagcgcagaccttgtggaggaggtccgatctccggcgacggggaggacgacgatgccgccggcgacctctccggcgatgtcggtttgccctctctctccccttctcctgctcgtcttatggccttcaacgtgggccagtttggtctctccatgtgggccgaaaattatgggcccaactcaatatttgggccggactgcgaagttctacgggcctgcggattatttgggcctcccatgggccatggatcatggcctcgccgacgcatccatatccgccgcttcttcgcttcgcctcgcctcggaggctcggacgcgccgccgccggttgcccggtctcctcgccggccggcggatccggtgaagctacggattagtgagtggtaggagcagcagcggccatggacgggagccgccaggagatgccgccgccaacggagctgagcgctctcggccacaggtaatttggtttccgttcttgcttcaattttgcttagttttgtagatttctagttgattataggtatatagttccaagaagtttatggtacctgacattcttgtatggtagcatttgacactgaatcactgatggctgaagctgcgttggctgccaaaggaaccaaccagatctattaataaattattaatcaaatgcactatcttttttccagataaatagggtgtattgccgcatattcatactgtcaaaataaacattttcattaattttgggagggtggaatacgaagtaccattttgtcttattttgaagggaagggaggaaaaaaacaaaaataggtttggcacaatataaacagattattacaattgtggtattgttcaagatatcaaagctgtaggtggttctggcgtatattgttttggttggcatctaggacgttgatgcacatcttattctgggaatcgttagttcgttacagacttacagttcaatgaaatggtcagttttatttgcctcaatgtgtcataactcataagggtcactgtaatgactcaagaagctgtaggtgaagttactgctttatattgcttcactgaaacaacacagttggatcaatatcactccactctatctctcaatctttactagtaggaagtagtaattttatcttcgaatgttttctctgctccagtaatctctgaatttttctttgtttgacagggaagttgctgctgcagaaaggccctttaagaaaacctgccactcatcagtgcctacatcttctaccttgtgtgaaccccatgtttggccaggtctcctggaaagcctccttcaccaaatcattgctttgcttagctcattccaggacttgcttgcttttagtgccacctgccactcttggcgagctgcgctatcttcctttccatccgtatatactttcaacttcccacctctctgcctcaaactaaatacacctaatatccgtccccttcgcgtccttttgaaggacaatcttttatcttactgcaaatggcagcttgatgatccatccaagagaaacatatcccttcgttgttcagctccgccagatgctccaaatcgcatgcgctatttgggctgctcatatggatatctcatcttctcctatcatgagaagaactgcctctttgttgatgcttacactagcactaagctgaagtctcccaaactcaacttcatgggcgacagggatatctactacggcatccttacggctccacttaattcacccaactcacatctgatactttgttcgaggtcttccatattctattggcaggttggaacaaactcttggacaaagcacggttatggcggtgagcacattcttcagattgtgctcttcaaaggtgagatttttgcgatggatgttcttggcaggcttcacaccatgcaatttgcacctgagctcagcatacaggaagtagcggttctgcgacgagaagaaatggttacaggcccacgttctgggccatggctggtggcctgtggtgaaatgcttctcatggttgatttgtcaacagaccgcgaccaattgcctcgcacctttcaagtctttcgtcttgagttttctgctgaaacagttgagtgtgtgaagatggaaaggttggaaaatcaggctctctttgtcaaccttgatgggagggaccctacattctcttgcacgagccctgaaagatggggcggaaagagtaactggatttatgttgcgaaaccatctggagattctggtgaaccttggactgcggtcgagctcggtcagccagttcctagtagaatagaccgcgtcccagactttcaagtagacaacatgtgggtggtacccagtttgatttatgatgtcaaccaatgatgttctcatcaagttttagccagcgttgcacaagccatatccgtacttgctagtgtgatttaatggtttcttgacctgtggcatatgtatggattcttgtaagagtacactgaagttgtatctgtagtatgagaaatgcaggttcttgcatgtactgtgcagggttggtctatgttctgtgaccatgtgaatgctgccttaatattatattatcgttggttaatggttatgttgtgtgacgccggagggatgtcgctgagagttgtttcatgaatgattatgccctttttcttttacatactgatcaaggatcatgtccataaaatttctcctgatgttgctacaccagcctgctgagtgcagtgtactgaaacatatgttccctgcattactgaagcatcatatatatgcaaccaagacgattaattaaggtgaattagattgtttatgattgttctctggggaataatggccatgtctcagatatcttggcgccaaaacatgcacatgttaaattgaacaatattgcaaaaatgtaactaatcaaatcgattaggactcgagaacatttcaattacaaaagatactaccaataattaagcaaaagcataaacaaaaaaaatctattattactaattattattactacgcctaacaaattattatgatttactgtaaggcccacgcgttctccttgatgatctcctcctcctccggcgtgaagtcgttggcgatcttgaaggtgtccctgatctcctccggcgacttgcccctgatcagctccgccgttcgctggacggccagctccaggacaccctccacgcccatcaagttccccgccatcagcaggtggtacagcgtgtccgtgtccacgtcgatcaactcctcgtcgaacctcttcagctccgccgccgccgtgctgcggccttcgacggcggcgtgcttggtgcagtactcgatgatcttggagagggatgccggcgccgccgtcggcgcagccgtcctcgatcatgtggaggagagtatccgcgacatgctcgccgccgcctccgtcatctcgaaggtctccccgtcggagctcatcaccttgatcatcttcttcttcttcttctcttctgccgccgccatagatgacattaactgtcaagcaagctagcaaccgatttgcacggagaaattgttcgaaagtcctactgagctattgatcgctagcggcgatcgttttttttttcttttcctcttttattaagtttatacacctaaattttacacatctaaagtttgtatagcgaatatttataagtcaaaagtttatatatccaattaaaatttgaatttgaattcaatatttttatatataatatttctatacataaatttttctaactttatttttttaaaaaaatttatggtgtagtagaaagagaagaaggggaggcgagctcgccgccccaaccgccgagcgctgccgccgccgcagctgactcgacgccactccgccccaaccgccgagcgccaccaccccgccgagtgccggcggcgccactgtgcgcccccgccgccccaactcgacggccccactgcacgatctgtggcgctgtggctacacaaacatcactgtgttagtagctttgcatgcatcgctagatgctaccatgccgatgaatcttgtcactcactcaccatgctgctgctaaagctaaaaagcttagctagctatggaacatggaaaacatggcatgttcttgtgaaggattactacgtttccatgccatgtgctgcctaatagctggggcggctggaggtgctgccgcacagtgccggcgggggtggtggggcggcgctcggtggtggcgcagggcagcgggtcggtggtgacgcgacgccgaagaagcgcgtggcggcggcggtggcgctacgcctggagggagcgaatcgatccagacccagagtatctttctttgatctgacaggtgggcccaggggtaaaaatgtccacaaatcttgaaaatatatacaaataaaattaagaaaagaaaattacagtaaagatagataaaaagatagataaaagtggtaccaaataaactaattagcagtcctaatgacatattataaagggcatacggattgggtggtaaaaaaattgaggcacgcgaatttgatggtaaatagtctaaattctcgaggggatcgatcgcccattagccgtccccgaaattgttattgaagaagctgatcgatcgatcgatctcagacctggattaattgccaatgatcagtaggtgatctgtgcttatctatttatttgcatgaattgaatcgaatcgaatccgagtctaatatctcaactgctattccgaaacgattgctttgcttgttaaatcgaaacggaatccaaatgtacgttaagatgaattcgtttccttgtgtaaattcgaagagaagaatgggtgtttcttcataaatctggatcgcttatcaccttgttaatttgttaccgactcaactgcgaccgtcagatgagaggcgtgcggttcggattggagcgcaaagaactgaagaaaaaaatctaccctcttctcggccgccttattatttatccaaaaatgctaatctctgatacattcggttggtgaagagggccagattatttaatttctttatctaaaatgcttaatatctgatcaaacttccacacgcgccagggaagatcttcttggggtttataatgttggaaatatctttcagtaaattaccattcaatttaatccaataataaataatgtataaaccatgatgattataacatagaccattggcaaattgctcttgatactaatagagataaacaaaatagacatacaacagttgtaaaccatagaaacaagcatgtccagctcatttcccccataaaaatagaatcatcagacaagaacagaataaaatagcacatagtgatacagctttagttgcggaacagaagcacagttgccagaagcaaaaaaacatttgcatttttgtcagcgtagtgaaagaaaggcagcgacttatatggatatttattactgaagcataataatgccttataatggaaccaagacgatttattagaactgaattccctctagtagttcctacagagacaattaagtgtattagattttttttccttatactccctccgtttcgaaatgtttgacgccgttgactttttaagcacatgttttatcgttcgtcttattaaaaaatttaagtaattattaattcttttcctatcatttgatttattgctaaatatatttttatgtaggcatataattttacatatttcacaaaagtttttgaataagacgaacggtcaaatatgtgttaaaaagtcaacaatgtcaaatatttcaaaacggagggagtatatgtgattgttctatgggggatatataatggccatatattgatatcttggcgccaaaaacatcaagagctacatttcccatcggatacgggtagtggtgttcccacgttcgattacccggggtcacatgactccgaataatttattcaatcctaactaaaataatttattcgatcggcaccgtaaaatatcgatacgaaggcgaagaagctgtccgatctctataacctatgttaatttggtgattgattgccgatcagatgctacgtgcgcatccttttttttccatgaattcaatcgaatatcgagtctaagtacattgcaaatacaaattaggacaaggtaattaagcaatggcaatgcatgcgagtgataaattgcacaaaatcaattactaattacttctgaataataactactaactccatcccaaaatacttgtccctttaagtttttttttaacttttgatgattcgtcttattcaaaaaattatagaattattatctattttatttgtgattttctttattatcaaaagcactttaagtatggcttattttttttatatatttgcaccaatttttcaaataagacaaatggtcaaatgtcgcaagaaaaaagtcaaagcgaccattattttgggacggaggtattaactctactatagtttgtgaattgtatgatgtactgccttcatcctaaaatataataatgttggctataaatttgaacaaatacatgtctaaattcataattataaatatttatattttaggatgaagagtgtagtaatacgtagttagtaagtactactaaaaggcagggttcaatcttttgttttcggcgtttctagcaaagggtgtctatataccgaaatttccaaaagttcgaacaaaatttggtcaaatttgaataaaatattaccaaatctctactattataaaaattgaaaatgtttttgccaatattttagtacgtcatccgtgtttgagtcggttttcaaattcgttcacttttgaaaatacatatttgtgtttgagtcggattttaaacttgtttgcttttgaaaatataaaaggagtcgtataagaaatattttttaaaaaaatttacatactaacttgagattaatgtcagactcctaatgattaatgtcagactcctaattacagctcatgattttctaaaaaaaatatccaagcgaatttccacagtgaatttcacgctagccaaaccataacaataataagattaaaatatcattcacctgttgtaacgcacggacatcttttttagtacataaagagaaagaaaaaaaattaaaatttcggccgaaataatatcatatcggaggggtcccctccgataaaactggaatttcgttccacaattttaaaccctgatagcctagaaggcccattcatactccttgcggatctgctcctcctcctccggcgtgtggtcgttcttgatcccgaacatctccctgatctgctccggcgacttgcccttgatcagctccgccgtgcgctgcgccgccaggctgagaaggccctccacgcccatgaagttggccgccatgatcaggtcgtacagcatgtcgatgcccacctccatgaactccacgtcgaacttcttcagctcctccttcgccttgcggctgctgctgctaccttcggcggcggcgatggcgtgcttggtgcagtactcgatgaccttggcgagggcgctgccggcgacgttggggagagtgatcccggcgccgccgtcgccggtgcagccgtcctcgatcatgtggaggagtatccgcgacatgctcgccgccgcctccgtcatctcgaaggcctccccgtcggagctgatcaccttgatcatcttcttgttcttctcttctgccgccgccgccattgatgatgtcacgcgagctgatagatgtctaaattgatcgacggcgaattctgaagctgatcgatctctgagacgacccacgtttggtgattgattgccgatcaggtgccatgagctcatatatttattgcatgatgaattgaattgaatccggatctaatttgaactgttattccgaaccgattgcttccttgttaattcgaaacggaatccaactgttaagttgaattcgtttcttaaactttgcgtgcagttcagtggaggtttccttatgtaaattcgaacgggaacaggggtgtttatgcataaatccactatcaaaccgggagttggtctatttttttaaaagtccctacaattatctcctattgtattgtttagtcgcgcaaggggaacccccgccttcttggatctccggcgacgagcagcctccgtcgctgccttctccggccatgtctgcatatgcatcctgcatccacgatgacgtaagccggccacctgatcgagcagtatgacgaatgcagatgtgcagtggaaaaatatatttctgacgagcatatgacattcaggtgtgtgttcatcagtgggtattcctttttttaatttcgacagatttgaaattcaggcactcaggtacctacctatctcgtgagatacagttatcgaatttaatttccacgggccatgatattgtttatgcatgcagtttgggttagggattattttgttgatatttttagtctcgatttcactattagttatctccaactctacatgctccttctgaattatcatatggcctaaataaaattcatgacttatgcatctctgatcaaattttcagacgcattagggaagaatatatacgctaggagatcttctctgggggtttatgctatctatgggtcatcagttcacatatctgaaacccatttccagtgaaaattcttgcaatggtatgtcacactgatcatgtatataaatgcagaatgtataggtgctctgctgctccttgtacttatctgagcttcagttgttttacaatttagattacaagagaaaagattgtctagtaaaagatttcttattgaaatttacaagacaaatcgttggcagcagagtagaccactggtgcagcctagccagtttctggttattccatctgggctatttggctacatgggctgggcctaaagctcatatgtgttggttatgttgggctgggccaaaagatctatgtttgtagcatctgtagttatcaggcttcaagtagcagacaattctcctgtcctgtgtccatcctctcactttcagcttcttttttaaaataaaaaaaatcacaaacaaatcactgagcacttgtgctagtcttctaaattaacccactatgatggctgtcctgtcctttttattggcagtaatcaatagtacatgcatatccactctacaatagacaagttcgtctcttttactaactatttttaatctcaccatccagacagcttcataaagctaatcatttgatgttcaccacctgttcttgcaagcccaactaaaatttgctacagtattacctgtaaccaacatgacctcaaaatgatggttcactatcaatgtttacagttcatgtggacaaaaaaatctcactgagagaaaaaaaggtattcttgcagccaaacatgtgtggtttctcagaccaaccacatgcctagttcatcagcaagatttttttcgaaggcatgcttttaaaaaagatcactccaattatacatccaaagtaaaatgtactccgtaagaatctacaactcttatcttcttttacatgtagatgtgatcactttgatcccttttttgggtcaaaaatggcttgatgctcacctagttgccaatatggaaaaccaaacggcacacctagccggccagttgctgtttaacaatgactggaataaagctcatcagcatcatcttttgtcctctcttttttttttaccttttaatttctctccagcatgccccatcatttggagccctgtgaggcctcaacatcttgatgatgttgcaacatttgcatcaagtgagaaaaaaaaaagagaaatgacaaacagggcaagtgttcatatggaacaagactagacttgagactttgaagataaccttgtggccttctttggctttggtgtgccaagaaatcaacactggcccagcggttgtacttccagacccagccagctgaatgtgaccatcagatgcagcttctatgtcgtcatgagttggacaagttttgatttttttcatggaaaagattgagagtattgaccaaattgtatgtagatatgtacgccgggtccaaattcaagtctagcctgcacccggatttttcatcgtatttgactaccactagatggaaatggagggtgccgcttttatgttttggggtcaaccggttctagaactgaattaaatattatgtgacaaggtttggagataccatgtacgaaaagagtatgggtaactaaatggtttgtcgtcttgcaggagctatttttttcgattacatggaagacgcatcatgcaagggcctttttatggttcttgtgagtgtgcactcagatggtaagtaagatcagtgaatcccaaaaaccctggctaccttcaaattgataacatggaaaaagtacagatcataatgaacaaaatatataggtgaaatccagtaagaaaaacacacacacatattcctaaatgacaagttgacaacacgacagggagatcgctgttgtgtcaaaaagagagagttgaacggtggtgaaaaaaaaagagagaaagaaaatgatatatttgcagtgagaatcgtggtctctgagtctccacacatgcacacacaagagtagactttgcatcgctcacaggaaaaccgaaaatgatgtgaggaggagcagatgagacggattggagtttggaagatgcgaaaggatcacataatttcatacctagacgtttaaaagacttttatgtgcacttgtcacctcaactttaattttctttctttttctcttttcttatctagattgcagagagatggctggctgctgcttacataatctattttggctgaaataaatggatttgttgccatgtccttttttttcttcatgatacctgcacttctagatggaagatgtcatgtgtaagttctcttactgttcacactgaaagctactgcatgagaaagttttttttgtaacctccaatcaccttcaaaataataatcatgtcgcacataggaaaagtttataaactattgtcctacaacaactatagtttggacagaaaaaaagtacgtttttttttaatttttgcaaaacccatcaaaggattgctaggcattaatttgagctaatacaagttagtagaacagtaaaataaatgaagatatgttaatcatttctacagtacctctgaattcttaggacatactcatgttgctgtttactgctcctacaccaactttggcactaaaaggaagaaggattagggattaggaattcgtggcctggtgtgatgtcaaccaatatgtctaacattatccagccattgttggctgtcatgggtacacaaatcttatgcatcaagtgacaacagatttcagttagtgctcaggataggtgtcctatgtgacttcaaatctaggctttttgggcactttgcattcacatgacttgttcttgactccacacctgaaagttgaaaccaccacaatctaattcaacagttaatctgatttttttttacaaaaacaatataatagtttgtatggacaaatctgaatatcatcctggtcttcagagatttgcagggtcgccccaatttcagcgacaggtaaacgctggaggattgaggaatgagttcatcttcctccttcaccttttgtgctggtttttgtttcttttttccgccgttcaaaaagagttggcgcgctcgctttgactgttctgtcctttaatttgctttcttgtttcttattttcttttgttcgtgttggtgatgactttgcagtactagtatcagtttagtttggattgattaatcaaaaggacatcataaagcaatctgagcatggctggccttttgaatcagagcagctctagaacttttgctctcaaggtcaggtgtgagcttacttgttaaaactgtccttaaccaattgtattattattatcacttactttttttttcttaccctctgaaatctgaccatgatctgaaactatcttttttagataataatatcatgatctgaaactgttggccagagcattgacaaacaggagaatttggcctcagctgatgctgctgctgatcaactgaaacttgttcttaaactacaattctgaactgaacctgatgcaggaaggaatcttgccggctcaagtttcgtcattcttcctgaaagaaacaacaaagcaagcagggcttaatgcagataagagaacacgcaggctttggttgggttagaggcatcttgattagttataatctgatgtatgaatgactccaaaacatcagtttgttgtctagtgcagaaattgcgctggtcaactccttaatttcatatctttaccttccaaccggcgatcagagaacggctattatcaacttgcattagttaacactgactagtaataacctatggtgattaagcttgtaaacaagaatgcaatggagtaaagtaatgaggatggcaggtgaagaagagaagaggccagagggatggattaagcaagaaaagacgaggtgattgaatgattaaaacaagaagaagacaggcaattgccggcatgtagttcagtgttgttgcctgcaacggtagcttttcccgccttttaagcgacgtttactgctactacagctcactctacagtattagtatctatacgtgagtgacctgtggtaaattcagcgtaacggctataacaagcaatagcagataaaacggtaaaaggacaattgcttgttatagaaagccggatacgaagtgtctgatcggttgagcacttaagcagttaagctaggctggtatgtcatagaaaaacaaacaaagatattaaaaataatttatagataaagcttttatatttatattcgtggtttaaaagtcaatgctaaaaaaataaactacggtgaaatacaataaatcaaaattaagtttaaaaattctttggtcactttgattttagaaggcaatgccattaaattcaaatacattttagaaattgacatcatcaaaagatctttatttctgaaggcgttgttccaaagtatagcatataatcccgatattctcttcatgattgtaatagagcaaaatatcgctagacaacatgacatgttcatgttacctactacggtttttcatctttctttcacttttatttttactgcatgtgtgcatccttgatgagttgatgtaaaggtgtaggatgtttttattgactaatgaaacaatccattatctataagaaaatgatttatgtacatctcaatttaagtcatggttataaatacttaatcccaccatattaatataagtgcaaccttgtatattactgctctgttaaaaaaaaaaacctaatcctatagtccgttgtatattaatattggaatgtgggggagtagtacgtttttaggcatcgacgtgaagtacggattatgtacttcggagtgttagacgggcggtttgatggagtgatgtagaaacaggagaaaaacgtttgggacgggatagcaaagcgtagggcaagtgccagcgtggaggtcaaagtcaaagagactttgcttgaatagccgtgctggcaacggtatgaaagaagagctccccttgtctgtttcttctcaacttgcaagaaaattcttacagtaaagactgcacaagtgaagaggatggcacaagtgaagtgcaggagatgacactggggccctgcacctgcactgcacatgtgcaatcatcatactacatgctctccttctccctctttctctttctgaatttcttctaatttctctgtttcatagtaacaattctcaaaatttaacttatcattgttttagttcgactactcttgttttataaataaatctacaagtaatattagtaaagtatgttacacggtaaatttaaatatattagtcccatccaacttgatcgaacggtttaaaagatatcagtggtcaattaaaccatttgtttgttagttagttagttaatattgccaagcactattatgaaatggagtcagtagaaaaaaacactactccattggaaaataactcatggccattttattctttttttcaaagaaaataataaagaacttagggtgatattttaaaaacaagaatactccattcttgaggtgatgagaggaaaacaagcaatggtgtgcaacccacagaaatcatgggttacctactactggccactggcagggccagggcaggcacattaggaaacaggggctcatcatcatgcccaacccatgctgcttgcctccctgtctccctgcctctaaatatgtcatgccaacaccacataaatatctactccttgagtaggttaaccaaccttaccatcataaactagtataattattctcaactcaacaagtggtccatcaacacatggctaaccatgtttcttctgtaaagctaatgcttgactactttgttttaagttgaagtgacaattaatatgagttttagtccaaggctttgtttggaacttagaaattttcaagcatgatttcagcttcgaataatacaaattctttgtatatatctttactttacttgtagttagtacatatgtagccgggtgtatatatgtaaaaagattaaattcaaattctattttcaaaaaaaaaacaaatcctgataataggggggaagatcaacttgcctccctggcttatagtttagtctttgccatcaataattgttttattgggtaggaaaaagtcacagttatggacccccaaaatcacaattaatcttctctaatacgcccccataaactttgctcttcacgcatccaaagtctaccactaaataaaattataaaaatgcatggatgatttcatggccactcaagcatctagagcttgcacaatagtccactttattgatggcttttggactatggaattggcacaaattgtcaaatagagtattttcataagcaacttttggactatatatgaactcccataaatcatagtgtacttttttttctaaattctccaaatgatctgtccaaatagtaattaattaaccgagttgaccatcacacccttcatgcgcaatgagaataatgaagtcattagtagtagtactggtagtatattaatgcagccgacgagactaattactcatgacccgatgtgtacgtcgagacggcttgatatggacggctccgtaaacctcattgtacgtatgcttcttgacctaatcaccattatttaaatttttctctttttttgttgttgtttttattgttaattctgccgtagatggactgcaacttgagctaaattgcagtcccatttggttgttgatttggataagtcgtctcctggtttgtgatgtgtttctgctgttgatgtcttgatgaggtgagagattctttgagcaggtacattttctttaattgcaagaggtagaagaacacaacacaaaaacaaactcttttatgattttagagaaaaaataatacaaactatttaatgtacaaagctgatttcatcccaacaaactctgaaagagaaattaaggcttcattttgccatgaggttgttctcttaaacccttcattaacctgtcatgcaaaggggatgtgtcaggtgatcatcattcgtaatgcacatagaaaaaattatccagagcttttaagtaagaactagtaactgcttgtgttcaactatttgtgctgatgtttacactaaacaaatggttggaagtacaatgttttgtgcaatgatcagctgataaagtcagaaggattacatcacatttgtctggaaataagcccggatgcatccttcgacaaaggtatggagggtatcctcaagggttcgacagtttacaacggctactgcaaaccttatcatttggcagaaaagtcattaggatggcatcacaaatgatgccaaaatccatgtgtctctaacagttgataatatctatattttcatccgaacaacaaaatagctaaaatttatggataatccgactcctgtgatagctatttgaggatatgaagtaatgaattagctagttgcaaagttggaaagttgctttagaaaaatattctaaaaaaattatatagaaaattttacacaaaacatgacgtttaagagcttgggaaacgtgcaaataaaaattcagaatagagatttactgaaaaagaaaaaaatacataggatgatataattactgaaaaagaaaaaatacataggatgatataacatgacctatccagcatacctagcataagtttttttttttatgttttatttgatatagagaaattatatagggattttatgttttcttgtaaattcttgctcttgcgttctaaaagagcccttatccaggtttcaagaacacgaaatcagtttaagcctcagtgctctttcagtttaaccctaaaccctaaccctaaagaacctgctgggcaaagttgaaaattcaaaggtaacttcaaatagagtacagggaaaaaaaataatagaatttgacccggaataacaatgttgcctggtacaccggtcagtttccagctcccggacttatttttaataattcttgttttgacaggaaatagtgacaatagtatcttgcatttcaccctccagaaatcaggtgacaagattgcgcaaatttgtttgcacaatgcaatagaaatattatataagggttttatttcactttgacaatcacattttcaacagaaaagcaaccacgaagcatgactgccagagagaatttcggtggcgatgaacaaagaaccatatcatcagttacaattgtcttccaagcaaagaataacacattaacaactagcacacttcctctaccactatgtcatcatcatcatgcatccaaggggggcaaagcaccgaattaacagtgtcactgaaacatgaacaagaaagaaacaagaaagaagaacaaatccctctcacaaacacaacctccacagcaattttccaatctttccttcccacaagcccatttaatcatcatcataccctcccccttccctcgccggaatcggcaaccgcactcatgccttcccctttctccatgcccagcctcttctcgtcttccattcccttcagatgcccagcagccttcagcgccccgatgttgctcacattaccaaagatcagaacaatgatgccgaggaagctgcctaggaacgcagcagcaaacgatcctccagcacgcccaggcccagcggatgcagcagcgaagccaatcatagcaccaatgcagcgtacaaatgcataccacaccgcaaaagcaccctccttccctggtggcgaggcatcgagcagcagaatgcgaccaaatgagtacagcacaccattggctgtgctctggacaagagcgatcacaatgatgtgagcggctctccacctgtggctcttgaagtagaaaccagcaccagacacaaataggcagatgatgaacccaagcagctgcatgcgaacagcatcagcacggatgatgatctggattgggtgcagcagcggaagtgagatcaacgggaacaggaagtagagtatccagagcacgagcacaaggactggcttgatgcaaacaccaccaatagcatacaatgtgccactggtgaagatgcacattgtggcgaaagatgaaaggaacactgcaaccaagcttccgatggcctgtgggtatcgcacaagggtcatgctgtagctgagcttggtgaagaagttaggctcaaatgctgtggtgggcgatgagctgctgggtcggtttgtgaagagaccatggcagataccaatgaaccagataaggccactgaagatggagacgacccaaaggcctgtgagctggtcagtgcgccgaagcatgtggtacatgaaagcagccatgagcgcagccccaatgccaccaatggcagtgcaatacagggtgagctgactggcagcagcacgacggcgaaggacaaggtgcttgccagagtcatgtgctgcaaggccacggatcatgagtccaagattgcgtgtatgcacagcctcagcaacaatgatggatgcaccaatgaacaggatgtagaagaggaacacccagactgtcttgaagaagccagtgaggaggcagaagaatgagccaaacgatgtcgcggcaatgaggatgagcgactgatactggccacggtcaaggtggtgtgcagcctgggtgaggatcggagccgcaatgaggattccaatcgcccatgataggccactccagcccaacggggacagccgggatccatcaatggcaatcgaatgcttggtcagcctctggtacctgccaacatttcacaaacttggtgtgaccatgatggtttggttgcatcacatgaacatgtacaggtaaacattgcatgctatgaaatttatgcagtaaaagcttccagggtgtacaaacaatgcgtgaacataaactgcaagaagcacatgcattgcctgctgaaagtcaccgtgctagaattccaggggttcataccagattaacccgttaaaagatggtaacttttgtgtgttgaggtgtcaacgttgacacatttaagtagcatcaacaatctcccttgcaatcaagggcagttagttggcctgatgcaatttaagcatgccatactgtggtgcacctaccagttggctggtcatgcggctagccctcaacagcatttggggttaaaggcaaaattgcaacggtttaggggcctcttttcctgttcaaaagagaaaaaaataaaagggagggaggagggcaggccaaagagaataggcaaaagcatggccctgcttttgcgcactctttttcttggttctatcaaaagtgagacaaaagcaatgtaaccctcagctacacaaactagatctatcagccaaggaaatgagctactaccatctccaggggtatatggcactgcatggatcacaaaagaaattttgcagtactactagtagttgaaatgaaatatggctagttatctgaagcatggaagcaagtttcacaggccatatttaatgagacacacaggcctcggcttggggtacctcataaatttcatacttatggcttccactgtccattcagtactacattttcgatctcaccacctaatgtttctcaacgttcggaagatttttaaaacaaatttacaaaggcacccctagggatttcttgtttgaccttatcctcctcccaagaaatcttgtctctcacagtcacaagagcacagctagtagtagtacaacaaaaagaaactgacaaaaaaagatgcagttcattacgtgtctaggtagagaaaatctcaggaaaaacgaaaatatattaataaaagagaaatgtgggatgtgggaaatagcctcactgaacaatatctaggaccaaacagtagcatcttttggagctttgcacaagaatctcttatctgctaataatggagagcaaagaaacatggaatctcaggaatcacgggctatttctttttaggattttgcatatacgccacatataaagtgcagcccggaaaaatccaatctttgaagtactatacaccagtttattttcacatttggggtaccttgaagatgtgtgggtaaaagaggttaaaaaaaggtggagtagagaactacgagtacagatcacaagatgaaggacgatgtaaagttaaaacgagctcaaaactttcaaaccaagaacaagagcagagaagagactagcaagaaaactacagagaaaaaagagtaagtttttttttcctaagtgcactatgcctgttcgtttgatgtacaaaacaagaagcatattttaggaagacatcaggtggaaacttcaaaaagcggagacat

SEQ ID NO: 58466 - DNA, 1535 bp, Oryza sativa
tccaccctgccttgccgccgcctcgcctcctccgccgccgcactccgttcgtcgctgtcgccgcccctccgccctacctcgcgctcgcctcgccgccacctctccgccatgcctcgcgctcgcgctcgcctcgcctcctctgccacctccgccgccacccctccgccctgcctcgctgtacgcgtgagagagaggaagagtgagactgagagtgagagaagagagagagaagagagagatgaagagtgggagaagtatgataggtgggtcccacatttttttttataaatagaatgctgtatggactgccacgcgtacgccacgtagatcaaaaccaccgcggattgggtcgaggggggtaatttgtccggtttgtatagttggggtgaagaatgtccggttttgtggttagggagggtaattcggacgaccgcgatagttcgggggggtgattcgtactttttccaataaaaagttatcatagcattaattgttatgtatatcagccttgtatataaacatttaaagatcattgattggatatttcatatttataatataatatagtttaactacgtatatttacataaatttgtagactaatatatttatatttaaattgtagaaaatattaagaccatcgatctatttcagtgacagtatttttttgttttattgtttttatagtattccgtgcgtagatttttcttttcttcccatggacagtactaagaaacctttatttcttttttccagttgtacataagtacggcatacttatgattttttgtctttttctagctgatagttatatagttcatatagtaataaggtatttctttttttaaataaaataaattagagatctaatctaatggtataaaaaattgggatcatcaattttggtgaaaattgacggtgatatctgtttaaatttatgttgtcactagcaaaggtgcctgtgcgttgcaacgggaagtgtacagaaaaaaaaaaagagaaaaatttacattatgtaattaattaaaatatttggtatttttaagtaggtaggtgtataattaaatcaatttacaagtaaagcacgtctgcaaaataaaatgacatggttaaatttaattttattaaattctccattattagttacgctctttgaaattttattggaattatcagagcttaaattgctaatttttaataatacaaacatcatttaacaattatttaattggaaaaaaaaatcaaaatccacctttctatgtttgggccgaatatagaacagtttatatcccctcccttttgtctattcaatgtgtctggcctgttttctttctccattgaagtccattttgcgtcctccattcggtggcccaataggccggcggcccgatacaggagctgctggagccgttcgatcgaatggatggtccagattaatcctaacctaaataaatatacccaaaccctaaccctaaccattcactccccctggcctcccgcgccgcccaccccgagcgaagacggtggcggcgccc

SEQ ID NO: 58467 - DNA, 36683 bp, Oryza sativa
caattctacggtctttaatagcaattctccggtagatggcagagatcgagatggggagggatcccgagtggccgcgtggccgtgtgtgtgtttctttttttacttttcctctctgattcccacttgcgacgaaatatcggttgagatgaacctgtccgtgttcttacctgttcttgtgatcttcgtgtgatctgatttcaattttttttcgcccttctcctgttcgttttcttgtctgttctggcgtcttcgcggcatgcgccctctcctgcgaagcgggcggtgggagaatttaggggaaaattcatgtgcgtagagaggtcaagaagaggcgcggcggtggccaacctccgacgagtagagaggcgcggtagtcggcggctcaagagaggtgcaacctcatcttttcacttatacttatcaaccaaactttaaactttaaatttaaagttgattttaaaatatttttcatgaaaatttatttttcaacatttgattttaggtcactaagaaaacgtacataaacgttttattcacaaattaattttttatataaatataccatttgacttattctctcaagaagtatgcagtggagagaccgaaaagaaagggagaggctactcacaatgaacatgacatttttttatttttatttttactttgatgactagattgccaccatatcgtcagtcagatgaaaaccacctcattctcattctggaattagcgatgtaaattgagcggttttagaagttgagggtgagttatattcggtttttgaagttgagtccctaagaaatgctgtatggctaaactaaaaatcatacagctaacaaacactgtagttcagaaaaaaaaaaaggctagaaaaaagttacttaaaccgtattagcttaaaagcatggcactaatcgatatatcaattagctgtttgaaacacgcactgaggctaaacggcagcatcatatgatcgatcgtacctgtgatgacggcgaccaatccccgggcatcgatcccggcggtgacctcctcggcggtggaggcgccggagaagccggagggccctttgcggttgaaccgccacatcgccgactccgtatggcgtactggtgtttgcaagctgagttcagcttcggcaccagatggcctgaaattatatggtcagactctgacagtgataccatgtgatgtggccacagcagtttcagcttgttactctaccaaagtactaaagatattgtttttatgccaaaaattcccagaagacttcaataagataagaacaccacacacagccgatgaacagagcagagaagtaaagccgaggggggtgctggttttctgttcagctaccaccacatccgcggttccggcgagctcttggaatcaggcgtttgcaatccaagttggggctaaaaatactactaatgttaatgcatgcctctgagcctctgacagtcacattcatagcatatgatgtagtacaacgaccggccaacagtaggctccttcggaatgcagattgaaaaaatataggaataggaaaaacattagaatatgataaaaatgtaagtataaaacagaggatttgaaaacataggaatttcatgtgaatatgtgtttggatggagtaaagtaaaaacataggaatctttaagaaaaggtgcactattacaaaattatcacatgctactagtaaattaaacaacattaatcaacctaatagtatgctttagttgcttgatggcatgatttgcctcgttcccacgcggagggagagaaaaaagaggtcagcgtggatttttttttcctgtgatcttccactgatatggctagcgcaggaattttccctatgtattttctacgaacgttttcctgtgatccgaatgacgtcacagtaaagtaatccataggaaccaaaatcttttatttttcctgtgtttcttctccattccgaataagctctagttcgataccgtacctccctccattaaaaaaaatagcatcatcttaagatgtgatatattctaatataataaatttggacatattttatatctagatttatcgtagtgtatgtattaggttatcttttttagatggagggaggaatgattccattttgcttccaaaaattcgcttgcagaatgctttttaaagccggattttttttctctctggatttgcccaaggtatttggaattcgtttttttttccgtaagggtgcttctgtttagctacagctaagctgcaggtatgggtcaccaagaagaatagcagtcgacgttatctcagaaattaataatgatgtttgcagtatggatgagcaactgcaggcgatggagacgccaatatgtaccgaaaatttgacaatccggcccttcttaaaaactcattataagagtcaactgcgctaaaaaacttattcaaaaaatgagttagataaaggttgaacatcatctaggctgaaagttgcacaacaatttaacatgatagaggctagcgctagtagggatggcgctaacctatgataaatatagcaaatatgtgtcacctctcggatgagatgttagcgtcaaaattagtggcgctaagatgttggatctccgcgtcgaacccgatgatgttaaggtcctgatttctttttggcatggttcatttttataataagtttttgaaaaagtcaaattaccaaattttaccttcttacaatctgctaagcgcctaaaactcaacatataaaagcatagtaattatatgtacatcctaaagcctaatttacaagcataccacaccaacccactaagtgcttaaagtttaatatggaaatatagcatattaaatctaaaacttaacatataagcattctgaatcatcattactcacattattttcatagcattttagctcaattccacctatcatttatataatatttaatatatagtagaaaatgtgccaatgtgttgcaacgggaagaaaagacgagaaaattgagcaaaagttgagaaagatttagattatgtaattaactaaaatacaaattttctggaatacttaggtattttttaattaggtaggtgtagaataaaattaatttacaagtaaagtaagtgtgagaaataaaatgacatggctggatttaattttgattaaattattcgtgattaattacactatctgaaattttattagaatttttagagctcaagtgctaattttattaatacaaatatcatttcaacatttatttaaataaaaatataaataaaaaaccattctttatctctgggttattttcagcccattttctttctcagcccgcagccaagctagcctgctttcctcccttctccttccctccgccttggctcacaagcatgcatccggcccaacaaacaactgaaagtctaatcggtatccccttttcctcctctcattgtcgcgtgggcccattgctaaagtgttatcccttaccttcgttcagagtctctcagctacttgacaccgccggaagccgtctcctccatgaaatccgattgagggaattccgatccttatctcattctttttccattttcctaagaatcgaagcaaatccgcttcgtatcgagctcggaatcgagccctaccctaaacaagcaaacacttttgcttaaaaaaaatcaattagtgtgcagatgacgatgacgatggacaaaataattccggaagtcttacgtattttttaattaggtatagatagatggatgtagatatagattcttccatatatccgtaacaaagcacgtgcgtcatagcaatagattaatttaacttctatggatggaaagttcttatgtcaagggtaattagcaccaagattggtaaaataattgtctgaatgaatttgcaggcaaactagtttgacttagggaatggtgatgcacacaattaaggttaggttgctccaacctgagcttcacaaattctgaagcaagggaaggggcaagcaatcactattcaccgcccattttaagtaaaataatattttaaaaacaagttggacacaagaggagaagcttggtgtcgattaaaagaaattttatggtacttcagaaagtacatagagtattaagattttacacattaaaatacctagtatctagagatattaaattttacactagaaaatatgatatctcctgtaccttgtgaatggttaagaatgataaaattatctgtcaattaatcaataagacatgtgaatgtgagtcaaacatgagatcctaggattgaatccacacacatgacacacctagcactatactagcaatggcacctcaaaagaatatctctagtccaatacctcagcacaagcacgttacatctactcagtgtttatgtaaattttaggaaagtagaagcactggagtgttggtccatgaagcgtaaggcttacataaagaggtgaggtgggcctccaaagtccaaacattagtttaagaaatacatagccagagccagcccatgattataggaagaacttctaaactaaactgaggcggatatattacaattcagattgttctaactagtcttggaggaattgcacggatctctttgtttgtttatgtgaaaattttatgttcaaacttgcagaaaatagactgtagcacatgatgcataacacaaactataatttgatagccacatcaagaggacacaatcttggagctaaattcccatagtttatttgccaactctgcatttgaagcctgtgagcttggggtatctaaattgcagttgctgaagtacttcccacttatcccggtgaattgagaatgtagtgccacataacatgtcgttgcagcaccctatacaataaaaccatgaggttagaaacacataatatgttccacacctacaacgcacgaacatatactttttttaaaaaaagtcacctgttctacagttttgtgtacgaatcttccaatggacttcactagagctgcaagagagaaccaatgcacaagaacagttaagaaatattatatttataagcagcattgttcgttgtgtttaccagtaatcaaaatggttggggatcatcctaaattggcattatggagtatgtgcttcttcaagtactaattgttccaaaattctaattacactccaaaattttgttctgaatggtttgggaattaccatttataatagtcctgtgcctgaacaggttggttgtaacaacaccaggatggactgcattagccgaaatgttcacaccatcttcctgttcatactcaacggtttcccggttattctccattgatttgacatataatatatatgatcagagattacatacgaaatttaggcataagctactaccttcagaactcgtgacagctcagttgagtgcaaaatgttggcaagcttagactggccataagcaataagactgatgaatctggtaagaaaagttaagtgcttaatattatctaataagttgagtgcatactgcgtaataaatatacttatctttactaattggagctcccttgataaggggaccttacgctaatttttggatgataaaaagccaaaaattcttatattaaacagtcaaaaatttaacattaattcaaagaaaaagaatagatcatccagttctcccacagacagcaggaaatcatctccttgtgcactacccactaatgtaaaattgggttgtttttgttattatccatatgatatctagtatgtgtcatatacgaaaatggggtgtccagtcctaatttttagaatctcagaattaattaccttgaaggctccttcaccttatcgaaacatatccctttaggataggtcacaaaatgtgctgaagacgacacatttacgatccttccttcaacaccagttttgctacttgtcctcttcatgttctccagcaagagatttgttagaagaaagtggcctgtcattcaagtcaacagttagtgcactatgagcatcctctcacaacccagaaagtctcaagaattaaccaaatcactcaagcagctaatccgttaataagattgagatgcatgaagaaatgctgtgtaatttctcgtaccgatgtgatttgttgcaaattgcaattccaggccgtcaatggagcgtgtgcagttccttgtcatgattccagcattattactgtttataaccacagttaaaaatttattatttaagttgacaaaataataatactccatccggcttttaatagatgatggtgttaaattttgacatgacatttgactttgttcatcttattgaaaaaattttagtacaaatataaaaaatatgagtcaatccttaaaagttattttaaagtgtacaaagtttttcacttttcttgcttctaaggattgttttttcttctgctatactcaatgaaaagacacaatctagtgttgttttccctaaaaaaattattttgatggtaaaacaagttataacaaaataaatggtattttaaatagataaatagtcaagcgtcatgtcaaatgtaaacggcatcatctgctaaaacaaacggaggagggagtacatatagaagaagcgttcagattcttgctcttacatgagtatgttgagaggtaggttcagagcctcaaactcggtggcaaatctcctcaccgaatccatggagctgaggtccatctccagcacatggataccggcgccggggatctcagcccggatcgcctcgctggccctgtgcccggcggcgacgttgcgcacggccatgacgacgcgcacgccgcgcagcgccatgacgcgcgccgtctccagcccgatgccgctcgacgcacctgcagctcatcagcccactctgaatttttctggccaacgtcgaaaccgtgagctaaatggcatggcagcagaccagcagcagcatcatattcgtacctgtgatcaggggcggagctagtatagctaagggggtgcccaggaactggttaaaaaaaatttaactatagcttatttattttcaccatatatataccccgtcagtttcactcatatcaagctaaatttgattcaaaccagagtaaagcaagcgagtggaacccctttcattttgttctagctccgcccctgcctgtgataatagaacttcgcaccatctttgcgcgagtcgttcaaaaaaaaatcatatccgtacctgtgatgacggcgaccaagccccgagcgtcgacgccggcggtgacctcctcggcggtggaggcgccggagaagccggaggggcctttgcggttgaaccagcacatcgccgactccgtaccaagctggcgtacgtcgagctcagggaatagtggcgtactggtgtttgcaagctgagttcagcttcggcaccagatggcctgaaattatatggttagactctgacagtgagagaatgtgatgtggccacagcagtttcagcttgttactctaccaaagtactaaagatattgtttttataccataaattcccagaagacttcaataagataagaacacctcacacagccgatgagcagagcagagaagtaaagccgaggtggggtgctggttttctgttcagctacagctctgtgggtggctgggtgcaaaagaataatgctcttcagcatgctacagacgacagtatggaggaaaaactgcagccgatggcgatggagatgctgatatgcattgacaaactagaaaccgcttccaagttacaactgtagccgatggcaatggagatgctgatattgattgtcaaatcacaaaccacttccaagttccaggtgtgccaatgtcaaccggtggacaaagtatatcaaattatcattttttttcttcaaagtcatatagtagtagtatatatctggtgtcccatcatttcttgtgagtaatccaattactagaatccaaatccaaaacgaaatactagtacattctagtattgagtagatataagagcttaccgttgacgaagtggaatttcatttctgaagaaaacgggtatactaactcagaagtatgtactggcttccaaaagcatcaccctttataacaattcttcttcttcactctacatccaatcatctatttggtgatttgagttgcctaaacctttgaaacagcattataaatgacgtacccatttgtcttaggtcgcaaactttttttcttaccagaagggaagcaaagcgcactggggcattgtatcgaacacctggcgggcacggacagacaacacaacggatccggcgggtcatacgctctgaagccggagcccggcgcagcggcgcgcctcctcctccgtccgcccgatcgcctcgccgtcgacggtgccgtggacttccaagttccaacgtctcctgcaaagagccacccaccccaccaacaggttaacagatggtggtcctcgacgcgtcgaggctgagtgatagtactattttcttctctcttttcgcctgaggagttcgctgatcctacgaaccctctcttccgtcgcgagcacccttcgtcgtcgccatgggcatcgccgggaaggagagaccggagacggttctggttgtgctgccgaacggaggaaaacgccgagacgtgtgcctcgccttcttcaaacgtctcgccctcgtcttttcacttatccttatcaatcaaaatttaaatttttcaccttaaattaagagttaattttagagggtttttttatcatagtttattttctagtctttagatttagatcatttagaacacgtacgtaaaagttttatttataaattatttttatttacaaatatgatatttgacttatttcaaactatggggctgctcatctggttgggtcaaaatcttgtttgacctcggtataacagcctcgatgtcggcccatgaagtgaccggacttcctccatccaacctaaaatataaggtattttgataagatgagacatagtactatgaatttggacggtgctatattctagtattacgaatttgaacactaagagtgcgttcggtggtaagggatgggaactaatctctcccacataaaaaaggagcgattcattagcgcatgattaattaagtattagtttttttttgaaaaatggatcaatgtgattttttaaaactgtttttttaaacaactttcgtatagaaatttttttaaaaaagcacactgcttaacagtttgaattttcaaaaatacgcaccgcttaacagtttgaaaagcggtcacgcgggaaaaataaagtgggttctcaactagtcttgccaaacgcagcctaaagtatgttctgtccaatcagattatcagaatacgttatattttagaacagatggagtgcgtggtgaggtgggatgaatctccacactaactaggcaatatactccctccatcacggatactcatcggttttgacccagagtaaatgatgtataagatattattggtaaaatacaatttttatgcgaagttaggcaactcaaagtcaaaacagacttctttttttaatggagtataacagagaagattcttgggaggaactacactctctttatttgtagactttctatgaaaattttatgttcggcttacacgaaataaaatgtagcgcatgcatatatgaataactcaaactacagtttggcagccgacacaatgttggagctaaattcccatagtttcttggccaactctgcatttgaagcctgtgagcttggggtctctaaattgcagttgctgaagtacttcccacttattccagtaacttgaggatgtaatgccacataacatgtcgttgcagcaccctaaaaaataatatcacgaggttagagtcgcctagatgttccacactacaacataacaacatatataaaagacgagatttttcattttttttaaaaaaagttcacctgttctacagttttacatacgattcttccaatggtgttcaccacagctgtaatggagaagaacaattgaaaatggtataatggtataaaaggagatgcattcacaaatagcatcatgtgtttaggagatgcaacctttccacgccagacagcaaggatcaaaatgtttgggaatcatcccaaattaatattttgaagagtatgcttcttcaagtactactaatttattccaaaaatatcttcaacaattttgcattgaaaggtctagggattaccattagccatagtccagttcttgaataggttggttccaacaaaaccgggatggatcgcatttgctgaaatgttcacaccatctccctattcatacttaacggtttccaacttatgattcatagatttggctataatcatatgcaaacagagacaacatacaaaatttactcataggcatgcttagcaaataagaacactaccttcagaattcgtgcaagctcggtagagtgcaaaatgttggcaagcttggactggccgtaagcaatataagtggagaatctggtaagataaatcaagtgcacaataaatatatttatctttactaattggaggccccttaattcctcatgttaacattagaatgacaaaagctaaagttcttacattaaccaataaataaaaggaacagattaacataaaccgctggaagaaatattttcttttaactcaaggatggccgagatggccctcctgaatgtattgattcttaaatgtaaaagaagaatgattttggtcatccaattctctaatggatgacaggaaattacctccttgtgtctgtaatgtaaaacagagttatattgttaagaataatgtaaaacagagttatattgttagaatcgacatcatatctatgctccttgaaatgcaaaaatggcctagctagttagtcctaatttttagagtctcggaatttattaattacctcgaaagatcttttacactatcgaaacatatcccttcaggataggtcaaaatgtgccccgaagacgacacatttatgatccttccttcgacaccagttgtcctacttgtgctcttcatgttctccagtaaaagattcgttagaagaaaatggcctgtcattcaagtcataaaagcaatcaatccacaattaagcaatatcgagatgcacgaggaatgccatatgcaatttcgcataccaatgtgattagttgcaaaatgcaattctaggccgtcaatggagcgtatgcagtccttggacaggattccagcgttattgctgtcgtaaaagtaagtttgaatcagtatagcacaggttaaattcgctgttcgagttgacccgtgtttctgttcttacatgagtatgttgagaggtaggttcagagagtcaaactcggaggcaaacctcctcaccgaatccatggagctgaggtccatctccagcacatggactatggcgccgtggatctccgcccggatcgcctcgcgggccttgtgcccggcggcgacgttgcgcacggccatgacgacgcgcacgccgcgcagcgccaacacgcgcgtcgtctccagcccgatgccgctcgacgcgcctgcagccaggtcgtcaagttcactctgaatctctctgaccaaggttgcgagcttaattaaatggcatggcagcaacattggttgaatgattgtacctgtgacgacggcggccaagccccgggcgtcgacgccggcggtgacctcctcggcggtggaggcgccggagaagccagaggggccatttcggttgaagttgaaaaaccacatgggtggcgtcgagctctgggatatggggtttgcaacctgagtaaagttcggcatagattactccgatgatatatacatatacaggctaaatgctgttgctaaggtatggctctgacagtgatagcatgtgatgtggccaaagcaatctagtttgctactcttccaaagtactaaaagtttgatttttcttcaaaaattcgcagaataatttatttagtaagataaagacagctgacctgagaggctgagacagcagagcagacaggtactaagccgatgggtgctggttttctgctcagcagtatgtcagcgacaacctgcaaccacagtcactcgagcagagaacgcgagagagaatgaacacaagaacacgatgaactcaggtgtgttttggcgctgcgtagaaacgttccagcattttctctgttttttcttccttttattcagtacagaaagtaaaaacgtgggatcaagccgcgcgacgcgctccgtgcggactaagcgcacgtcaagctcgacatgtgcacgaccgagcaaatcgcagtcatgcactcgactggaaaacagaagagaacaagctaaaaaactgggggaggagaaactgactaacaggaaacaaatgaaagaaccaataaacgagctagcacaagttttacagctaacgagctatagcctacagatgctggctacacgatcgaagggaagcttgtagagaaaaccttctgatatcgtctcaagaagatgtttctcgtcacgctagctgcagtctggaggagcaactgcaggcgatggagacgctgatatcaatatgcatgaacaaatcacttccaagttaattccaagtgtgccaatgccaattggtgatttaagtggtttgaccatttctaacagcatcacaaatgatgccatgcaccctaagaacataggaaaacaaacattccgaagagaacaaggtactaacttctaacttctttcaaagagttctactaatattctgaagaaacaaagcgcacagtggggcattgtaccgagcacctggcgagcagggacaacgacacccgaagccggcgcgcgctgcctcctcctccgtcaacccgctcacctcgtcgtcggcgcaaccacttcctcttcttcttccaacatctcctgcaaaagatccacgcaaagggatagtagtttcttgactctcttcgcttgtggagctcgctaatcctgttgtcgccgtcatggcgtcactcattgtgtcgccgtgtcggactcgcggagaaacgattctgcatatatgggccgtatctaagagcaaacagagcatgcctcgtttgtatgggccttcattccggcccatctacgtgaatgggtcggccttctagttcagttttccgggcatatacaagtggattggcccagaactaaggcccattcaaattaggcccaaggatttgatgcacaatttagctcagtaaaactgaacaaactattgcagaactatatactagtatttattaagaccagatcttcaaatttagcatcgaatttatcataaaactaagtagcaaatttatcacaaaatggtaagtttagtgacaattttaatcacaaaactacatctccaacataacggtaaaacagagaattgaactctgcacaattctcctcaaaaatcagtagaatcagtcgttttgtgatttttctaaagataatgatcagtagttttgtgatactgtcaaatctgtagttttctaataaacgcttaaatattttgtttaagttttgtgatagcttggttaaaggatatatggttctataaaatttactgtttttaaagaaaaatctctttacaccgaacaccctcaaactcaaaagtttgtcttcaccaaacgaaacgcaagttgagctaatacatgcgtgaaattttcgagaaaaaaaagagctaatacatgcgtgaatttttcaaaagaaaaaaaaaattaagaagaagagctaatacaccaagctgcacaaacgcgagtgagaaagcagcgacgaacgatcaaacacactctaggaatccttcttcttggcgtcgtcggcgtcaatggcgccggcggcggcggtggcgtcgtcctccttgctgtcgctgccgcagtagtacctgttgaacgccttgggcaggtagaacggcagcaggaaggcgaagaggttgatcccccagtaggcgaggttcgccaccgccagcaccctccccgccaccaccctgcggcgcgccacggcgggcgcgccgccgacgccgccgccgaactggtcccgcttctccatctcctggcggagccactccgacgccgcgaacatcctccgcgcgccgtacatcaccaccacggcggcacgcacggggagggagaacctcccgggccacgccgcggcgaggccctcggtaaagatctgcgcggcgaggaggaacgcgtgcggggacgccgcggcgacgcccgccgtgtcgcccgagcggaggccgtcgaggatgtagagcgccgggagcgcggcgccgacgaggaagccgagcgcgtcgtgggccctgaggaggaagcggccgcggccgaggaagaccggcgcgcccgggttgggcttgccgggcctctgcgggaaggcgaggacggagaggacgacgaggtaagggatgacgaggagggcgaaggcgatgtcggagagtggcacggtggtggagaaggcgagcacggccgcggcgccgaacgagttgagctgcttgatggagaagaggtagtagtggtggtgaggccgcgccgtcggcgacgtcggcgtcgggtgcagcggggggagcggcgcgcccgtcgacggcagcgtgatgccgcccccgcacgtcggccctacgccgcctgacatggccgccccgcgcgcgacgagagtgatcaaagcggtggcgcgccgcgcgcccggtgcggattccttcgcgctctggctgcgacgtcgcgttggttggcttggtcggagcgggagtaaagtgagcgcgggtgatgaagcgtaaggacaacaagtgcgaggtttaaggcgacaggtgccgcgcggcgtggcgcgctctgggcgcgtcgcgctctgagcggcgccgcgtgtcgcgctttgggtttattttacgagcgtggaggaggtggcaggagctcggctcccggcgcgacgccgccgtgacgtggtggcgtccttggctgtgtttgttgtcaaacgatgggcacaaaatcaatggaaaaaaatctgacaggaaaaggtggttaaaacggtacgtgttgaggatgggtaggagaacaaggttctagacacttgtttgagaatctccattaggctgctgagttgggtgcttttgggttcaccgatagacaggcttaggcctcacattccttagcttttttttttgttagttacgacttgcttgctgctaattgaaaggtcaccaattggtttacaacacaaactgagaaggggggggggggggttggtttgtgagaagagtttacaagaagacaatatgcctgcagtctatcagggaaaaggtaattccggaaacatctcacgtctcagccctcaacacggtaagcaagcatatgcaggtttttcacttatcacagacaggtcggcagttcatccagccaatccatatgcttacagctgagtcaagaaatgcgctacattgtggttggtttcaccaaagatcagtgcttccaatttcgaagggttacacgtacacgagttgcatcagagccgtccagtacctagagcacgacgggttcaggtgtatcgccctgagaagccacttctctggggtttgcatggtttccactagctggttctgctgggaagttgctgcacttgactgcgttgccagaagatgcatctggaaatagagctcagcaggcctcaattctgcacgacgaatcggaaaaaggtaaattaaatggtgaaatttcaagaacagtgtgctttgtatgaagccatgctcagacctgggggccatgagaaccactctagacgaaggtttttctcccacttggctttggagccaaggctgccttctgcttgggccagtaagagggacacaataggtaaagaagcaagtgatttctgctgtgcctttctgaggctggaagctgcacgggctataaattgaggggccgcgaacctccaagcaatgtccatacaaattgcgcctacaagggtaatgtttcagtcagcacattgtcaaaaataaacatcaagattgttagttagaatttattccgggctagtgtagagtaaactactaagaaaaataacaataaaacatcccaatttagttagtcattatagtaaataagtagcatgccaattaccgttgagaaataagacacagctgtcaggatccccttcagcacatgcctgagcaatagctttttcagcacttgcaaagtcctcattccatactgaacactgagcgcatgctagataaaaaagagacatccatttggatgcattgctacctttcctttcaacgcatcctccgagatgtatctctatttcatcaggggtaccctccagtgaacatatagatgcaagttgcttaagtattacccagccaatttcagtatctgtacggttttgcaggcatttcatgtactcactcctagagttcaaaagattgccttgcatcacataggcccgacacagttgcaagtgtgcaaagaaagaatccacgctcgaagaagttactccaagagcttcagtagcttgagcaatacagttgccatggtcaccagattgcaaactaacctctgaagccacaagaagtaacaagtagttcccatactgaaccaccttattgtcttgtgaattgctaccactggagagaacttgcaaaatcagcctcttcaaaatggtgcagatatgtttcggatacttttcttcacgtgctttttggaaaagggtaagtacaaggaggcgacgtgcatcttggttccacggttctagatgaacccacctgcaaagaaagtcacacacttagttcttttttaagactcatgccattttatttattaatggaaggtttagaaatacaaagcatgaatggttgttacatctcctgtgggaataagcataagagcttgtttagttggatagattgttctttggaaaatatgtgcaagattgttacagtcaaaccgcaagcttaaggtcaagtcacacacaagaatattagatacatggtaaatatagtaagagaagatgtacctttgcaggcggcatattgcattgtatccgcttaggtattgatcttcacatgttggaaaagagaactttgggtaagaagtgcaggtagcatagcaagaaactgctgcacatgcttgaatttggtgtggagatcttaagcccctattggatgtatatccccgggacaatgaagtaacccttactgctttatgagaagccatccaatcttcacttgacagtagcagagatccaagttggtttctacagcatgcaacgaaggaaatatagtgcacaacatttcgattgaagccacaagtctagaacctagatattaccagtgcatgcaagatcattaccttactaaactgcagtcgggatacatgtgtagaacctttttcaggtaagacaggccaccatcaacccttaaaaacttgtctgattccccaccaatctacaaggattatttttaatctatatcagcacatttatgctctagcacattcccaaaagaagcattttttcacatagaatgccaagaattttagaaaaccatacttacagcatttccaagagcaatatttgagtggacttcactcatgacttcatacgatgtaagcctaggaggcatactcagctggggtaactgaaaacgcttgtttggctgtaaagcatctaatgcagagataataaatttcagctgtgtgctgtaattgagttgaccaggcagtttatgaatgaccgcagctgcagagtccttcccagagatgttgtatgtcaacgtgcatatgaatcctaaagctgcagttgcactctcctgcttcatactcgataagttttcagccaagtttcttgatactgaaagagcttcatcatgccgaccaagtttccataatgaaagagcatatatctgcaatccgtcatcattcagaaatcctagaaatttgagataacttgttagcctgtgtgttggatagcataagaaaataacttaaaggaatttatttgccatgcatggcaattcaggagaaaataggaaaaaaagatccttccattgctacatgaaataaaaaaaaaaccttgtcttttcaattcttcgcactcccgcactgcctcagttgcaagaccagtctacagtcaaagcaacggttaaaggataactgttccataaacatttgtaaataatgtgacagaaaatgcaaacttattgcgcataaaacatttgaagtaacatgatctttcagctgcctgatatggatttttttttgttgtcatcaaagcggatgataatactcttaccttacatagtgaccgggcaagattcacggaaatatcagcaatatgacatctgcagtctgttttggagttgcgcatcatatctaaagcaaattttgcttgtcggtacgatgcaattgcagattggaagtctgatcgcacttcagaaaccaagccatttatgttgtgcgactcagggtaatgaggtgcccgttgaacagcttgccttacagccatcaatacctaaataataggactaagtataaggggattatgtgttacagggaaaagaacaggaaacaagtgtcaaccatgtagtctggtactctaaaatatccaaaaaaactgagcaatctaaagtagcagacaatgcacggacagctagtaacacttcgcatacatgacaccataatgaagcaatatgtagctattgtggtctgggaccataacagtagcatttagcatcagcaattagaacattaatgataatagagcatgtgataattgccactaaagcacaccgctgcgggaaagaaaggacttatttcaaccatgaagtaccttctttttttaaaatgtttttgttcttttttgcaggggaggggggagtttgaaagcatacctgaggtgatagaagttcaccagaacgagcagcaattgttccaagaccaatctggaactctggaagctaatacaaaaacatcgctataatgaaatcaaaacaaacttgaaggagaaaaactaaccaaatcattaatgttatactgacaacaagtatgatacaaatgaactatcttacaggaagtatctgcacagcccgcaagcagctttcaaaacattcatttactggcccatcccttgaagatcatgccaaagcgtataatcagcttaataagaaattatctgtaacaatatatgaaatcttctatgaaattctatgggagaaatacccaggctggtggtaattttcagctgacattcctgcccatggcaaggccagtgaaggatcaatgcttcgagctcgatcaaatgcttgtcttgccaactgcttatcacctgaatgcctgtaaatctgaaggtcgaactatcacttacctctcaattaatagaagaacagtcagctgccgcataaatagtactaacaccggttatggaaacatgtcattttggatttttttttaagttaaacttaaaaaaactttaaacattatttttaatatttgtattccatgtgtgaaaatcatgtgtgtagatttacctcgaaaagtaatttcacaatattatatattttggggggtttgtcaaatgtttcgcaaccaaaattagcagccaaagatgtattcatgtcaatgactaaaacgacatgtttttgtgtccggggggagtactacctttccaaggtatgcccaagcttcagagagagacatatcaagatgcagtgctctgataaaagaatgctgttttaaagcttgattacttgacaccgagcccaatgtaacccaaaaatccttattgactggttccagtatcaacccacccaacgacattttctctggcagttccctgttgtacacagaaataaaattttatcatgtacgcttgttaagaacagatgccacatgctactaagctattaatgtggaataaaagacttaccaagttatgggatctagactattattctcctcaatggtataaatgagatcaagacatatagcagtgtcattgtgaatattagcttcccagggagtgagatgcaaagctcgttggtatgagaattttgcaccatttgcagccaacaaacatgtatttctccactcaagtacagtagtcctgaaagtaccatcatccataccccccttgatattaccatcaccccatggaaagcatcttgcaagtgcgagctgacataaagcaagaaagcttaaaattataggatactgaaatttaaatgattaattaacagtaaaatagagaatacctgagcatctccatgcagtttccaaacacaggaaaggtttccagtcaaagaagtacaaactttggcagctttgcatgcttcctagaacaaactacactgagacaatatagcaggatatgtttcaattgaaaccaagactagtgtccaaataccttcaacagactagctgcccagccaaaggccccagtcattacacactgccttgcccaagcaagcaatgcagaagcaagaccaaagtacgcggaatgattttgaggagccatctccaaggcagagcggaactgttcaacaccctggcattgcgtatttcccaacacgtataagatcatggaaattattagcggtagcagcagtaaagggctggcatagaatttgcaatggtaaattatacatagtgctgataaaattgtgtatatctagtaatataatagttccattaagtgaaaaaaattcctacctttctaaaataaccaagcattagctggatgtttccactttctatcaacgcaaagaccttggaaccatccagttcaacagctcgcccatacgactgccagcataaactgaattaagcatattcagaagcctcaatatagtatactgcagcattcactaatgatgctaaaaaaaagtaacacacctttactgctgcagtaaacatgcccaaacggtggtatgccagaccgagtgcctaataccataatatggaatattaattacatacaaatagcatgcctgacttagatttcaccagcattaacaaaataaaggaaacaaggggaaaaaatacccacttcccataaatctgcacatgttgggtaacctcgtattgcatactgaaggctctgtatagcctctgaccatttcttctgatgaacctaaatgccccataattgtcaatacttattgaaaatacatcagtgcataatttagcatgcataaacaagaaaactatgaagaaaaatctagagatgttaaccgcataactttagctttaagcaaagcacatagtctacttgttccttgctccaggaaaaaacctacattttcctaagcaagcaaaagttggagattatagctgggcaatggacattgttaatttagggtttgttttgaagaagaacggggtgttctttttcctttgggatgatacaaatcctaaggatttggatcctattctccctatcaaagcaggcctgacaggctgatatagtcacagctttgattagagataaggctccaaaactaggtattgcagagatgcgaaatgtcaagcctaaactagccatgttgtcctatagatttccacatattctctatcaactaatccaaaatgacaggaacatgccaatacgccaatactatctgctagtatgaggctaaaggacgtgaaggaaggtgaataccctggtggtcatggcgtgaaagaaactggcactggatatattaatggcatatgaatggtattacattttggtaaatcgaaaggcatgcatatggggacttaagcttggactagccctagattgggtcagaatttaattatctcaacagtgttgggacttgggatcacagtaactaatacctgtaggctttgtttgggtgtgtctgagatggtgtgattgaaaaccagtccatatggatctattccatcgaatgaagccataatattttgcaaatttgcccctttaggtggagccagagttgatcacaagtattacggacatgattacttcaatcaacaatatactcaagctgtcaagcaactccaaccaaggatagatagatacctgtaagtaccccaacctccggaacgcccaaaatgcccggggtgacttgccagctgcctccttgcacaaagcgatctccaagctttccttgccctccaaatctagcaaatcacagaccgcctcctgcaccaaaccacacaaacagcatatcataccaaaacaccctcacaggcaaaagaacaaacaccttcgaggcacacgctcatatgcattccaacccaccccagcctcggcatcatcagggttgagcgtcgccgcccgctgatagcacttggccgctcgctgcgcgtcgccggcaagcgcataatggtggccgaggaagcggaaggggacgccgtcgttggggtccagcttggccgccgcgaggaagcgctcggccgccgccgcacggagccgcctcacctcctcctcctcctcgccctcctccctcgccgccgcctccgcgcggtcccataggaagacgccctgcacgcacacgactaccgcgtgataagcccgcaatggaggagcgagagccgcagccacggcgaggattcgtgcaacgggatgacgaaggttacgaggttgtagtggtggagcgggctggatggctcgccggcgagggtttgctccagctgcttgcggaggttggcctccgccgcctgaagaggagaaaaccaaaaagggtgagcgccagaggaagtgaggagagagatggagaagtgagagatggacagagtgggataccttttcaggcatatcgccggcgaggtcgggcgaccgccggcggcggcggcggcggcgacgacggcggcgtggtggaagtgggggggatgaagtgtggggaaaggaaacgaagcggcagggaggttttgcgatttagcccttccaattccaggtagagcagattggatcgaccctaccactacatgtggtgggacccacatgtcagtctgttaaaccctttatgttcctccatgaacgcgattaaaagaaaattgctacacatacgacctaactgtacgtgaactgtccgactcacgtacgatcaaattcattcatacatgagtcggacagctgagtcgtatgcatagcaattttggtagcatgtgtttagttgtacaaatgggtcatatctatagcaatactcaattcagaaacaaataaaagttgatagagaaaaatcatttctgctgtatcttgaaatagttcgtttttttctgtttaactaatgaaatgggtatgatacatgatttcatcattccattatcagaaatccagaaggaaagatgaacatgaactcagtatatccattaagatctcatttagaatgctggaatttaacacacagttttgtaggatttccacatgaattagttcaaagaagacccaacccttaattttcaaaaactcaggtaaaatgaaaagaattggttcctaagttttaacttaggtttacagctcaactgaaaaaagaaaaacactattctaacactacctccttagtttcttactggcacagaaacgatctattacagtcgaagcacagatgaaactcaatacaggccactaatgctgctgttcatatagtgcaaatgacttgttcatgttgttctgcttgagatattcttgaatggccgaacgcagtgcgatattggggatagtgtcacagttagcaagtgtttggttagtcactggagacctgtcatgtcccttatccagccaatctcttatagcatcagcttcataggtgaagccatccgctgccatctgaggatctctcatggtcacctgaagatatgcaattgcagtaaatcgttattagagtttcagacgagaagcaatgctggaagcatcggtaacagtttctaacgaaacaacggcagcaacttataaattctactccctccatcctagaatttagctacctttagcttatgaatttgtaagctaaaagtagctatattttgggacagagggagtacctttctaacttgtagtacctgagagattgggcaaaggaagtaggacggggtggcagtttcaatggcactacagatagatcgaaaagactgggacaatggcgaatgagcttccttcttcataggttcaatcacctcccacacatcatgctcaagatcagggcgcctctgcttgctgagctctgtgcactgcagcgcaatgtgtgcgagctgctccacatgcaccaatggccagtcacctgcagaatggtccaacactgactgcaggtcatagtcgttcagcgcctcccgcactgtcctaatcaggcgtagaggtgcccgtccggtcaagagacgcatgatggtaacaccaaaagagtaagtatcagactgtggcgtcagctcccctgtggcgaagaactctgggtccatgtatgccggtgttcccataggcctggaggtgtagtgtgcgtcgcttccagtgacactggactccagaaggaggcgtgaaatcccaaaatcactgagtttgctctgcaaattcgcatcaagaaggatgttgcctggcttgaggtccccatgcaccactgggtgaggccggtgcttgtgaaggaagataagtgcagagcaaatctccgtgatgatctggatgcgcacttgccaagtgagtggcggggtgttgtcaacacagttgagtcggtcctccaggcttccatttggtaagagctcataaacaagcgctgaagcttcagtgcaggctccaataagggtgactaagtttggatgccttactctactgagtatagcaacctgtgaaaacaaattggaacggcagaatgcattagcttaacttttaataatgattagcttatcttagttccgttttttcaatgcaatattatacaaatggatgataggcctttgaatagtacctcttgatggaactgagattggccatgcaagctgtcagtactaagcatctttatagctactgtcgtattgcgcagagaacctttgtatacagatccaaatccaccttgaccgatgttaagtgcattgctgaaattctgagttgcctgctccaactccatcaaggagaactcagagcttattgctccataggcacaagaattcgtcagctccttctctatacgcatgctccttgcctctttaactgcatcatctcgctctcgcttcattttactgtactctaacttcagtgactggacacgagattccgtaaccttcatgctctcttctagataagtggcaactgagtctgactctgagatgcggtgttcaaggaggtgcttctgttggtttagatcttgtaatctattggctttctcattcaactgatatttgagccagtccaggtcattttggagcaccatagtggcatgtttgagagattctgactcttccttttcttgtgagagttttgcctctgtctctttccttagttccatttcattaatatacatgcatcccaatcttttagcctgcaaatgcaatcagcgattgttaacagaaaatactgtaaaagtttggatattatataatacggcataccaagcgcaaaggatctgaaacacagagtaaaactattttaacttcttcctgctgagccaagactaccttgtttcattttgtttcgagtttattatagcatttccacattcctaacttcagaacagttttagagacctcttggtatctctgaagtacatgcttaatggtcttcctgtgtgaacatctactaagccgcgctagaaaagctcatgttaattgtagtacaaagtggtatttacctctatattaggctcaagcaaactttgaagatccaccttgcaactgtctacagaagaaggtaggcgtgctgattttgacctttttacagggcaacaactggcctccctaggcgaaaagaaacagagacgtttagtggaagaaaaattcaaagtagtgaaaaattaagaattatttaggcttcaataaacttgtgataatcattctcttatggaaaaataacagatactttacatgacaaaatgcagatagttataagataaggcatgtcgaattgtagatcagctaaatatggtacaaactcgaccataacctagactgtcctaataacatatacaggacaaagtattcgcaaagaaagaatatacaaggcaaaaataaatgtacacatgtttttttctcagttctactcattctaaatatgtgaagttctgccagaatttatctgctgcaataggcttgtgatctttgattctggaaaactattcgtccttcagttacatacagcatgcttggtaaacagtcaagattgtgatcccttctgttatttgtccaattaataccgattcggtgccttggagtttcaaaactgaagtatcaatcatatggctgcctataggccctatactgaaagatttacatgtgattattttaagctgcatattgtactgttatgttgagattccttgctgtgaaataatgccaaaactggggcttaagataaatacaataaaataaagtcagatttatataagagtcccatttggtagttgaagccctacctgacacatgttagcttcccgttgcaaataaaccatatattgcagtatgaatgtgctctttgcatcacacttattgctgtttgtgattgtggtgctttcatttttctgggcaacaaaaatagtcatatttttgtcacaatcaataagaactgataacgtgaaactgtaccacgattgttagaactcagagaaagagaagagagagaaaccttttgtagtgtctgtctgatgcagcacccataacaagtttagtgaccccatatatttctatcagatgaagaagtccttcgtcaattttggtaaaaaagaacacttctttctcagctttaacctggtcaaggaagaataagaaatttgccctctgatgaagtaaatattactttttgcattaattttccccctaaactttctttacaaaatatgttaacttattgcaatcgattttttgttttcaacatcatggataaaatagatagaacagaattgcagaacatgcatccatagatagtcaaacaagttgacttcaatatgtaaacctcagtgattcatatgattcagcatacaagtggcagaaagccttgatgccctgttaatctcgatcagtttaaaacaaaattttggattattacctaaccagggtttgaaatatggattttttacagttttgtcacataaaaaaatggaaccagagggttcattatagtattcagaaaaaaaaaatcaatgcaaaaatagatatggtgaaagcttcagcaaaaataaaataaaataaaataaaatagaaaatccccctagttcttccaaaacttgcttctacccaaaacaagataccctgtataaatttcctacgaatggtctttatggaagagatgtccccaaccttcattagcacggagtggatttttgtacctttgtaaaataattctacttcaataccaactgtttttgtttagacgaaaaaaaatacctggacgtggctttggttgtgcaatgataatactactataagaactatcttcagttataatatatgaacaatcagtatttggacatatcaagtaaaaaaataaccattttcactcttgcttggtgttactttttttttccttatgttctataattagttatttactcatagaagtctttgtggggagagtgaataaaaatattttttacatgaacttttcagaaaacaaaataaaatatcattatcttgcaccttttttcttgagcactggtccagatagttgtccacattttgcatccggctttcttcagcaaaaaaggaatcaactaagacaatagaactttgctaaggattatgcaaccgaaaacacaatagaaacaagaagtaatggttagaggaaataaaccagaatatggcagaaagccagaagctaaagattatggtacaaacatcataagatagctatatgactatatcacctcctttattgacatcgagaaaaataactttagataaagccactgcacataactaaccaaagttcgatgtagtaattatgtggatgatgatgatctccgtgctactggatgcatgatcgataacccaagacagtatggacttgccatcggtgggttgctcagggagagcaacataaaccttgtctctaaacagagttttctgcctgagcatcatactcatgcatgcaactggtaaggccttgaagatggaactaagagatacttctatctaccagtttgcgtttcccactttggacaactaaaagagggaacacactgcgtattagcattaaagaataagattccagtttaaccaggtaaaaaggttgactcttgactgagactatcggaagacaacgcaacactcaactaccaagtcgcagtgaatggattatctgaggaaagtcatttggtacgctgtcatgccatgccagtacaacacggcaaaatttgctgggaacagggacatgttatgaattaatgtaagactctacctttctcacatccttcacccccattgctcaccacaaattccctgcctttcatttctaataaaaaaaagatgtagtgcatcgattgtgtgccagtgatagagccatcagtctatctggtgatctaatctaaagatctcggcctcatatttcagttactccatatgaacgggagaaacaacctacgggtagtgacgattcagcaataatagcatatgaaatttgaggcgaacaaaattgacaacaagcaaacatctcatcatcaccagtactgcatatgaaattaaatcatcgtggtacagtcaaatcacctttgacgattgactagaaatggcgaacaccgaataaatacatcgcggcggcggcggaatcgcgcagggagacggcaacatcggcgcgcggcgaggcgggagttgggggaagccgtcgccggctcacaggatcccaccggggtcgcccgcctcgccgtcggcgagggggaagccaccgccgctccggcgagcggcgaggcccatatttatccctcgagaaaaaccctcgcctcgcgtcccagcccaagttttaacgtgcggcccagtaagaagatacagcacgagacggcccattttaaagtgggccgcgaatctgcggcccacgaggaatttttttttttttgacgctactggtttgggagtttgacactgtgacgagtagaggtcaagttggtggggaatctaggcggcggaggcggtggagcgtgtcggggagaagccgccggcggcgaggggagatggaggcgacggtggacgagctgagcgaggcgtaccaggagttcgtggcggcggcggcggcggtggtggaggcgcgggggcagtcggggggagagaagaacgcggccacggacgcggcgctcgaggcgttcaagcagcggtgggagctcttccgcgtcgcctgcgaccacgcggaggagctcgtcgagtcgatccgccagcgaatcggttccgagtgcctcgtcgacgaggccaccggcgcctcctcctcctcctccgcggcgctggccgcccccggcatcaagcccatcagcgccgtccgcctcgagcagatgagcaaggccgtccgctggctcgtcatcgagctccagcacggcgccggaggtgcctccgccgcgggtcccggcggcgggggcggcgccgcggctgcggcttccggcgttgcggggcagcacggccacggcggggtcgacacgcgcttccccgaggacggcgcccagtaggtatttattttgctcaattatcttgtactagtagtattttcttccaaagaaaacaaattactggtggtatctctgtgtaatcgtctaagaattgaagcattagagcttgtgatcgatattctaaaaaaaattgagcttgtgattttctcagcattgttactttatgcctactgatgttaaaatttgggagaaattaaccgttttcttagtgtcgtggccagatcacgcttagtaactgatttaattttgtcctattgcttttgttaagtgactaattgtgtaacggacttccttccagtaggttttagttctgatttgtagctcgctcacataatgttcgtgcatcgtactaaggtaaggtagtaaacctgaggtcccaggaaaaaatgaacaatttcatatatactactcaactagcatataactgtataagttccttcaactttcaagtacctactctggatgttttgctaatcttgcgtccgccacaatgtgaatgcttttccttctgattttttaatgaacaacattttattgaagaataactaagcagccacaaaaggcacaatttgtgataataaactctgggagattgctcatggtttgtgaaacccagttatactggaaagtgatattggttattagctactagtttcctcatataattctctatcgtacatttttgcgcctttagaattagctgccaattttggccaaacaattcaatgtttgtagcatatgctcttcttttattgtcgatatcatagtagtaattcactgctctataccaaaattgctctgagcactcatactctatcacaagcattagcagcaaagtttcctcaaatggaatatgaagagatgtaaggagataacaagaaattttggaaatgatcaactgaagctgctgcattaattcacctcaatctgtgagaaaatggtgtttccttatgcatgattttgtaaggcgcaacgatccaaacacgagcagctctacacacctgaagctgactgtatcagagatggatttgatccatcatcatagcctcataggacatagcatcagaaatataaatgactataataccatattgtgttattatgagctaaatgagctgctcactgatagaaacagcagttattttaggtccactttgatcagtagttcacaggaaatggtcctattgaatgggtgattttctagtagcaattagcaaatcactctgtcttgtagagcatgctgagctagaccagcttttcctggcaagacaactaaacactagcttcaatttagctaaaccagttgtttactgagctaaacatagcaaaaacatagcaggctagaagccaggaaaaactgagaaaggaactatctatctgaaaaagcatctttcatgttttcttaagagaatctgatagtaataggggaggacaagataggagtcagtttttctttcttcttctctgaacttctctcaagcgagtttggttaagaggtctgttgatggccgctacacggaggaaaattctccaagcatggtttgaagtttcccaaaatgcatgacagcatcccgtggccaagcatctacccccaaagcatgttattgtccatttaacattcaacatctactgatcattccaaggtacggacaaaagaaaagaaattgagcacaaaaacaggaaacagtaaacacagcatatccatatgatcacttttcttcagaactagccgaattcatacagatttttcttcagaactagtcaaattcatactgacttttattcagaactagccaaattcataccgacttttgttcagtgcaaaagatgagtgtagttttcagatctttatgtcgcgagtttgtcagcctctttctgaagaagtttaaatgcaggcatagcattattcgcttgggttacaacacgtaaaatggtagtaagaggcaaatgtgtatcctccattccgttgcgaagtgcgatggccatccaaaactcagagatcagtcgaacaacgttctgtgcaggcaaaaaatgttagagaatttttcatgaaaaacgatcttgatgggccggcttttctgtccgagcacgtattttcggcccggaacgtgacagcgagcaaaatgcggcccataattagctgggccagaacgggggtgcggcccattataggtagcaggagcacgatggaataagttcatctgaggtcccttaactttacaccgaatccgattttcgtccctcgatcggaaaaccagacacaacaggtccctcaactattaaaaccggtgcagattaggtccctcggcggttctgagagcggttttggctgacgtggcgcctacgtgactaatttgactccaccaccgagctcgtcagcgaccgcccaccggagcgaggaggacgacagccggcgatgggtgaagaggacgaaggcggtggtctggagcagaggtcggaggagggcccccagccaccatgatggtgctcgatccgtcgcgtttcaccaccaccgagctcgtcagcggcagcccaccggagcgaggagcttccgcttccccttccccccattgacgccgccgccaccgtagctgcggcgccgctccccatgccaccgcttctgtggtgcacgccggatgcggacggggaagccatggccgtggccgcggacgacgtcgacgtcgacctcggcatcctcggcgactcctagggcccctgtgccgccgccactaccgaggggagcagcgcacggcggacgtcctcctcctccagctgccaccgccacgcctccccgcatggctgcatctcctcctcctcctccggcggccatcgctgcacgccgccctttctccctgccggccaccgcccttctcctgcccgccactactggatctcaattgccggcgctgctccggggggacctgccgccgcccgtgtcgatctgttctgcccatcgccgtcgctgatccccttttatcgccccagcttcctcctccagctcgctactctcgccggcggacgccggtctcgccgccccctccagctcgccactctcgctggaagaggagaggagaggggagaaagatgaagagagggagatggggagagaggaggaagaagaggaagggtgagtttgactgacatgtggggcccacgtgggtcccacaattttttattatcttctatgtgagactgacatgtgggtccctaggtttttattatttttccgggtcgaattgacacgtaaagcgccacgtcaatgccacgttggacgaagaccgagtcaaattagccacctaggcgccacgtcagccaaaaccgccctcaaaaccaccgagggacctgatctgcaccggttttgatagttgagggacccgttgtgtctggttttccgatcgagggacgaaaatcggattcggtgtaaagttaagggacctcagatgaacttattccggagcatgattgggaagggaggacataaggcccatgtcgcatgtgtttggacggtccagatctccagatcactcagcaggatcggccgcgttcgcgtagcacccgcggtttgattcggcttcccgcaaggcggcggccggtggccgtgccgccgtagcttccgccggaagcgagcacgccgccgccgccgacccggctctgcgtttgcaccgccttgcacgcgatacatcgggatagatagctactactctctccgtttcacaatgtaaatcattctactattttccacattcatattgatgttaatgaatatagacatatatatctatttagattcattaacatcaatatgaatgtaggaaatgctagaatgacttacattgtgaattgtgaaatggacgaagtacctacgatggatggatgcaggatcatgaaagaattaatgcaagatcgtatctgccgcatgcaaaatcttactaattgcgctgcatatatgcatgacagcctgcatgcgggcgtgtaagcgtgttcatccattaggaagtaaccttgtcattacttataccagtactacatactatatagtattgatttcatgagcaaatctacaaaactggaaagcaataagaaatacgggactggaaaagactcaacattaatcaccaaatatttcgccttctccagcagaatatatatctctccatcttgatcactgtacacactgacagtgtacgcataaacgcagcagccagcttaactgtcgtctcaccgtcgcacactggccttccatctcaggctagctttctcagccacccatcgtacatgtcaactcggcgcgcgcacaggcacaaattacgtacaaaacgcatgaccaaatcaaaaccaccggagaagaatcgctcccgcgcgcggcggcggcgcgcacgtacgaacgcacgcacgcacgcccaaccccacgacacgatcgcgcgcgacgccggcgacaccggccgtccacccgcgccctcacctcgccgactataaatacgtaggcatctgcttgatcttgtcatccatctcaccaccaaaaaaaaaaggaaaaaaaaacaaaacacaccaagccaaataaaagcgacaatgggatcgctcaccaccaacatcgtcctcgccgtcgccgtggtggcagcgctggtcggcggcgggtcgtgcggcccgcccaaggtgccacccggcccgaacatcacgaccaactacaacgccccgtggctccccgccagggccacctggtacggccagccctacggctccggctccaccgacaatggtaatgttactatcttatcgtgtaatgttattctctccgcctcaaaatattagttccgccgacaacggtaaagttactatcttatcgtgtaatgttactatctcctcttcaaaatattagtttactggctcatcatgtagtgttactatctttgtctcaagatagtacgatagaataacgaatctgaacagtgtctaaatccatggcgatggagtaactgtgaagctcatccatgatctatggcgatcgatcgattaattggttgagttttgtttttttccaggtggcgcgtgcgggatcaagaacgtcaacctgcctccctacaacggcatgatctcctgcggcaacgtcccaatcttcaaggacggcaggggatgcggctcatgctacgaggtaacctcaccaattaattaacacaacctcatcgtctcgtactctcccaatcattgtcccgaggacatgcattcgtacatctccttcgaaacaaaggaatttcattttagaatttcataagggttaatttagaactatagtgattatataatgaaaatatatccagtaaaactcttgtgtttcaaattaaggcggcctgatcttatcaacaagtcaatgtttaatacattgctatttcacaaacatttttggcagtttatatttcacaaacattcaatgcaatatatatatggaattttgctaaattaatggacatcgatttacgttaggtacattttgatttgggcattaatttggccgagtacattttgagtacaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgccgacgacggtgacgtcatccagatggacctccaggaggccggattgccagcgtggaggcccatgaagctgtcgtggggcgccatctggaggatggacaccgccacgccactcaaggcacccttctccattcgcgtcaccaccgagtccggcaagagcctcatcgccaaagacgtcatcccggtcaactggatgccagacgccatctacgtatcaaacgtccagttctattgagatcggacggaaacgatcctcctaatttatttccctattaatttgttcaaatggtttccttctataacctatatttttcccgttgttagaaatggttccatttcctcctacagcttactttaagatagttgcgcttgtatatctgcgccatcttgtaagttgtaagatgctgaagaacactatgaattctgagcatctgattctccgggaagatttactatgataaacaacagtttgatttactatgtgtgtccccttgtttattgtatgctatcctaatacttatgaaaagttttgataaatatgtgtcactttgcgaaaactcaaattcaatacatacaagttgaaaaaaatattatacggtaatatttgttcctataatattacacgtacgctaagagaagacggacatggattttctactcctagctaggtggaatcgcacctatgcaaacgtttgcatgtcatctaaatagtcgtgcatttttttttaaaaaaaggtttagattgatgtgatgctagaagtatatatacatgtatagttaaatatgatctcctttgagaaacaaaaataacaaaatttgaacaaaaaaatacaaacacaacttgttatttttatttacttgaagatcgaatttgtagttgcatgtttgtgtaccaaattatattatcacaatatatcttgctaattttattttatatttttatttaactatttataccacatgcataccctagatgcacttgctaaaaatattctcactaggagacggggaagtatccggtgcaatcacccaattcggtgcaactatgcatctctcgtcctacaccgttggattgagaaatgggcgtccgagattcgtccacgtc

SEQ ID NO: 58468 - DNA, 36790 bp, Oryza sativa
ccctcgcttgccgctgctccgtcgccacgctcgcgctcctctactctgtccgcggcttgctcgcgctccactgctcggcccgccgccgcgctcgcgccttccgctgctccgttgccgcgctcgccctccgctgcgccgcccgcatccgtgctcgccgctccgctcgctgccttcgctccgccgccggacggccgcgccgcgtagcctcgcccacggcgatgacgacggcggcggccacggcgcgcggctgcttcgccatcagcctgaaggagaagagaagagagagaaaagaaaagaggagaaaaaagatgtgaagctgacatgtgttccccatgtgtttttttaatttttttttactgattaggatgccacgtcagtaaaaccggacaaaaaatactgccgagggacctctggtgaacggtttgagtgagtttaggggtacacatttctggttttgtggttaagggacctccaaaaatctcgctgttaagttgagggacctctggtgaacttattccttttttttaggatgggcccgttcggcctaacttgaggaattgggttggtgaggcccaattcggctggcccaccaatccctcgtcttcttctccacgcgacgccggtcaaagtttgacgctgcgacgaaccggagaaggattttcttccgatctcgcttccacctcgccgcctcgccggggaggaggagggtcgatggccgtggcggcgccggcgaaggcggcgcacgcgctggcggccgccgcggcggggatggtgctcctgtggtgcgtgcactttcgcggcggcctcgcgctcagctcccccaccaacaagggcctcatcttcaacgtaagaatcgctcgccccccaccttttcagctgatgggtcgtggatgttgccattgttgttggggagattctcctgtccttagctgtgctggatctttaactcaactgccgtgaacgattgcaacattgtggttagtactgttttactctaaactgcaggctagttgaccattctggttaatggcggcgtcatttgatttggttgcaagcctatagcactgtactgtgctagttcttgtgttatttgtctccaagaatgaacttgataatgctatgtgtacaagagagtagagacctgtattgtttggtgtttgcgctggtatttctactttgctgtgtatattgtgtagtccatgaagaaatgtaaatctccatttgaccacttgggcctgttctgaagatggattgctgggttaccgaaggtttagttttgtgtaaggatttgtgctgaaggtcatttttggaggttaaatccttattagaaattttaggataatgactgagtgactgacaaggcttatatttcggaggggataatatttgaagattgattgtaaaatggtctggtttacttttttaattgcgctctcagagtattacatatggcccatttgctaaaaaaattggttttctgatccctgttatgcaggttcatcctgtgcttatgctgatcgggttcatcattctaggaagtgaaggtcaggacaaaaaaaaactcattcttttttctcctttgatggttttgccatgatgagtattaaaacaatactcactatgctattatttttgcaaagttctcaccgatctattgcgatttgtttgcagccataatgggctacaaaatatggccatggggccatgacacaaataagatggtccatttgcttcttcatgctattgcacttttgctgggttcagttggaatatatgctgccttcaagtttcacaatgaaagtggaattgctaacctctacagcctgcactcctgggttggacttggaactatctgtttatatggtgtacaggtaatttgagcaaagcatttatcattctaatgttgtctgaattgagatttaaggtttggaactatgttagagctttttaaatttatttattgcatcggtagccatgcaagcatgattgccatagctatactactgaatgcctcaaaagagcttccactagattataatagcttggacaagttaactatctgaacccagattagctatttgcaacattccaaatgccactttaagtagtggttttgcctttgtgaagaaaagtgtaaaggaaaagtcatgtaatttgctatgttacatctgtctgtaaaggaaaagtgtctgtaggatattgttgaagcatcaaagcagagagaatcatgcttcattcgacatgatttaggccacaaaccaatagaggaatttaagaatatgtagcataaacctactatgataactcaagaaaatagatgccgatattcctgaattaatcttttccctcccttggcattaccgagtgacatcaaggtatcagctccttgttattaaatattgtgttaggtctcctgattgttgagaactttacaagatgatatcaactaatgaaacatatgtcaataatattttctttgaattcattgttctgaaacttgctcatagtccgtttgctattactcttttgtgtgaccctttccctatattcagaattacctgaaacctgattgtcctaaccccatgttgatattgcagtggatatttggcttcgtcaccttcttcttccccggcgcttcgccgtcgctccgacgcgccgcgctcccatggcacgtccgctcgggccttctcgtctacatattagcgttgctcgcggcggagctggggttcctggagaagctcaccttccttgaggccggagggctcggcagctacagctcggaggccctgcttgtgaacttcaccgccgtgctcgtcatactgctgggctcagccgtcgtgatgtatgttactgctccgatgcacaatgaacattctcatgggtattcagcagtgcgcaagccatgagccagatgagccattgatcgatccagcttcttcatcggctgtgtctgttgtataattgttttgctgaattattcccatagctgctgcctgctgcaaatgtggttcagatctatgggcatgtgatgtaactttgtaagtaactgacgatattaattacgagatgcgaaaattttgaactgtttgtttactgatgatataggagaggatgataataaagatgagattgagacaaagagatgaagcaaacagttctgtcattttcttttgtgtgtcgagttggtactggggaagcacaagaaacaaaaactaaaacctgaagctgtaatcttttccccagccaaggcaccctaataatggcttactactacctaattacaagcaaaaatctgctgccaataaaatccaatgcagtatgcacggaccattgccaatgttaattcttttaatctagacgcattttactgcgagggagggagggagaagaaaaatctctacgcggagaagtagctgaggatgacgtcatcctccctccccgacgccacggcgccgacgacatggccggggctccccttccccttctccgacccgtccgcccacgccgccgtccaccgcgtccgccggctatccccaccaccacctcccccacgcgccttgccgtcctccccgtcgccgccggccatccgcgccgccgccgccgcagccgccgcccgcttctctgcccgccgcttcgccacgtactcctccgagatgtacacgtccatcgacaaagcaaaatgccaggctaagcaagcaagctgtgaagccgtgtgctccctccaagagagcaggcaaaggttgtacacttgtacggcccggtgacgcgtgttgagcgtttgcaaggttggaggggagagcgaagcatgtggggggaggagtggggtgcggtgcgggtcgccggcggcatttatgggggaaggtgagggcggaggcggcgaagcggtgggcaccggccacagtttcgggggctggcgcccgcgaaaccacgtacgagcccgggcctttgtctcggattctgcgagccattcgctgccagtttctattgccgggatcctcctgagctttaaagctagaaagtgccatttccagtttatttttttaaaaaaaattatacgaccttcgttccattttaagtgcaaccataagtttttcggccaagtttgatcattcgtcttatttaaatttttttatataattagtatttttattattatgtgatgataaatataaataatacttcactcatgtttttaatttttttatttattttttatagataatatggacgattaaaattttacacagaaaatcatgcctgcatacggagggagtatatattaaattttgtttcttcgttgggactgcaccggctgccacctatgctgggggagagttacttttcgaatttgttaaacagttgataaaattcaaaaggaggatcgattagcttgataccatgagtatatgctacaacttgggagtggtatatttgttacttgtcttgcatcagttttcgcaatataaatctatttattattctaccactacatcgttcttttttttttactcatcgttttcacgtcgacgtagaatggtgcaaaatgtggctttaaaatgtataatgtataatgtggctttaaaatttacagtcaaatctcaatggttttattatcacgatcgacacaacatgactggtagaatggtatataagatggacagacggctaatcgcaatgactcgcggaataagattacatctagattagtcgatttaactttaggtattaagcctgtggcgcccttttacttttatctataggtccttaattaagatttggggtccttaattttcaaatcttttagccactttttaaatagtattaaatgtttgcccttattacatccctcattaattcttttccaattcagtttaaatgaaaggcaaccaagtcatttggattatttttagtattcttatgtgcacgtctaaaatgacttacaattgaaagaggggattatagattatattattaagagtagatgaaaaacagttgttgtattatctctagaggtttaaaatttattgcattaaaaaggagaaaaatgtgcatatttggatattatgatgggtctagattataaaagcttatgcagatttatcaatctatcaatctaatatatttttaagattgctaaaaagtaaaacatcaccttcgttgtagagacgtataagcaatgacggaggcttatctcctaaactcctactaaaatctatcaaaccttagtgaattttgaaaatacaaggtgtataagcaagttgagtcttactcttggagattttctgactccgcccctgcgtataagttactacattaattagagagaaaaaaatatatgctattagattgtgggggacgataaaattatgtgctttgtatcataagataagagttatatatgaaatccaatcctactttataatttactgtatgcaaaatatatttgtatgtataaaataagagctgagagttctatatatatatatatatcaaatcttgtttaactagaccgcacaaaaaaatcccctacttgcatttatgaaaaacaaagcaagggttatatacattaaattcaactctgcttataaatctggtttcacgtaaaattacatgagaaatatagtagttttaaggaaaaagtacgaattacccccccaactatcgcggtcgttcaaattacccccagaaccacaaaaccggatatttttcacccctaactatgcaaaccggacaaattacccccctcaacccaatccgcggtggttttggtctacgtgacgtacatgtgggaatcccgtcagcattttattgtggggcccacctgtcatatatatactccccctatctcatgtctctctccccccccccctctctcttgggccgtcgggctcagggcagtcggcgcacacggcgccgcgcgggggcgggtggtgggtggcggcggcaggtcgacgagctcggccggctccggtggcagttggcgcagacggcggcgctcgtggccggagctgggtcggcgcgccttgccacctgcctcttcgccacaatcccgtctcgccgccacctccggccatcatccgcgtctccgccacggccaccaaactagcttccagccaaccaagctagagagatcgaagcatggagaacgcggcttagaacctcgtaagcaacgttggtcagttgttgaccgaggaataccagcagctcagcggtgtcggcagcgaggtcgccgagctgcgcgacgacctggccaccatgaacgccctccaccgcgtgcagtccgaggccgacgacggcgccgtggaccacttcgtcctagagtggatgaagcagctccacgagctcacctacgactcggaggactgcatcgaccaataccgcttgtccagctacagcatatgaagaaaaaggccctctcgagccccctcctcctcctccgcatggcggtaacgtcacatacagctcgtagagaccacctacgtttgctgctccccggtctccttctccaggcgcaagagcgtcgtcatctttatggggaactgacaaaaggaaaggaattcgttagtgttagtatcagaccacgattgagaaaataaccaaatctcacaaaaaagaaatgcatgccgaacttaccaccacctgctcgccacgctcttcccgcaccgctgcctcgccggtgagattgccgccctccgcgtacgcgccgtcgccatcaacgagcgccacgcccgccacggtgtcaaccacgccgcgccgcgccgttcccagtccccgcctccttggtgatggtggtgtccacgtcgcccacgcagctgctccaccatgccaacaatggtggcgccgcgggaacagcctcctcctcctccgccgccgctgcctccctcttacgtctctcttgctcctcctccccgtcctcctcccgacgcgcgcctccatccgccgtcccccgtcctcctcccgacgcttccggccatggctcgcctctccgccatggccgcggcgcccgcctctcccccatcccctccacctccccgtgagtcgtgtgcgtgtcgaccgccagcccatccccgcgtcgctgcccatcgcccttccctgcaccgcgccatgcgtgccggccgccggcgtgcgcgccgctgccgctgaccgacgaagagagaaagagagatagaggaagagagaaagtagagtctaacacgactgccacgtgtacgccacgtagaccaaaactaccgcggattgggtcgaggggggtaattcgtccggtttacatagttgggggtgaagaatgtccggttttgaggttcagggggtaattcggacgaccacgataattcagggggtaattcgtactttttcctagttttaatagtagaagcagaaacaattggatttgtatcttttcctcactaatcctcagcatatagattgaattttgacttggcacatgtttatatctttccggcccacagtcagtcgtatggccttctcgtacaattacattaatcaagatttacttcatctgtccaagttgtttgacttaacagtgatacagacatacagtcttttgctagtactgctactgttctggagtcatatactcatatgtaggccgtgtttagttgcaaatttttttcttcaaaatttcaacgttttcattccatcaaaacttttctatacacaaatttttaacttttccgtcgtatcgttccaattttaaccaaaattccaattttgatgtgaactaaacacaaccgtaatctctctatatgagagtaaacttttcggaaactgttcatactgtcacagtggggtggggcctactgccagtactgtggacttctcgtgcagttacataattcaagctttgcttcatttgtcaagtaacactatggctgtgtttagattcaaagtttgggtccaaactttagtttttttccatcacatcaatatgtcatacacacacaactttttagtcacatcatttttaattttaaccaaaatttaaactttgcgctgaactaaacacagcctacgttttcactgaatacgacaataggcacaatcttgtactgctgctactgtactctaaaatcctatgtagagaaaattgacttttcactctctgtatcggagtaaacttttcagaaactgttcatagtcatactattctgaagttctctgtagagaaaatagattatgtacttttatgacagagtaaattaaacttttcagaaactgttcatagtacactataactatcatttgtactagatacgtctatcaacgcttgcttattagcttaccctgcacatccaaaattttaattttgtaaaactcaattttgaagttgattttagggtattttttttcatcgtagtatattttctagcatttgtttttaaactgctaatataacacacacattttttttacccttaaattatttttgtttgcttcgtcattttaaagaaccatttgacgaattttgtgaaggggaatttcagaaccataagaaaaaccatgggcttcttcagttacaacgcgcttggaggagcagctagcaacagcaccagcagaaaagccaaaaaaatcagtgtgaaatcctgcctaaaacccggtgtctaagcacctttgttaagctagctgtgccgcatgtgaccactgcttattcgccacgattaagcaacgaaaatggacgaaacgaatcgaatcaaggaaaagacccgagttgactgcctgattctggcacgtatcagcagtcatcagtacatcgagtcaaaatttcttctgttactcgcaatgatctcacatgcaattttattaagcacatgcagatactgatgatgcagctgatggttttgtgtcagcccaatgtctgagctttgctggtttaacagtttgggctcaagcagaaagcagatcatgatcaattagatcattaattatattctcacctgaatctgctttgggccatcctccccttgcaaaatgcagccagccatagattttctccacggtttgcacaggagaatggcgacacagcatcagagtattgcgagatctccaattgtctaatcagaattggtcatactgtcatcgaatcacttaagcaagcaagccactcccagctaacagttctagactgcctatagctaacaatgggctacctacctacgaatacatggccgttcttgacggctccaacttcatacaagtgcacaagaaaagtcagaaaagggtagagatttgtctccttcacacagacagaatcttcataaaagattaaagatcttagtactagactaattcactttattgacaaaatatttgttctggaaaggcagataatctgagacgtgcataaatattacttcctccgtttcaggttataagacattttgactttagtcaaagttaaactattttaaatttgattaaatttatagacaaatatagcaaatcaataattgaatatatttcataataaatttgttttgggtagaaaatgttactgttttttttctacaaatttggccaaagtcaaaacgtcttataacctagaacggagggagtagataagtttacactatatatagagtttacacgacatattttcccacttacatatgggttatctacctgtgaatacattgccgttcttgacagctgcaacttcgtactagtgctaaaaaagtcagaaaaggttagaagcttgtctcctccactcagaatcttcagaaaaagatactagtagactgattcactttattgacaaaatattggttctgaaaaaaaaaattatgtgacaggtgatcagagatcatggatgtatcagtatcaggagtcgcagtcattagtttcgtttttaagcctacaggaagaacatgtttaattcctgatcgtgtgtatgtgaattgtgaaacggtgacgtaattagccaaatagccaggcatgttttggatgatgaggatcgattttgtgaattgagtttggtcaggtactcttcctcctctctgtctactgcacaacaactccaatgaaattatcatgatgcaacagcaacccagattaacagaccaactagaaaactgaaaataacttgatacataatttgcagtgatgaaatcaagttgggttccattgcacactagcatcccgactgctcacctaacagaaggaaaaaaaaatcacatataaagagtttaagactgatgagccattgttgacatgccagacatgacagtaggaccaggcaatgagaaaccataacaaccgaactcactgtcaggctgtcaactcatatggaacaagagaataaccaaggatttaaccacataattaacttcagaaatgcatgtcgtttctgtctcaatttgttgattaaatgctgttggttattgctggtgttgaatgtggacaggttaatcatgtaaaaatcatgtataaggccatgtttagatttcaatttttttcttcaaacttctaacttttccgtcacatcgaactttcctagtacacataaactttcaacttttccgtcacatcatttcaatttctttaaacttccaattttaatgtggaactaaacacaacctaatataggttcataaaatgtgaggaattgaacctaactggatttaagcaagcgacgccttcgcccgtcgggtctgacgaaaccatcctcccagctcgaactcgctggccgatgtcgctctcgtggatgagcttctcggtgagaaaaaaggtgaaaccatttcgtgatctttaagttttcccgggaccttaactactcctagcttattaggcacaaaaggcacaaatcatctctcgcgttgcacaattatgctcgtaaattcaaacgggtgatgtcattcgatcaaatcctagataagatcgattaataaggaaggaaaaaaagagtatctttttctggtgatttgaagtgtaaaatcgtgtacggtgaaatcgattaattaggaaggaaaaaagattttttttgtgatgattttttgtgcaaaaatgggtacggtagcagggataaatgagaagaaaatgagaggtattggacagtcgacacatgtaatcctgaagatgaaggctgtaattgggttatgccagtagattgtttcagggattcaggccgtgtcacctgtgtgcattgtactggaagagaagtagctttcactgattcatcaaaatttaagtgcacacggcacggcacccatttgcttggtgacacaaaagcaggcgaaaagataggactaatgtggaaatttgcatttctcaagaaatactaggttatgagattgcaagattaaattcaatcttttttttacgaggtgtgaatgaaatggatacctaatcagaacaatcaaatcacacaatgaagatgaagtttccgttagcaagcttttcaagctaataaacgacgtgttttgtgcgaaaactttctatatgaaagttgcttcaaaatatcttaaatttataataattaaaactcaattaaacataccctaataactttcttgttttgcatgtccgtatttagtatgaatctttataagattcaaatgcagcctgtcaactaattcctcccatcactcaaaaacgaacacaggcctcccctatttcataagttttaaagtccaagaatctttagaaatctgcattttttttcagtggatatacgaacccctctgcacagccattggtatggtatcttgtttctctggccagaatctgcaccagcatacaacatacgaactaaatcttcataaaccaaaaaaacccatggatacagaaagcgatgcatggatagaattgtcagttggcacgccaaactgaccatagattcagctaaaaaaaacaacaaaggccagtcgaaaagaaaaagaatttccttgaatccttatcactgacaatccaatccgatttcacctggttgcttgcttctgctgccatgccatcttctcccaaccaacctgggctaatcagtcgccatccagccagctcctgttaaaaaacaaagaagaacaagaagtagaagcagttcgtgtgcttctctcatttgttccttgatatatttgctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatggtaagtaaggtcaccatgaaaaccatgttttccattgacaaccttgcttattactagttttgttgctgtaataatccaccaagcagagaacatgtttttgttgctctgagctattccaggtgcaacttgtgaaatctcttgttaatttcttcagaaagaaacatgatgaacatatttcaccagagtgtataatatatgaagaaactaattagcaccaacatctctgcaactaccagttaatttgaatctgttaatatgaaccagatagcactatgaagtctgaatcttttcttcttgtttttgaatgctaccctctgaatgtttcatgtttacacaaggagatgtgacatatagtcaggaaaacttctaggacaaaattcatccaaaatatcaaaattgttcccttttttttttgccagatgctgagaaagctgcagcaacaggtggctcacacgaaagaggtaataatagtgattctccatcctctacaattgcctgagatcaagaagctgcacacagcctctcgaattctcgatctgatacacacacaaaccattcctctctcgtgttcatcagacgctctcctgacgacggtcgccacggagaagaggatatcgctgatcaaggcgtgggaggagaacgaaaaggccaaggccgacaacaagtcagtaatactaatagtagctcttctctcacttcttgccaaggctgagttattttcttcaactttgaaccgtgctcgcttttcattagcacgttttttaaactattaaataatgtgctttataaaaacattttatatagaaaataaattcaaactaggtcgaaagatataaaattcctgcattccaaatgagccctcggttaactgaaactttcgcgcacagggcggccaagaagttggccgacatcgcctcatgggagaactccaaggtggccgagatcgaggccgagattaagaagtaccaagtaagttcagctcagctaagttcatcaacaagcagaacaaggagagatcaattatgtgtgtgtgaatcattgagttgatcgatcggttcatatatatgcaggagtacctggagaggaagaaggcggagcaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtcgtcgtcgtcgttgttgtaaatgtgtgtgcgacagtgtgagtgtaccggtgtcaagttcagatagctagtggttggatgtattttctcagttgtttgttttcgtttaatttcatgtacagggcagctattgcagtctcatgtgaaaaagggaacatttattatgtacagacatgatgttttggggtctttattcggattcggcggtgaaattgtaacatttttgtgcctgtggtacttggctagtactcatgtataagaggcttacccatttgacattattaaaatgttggtgctgttacgtattgtcgtgttttaatgagttattacttttaagtgaaatgattagctagagaggtccaatactagttgtgtttcacatgtttagctactactcctccatatttcaatgtatgacaccgttgactttttaaccaatgtttgaccattcgttttattcaaaatttttgtgcaaatataaaaatatttatgttatgcttaaaaacatttgatgataaatcaagtcacaataaaataaatgataattaaataaattttttaaataagacaaatggtcaaacgatagataaaaagtcaacagcgtcatacatcaaaatatagaggtagtattacggaacacacagacaagttatatgcacgcaaagacatcacaaacttgaggtgcttcttcttaagttacgaaataaagccctttcatattcgtttcctattggttttcaactcgtgttagggtgccaacatgaaaaagcgatcaaaattcaatatacgacctttaaatataactagataaatttaattataaaggtctagaaacaaactacttcctatacaatcagtacattttatcaactcactcaccatatattctctctgttttaaaatgtatcacaccgttaacttttcacataacgtttggctattcatcttatttaaaaatgtagcataaatatataaaagtataggttaagattatattttattttgagatgttcgagggtacttaacggtgtaggccccgtttagttccaaattttttttctcaaaaacatcacattgaatctttggacacatgcgtgaagcattaaatatagataaatgaaaaaactaattgcacagttagggggaaatcgcgagacgaatcttttgagcctaattagtccatgattagcctaagtgctacaataatccatatgtgctaacgacagattaattagactcaaaatattcgtctagtgcattccaggcgagttatgaaattattattttcactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattctttcccctttttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttgataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcgtacaaatttttttttcgcccatttttttttctcctgtttttttcggatcagactatttttttcttttttcgcctggtcgatttttttaccacgatatatataattcctttttctttggaataggacagttttctttttatttttttaaactctttttaccgcgtcgatgtagtcggattcgtttcgatttttttcctttttttgctttcttttttgtcagacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttttgtcggacatatttgttttttttccgcccggttttttttcgccaggtttttttatcggacttttctttttttttcgctcggtttttttctctcgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggacgggtgtttttttcgcccggtttttttttttcactttttttttggatcggactttttttttcgtccggtttttttatcaaacaaacttggttttttctgcccggtttttttcacccggtttttttgacggacgatggaagcacctcttattttttaagtagtagtagatagtagagtagtagattcgtgtccgaaaaacccttctcacacaaaaatatccaatgtgacacccaaatttttttttcgggaacagtaagcgagtaacacgtgcgctcgtgcagggcgtgtaccagaaccaggaaggccaaagccaaacacaacccctcccattcaaaaatatcagcccctctctctcccgattccgacttcctcctgatccacctccaaagcccacgccacccgcaccgcaccacccaaagcggggggaaacccaaaccggcgaaaccctagatctctctccgctccgcctcgtcgctcccccaaaccctagatccccgccatgcaccaccccagggcgcgctacccgcccggctacacctccggcggcggcggcggaggcggaggcggaggaggaggcggccgtggtaatggcggcggcggatttggaggaggtggcggcggcggcggcgggaaccacggctactacggccggggtccgcagccgcagccgcagcagcagcactaccaccaccaggcgcagcagctgcatcagcatcagcagcagcagcagcacgcgcagaggaacagctcctcgcagcagcagcagtggctgcggcgggaccaggccacggcggcggctgcgtccggggaggtcgcggcgaggacggcggcgcagctggaagccgtcgactcgaggtatgtggattttttacgcggttttccggtaacgctgctttggtgcctgccagctgctagggtttgtgttttgttgttagaagaaagcagagcgtatactgcgtttgggagtgtaggatggcgagattgaggcgtacgagttgatcgcatggattggatgtaatttggggggtttggattgtgcgcatattattcagctattaacagtgttctgtttaagctatttatatggcaatagagggtttgtctctacttgtttgtaatattcatgtttcactagcttctgtgcttgcaggactcctgcttgcttgcccctgcattttttttcttttcagaacccagaaaacacgccatcttgccattttattgcattattaatttattcgggtgttttatatttccttgctgtggggtttgaaataggaaatgttgcatcgaagtcattcttgtggcatctttaataacttcattgatcattattttttttgggctctttcagctctgaagattggaaggcacaattgaatttgccagctccagatacacgttataggacagaggtgaaattctgctgtgtatttgtagtattgtttctactatacatcatcatttacttcgttggtttgagcaaatgttggatggaatatttgaatggtaaccatttgctagtgttatgtggtgctgatgctgtgttctgcaacatatgtttttatgcaggatgtcactgcaacgaaaggcaacgagtttgaggattactttttgaaacgtgaactactaatgggaatatatgagaaaggattcgaaaggccatcacctattcaggaagaaagcattccaatagctctgactggtagcgatattcttgcaagagctaaaaacggcactggcaagactgccgcattttgcattcccgcacttgaaaaaattgatccagagaaaaatgccatacaaggtgagctcttcactcttgtattcttatttataaggaaccataacattaatattttcttgattgctgctcccaacattttaaactgcactgttctttccggcattcatgttgatgcatctcaaattcagaaattcattaattatgggtagtatcttagttgtgtatgctagatccatatgaacttcaaaaattcagtgcactttttgtatactatacttagagggaattattggcatgcaaattgtctgacagtcttttgtacgagaacttatgattgtgtcttagcaaactatttgctctttagcattatctaccgtattgacagacaaaaattatgaacaatgcaacaggcattttcttagctgatcacttcttttgcctttttatggggtgctggtatttcagggtgtctattctcactgagctttctcttgagattcccttgtaaagctggctaccccagctattaatgtaagatttcaattggctatatgaaacttttaaaagggcaatgtttctgtggtgctagttttatacccaccttttatttaatttatcgtttcctactcttttggttccccagctattgccgttcccttcttttggtgaggaatcttttgtctttcatgtttacaaacaatacatactgtttatgactctgttggatctgtggattttatctgcagttgttatattggtaccaacacgggaactagctctgcagacctcacaagtttgtaaagagcttgggaagtatctgaatattcaagttatggttagtactggtggaaccagcttaaaggatgacattatgcgtttgtatcaacctgttcatttacttgttgggacacctggtcggatactagatctaactaggaagggcatctgtgtgctgaaggattgttcaatgctcgtaatggatgaggtatcatgagtagcactcaattagggtcatgcttttgttaatttatatatgtttcaatcacaactatgttataatttttcaatttttttatgatctgcaggcagacaaactgttagctccagagtttcagccttccatagagcaactcatccatttccttccagctaatcgtcaactattgatgttttcagcaacctttccagtaaccgttaaggatttcaaagagaaatacctacctaggccttatgttattaatctcatggatgaactaacactaaagggaattacacaatactatgctttcgtggaagaaagacagaaagttcactgtctgaatacacttttctcgaaggtacagctcaccagaaatcctattttttctgtcttgtccatctttaagcataaattgacataatttcccttctttgttttggtcagcttcaaataaaccagtccattatattctgtaactctgttaacagagttgagctactggctaagaaaatcaccgagcttggctattcatgcttctacattcatgcaaaaatgttgcaagaccatcgaaaccgagtgtttcatgattttcgcaatggtgcttgcagaaaccttgtgtgcacaggttctctaccttttgccttgaatattttctgctatttcagctagtgttctgtagcatatgctgtgttacaaaaatcttgttttacgttatcttctgatatccttatttgttgaataatgtattgtaccatcgttgtattttgacttctcaagcatgagatttgacctctgatttctgagtaaataattttcagaattctttggctagtttattagttacacgaaggcttttgctgcttttgcatgctcttacatcataaaataggctcagaagtagcttccggagcatggaatttactacacatgatacatgagctgccaaagcatgcccactgttctgtgctcataagactaggtaccccccaggctatgtctagactctagaatgctcgtagttcgaatgttccactaatagttaatgcactagaaaataacttgtttggcatgatgtctagagcattttttttcacttgaccttccatgtctacttttttttgtactactattgaaataatgtttggatctagatgtattgtaattgtttcaagccatgattcttgatgtgtgtggtaagtgtatctccttttgtgtgtgcacctatcaggttgacttcttttattacatataaacgattaattaatgtgacatgtctttgcagatctgtttacaagaggaattgacatccaagctgtgaatgttgtcattaattttgacttccctaagacttctgaaacatacttgcatagggtaagttgtttcctcccgttccaaaagaaaatattttcctataatctgtaatcatgtaaagctatcaatatatatatgggttgaatgcttgatcgttctaagctgaatgcttgaatgccaattctcattcagatttgctatacttatgggttttgcttgttcacaaataagaacttcaacacaaaaatcaaatctagggttgcatcttgcatgagtgatggtgatttaccattgtgcagtttgcttttgttactgtaagttggatcttcatgtacacttgtaggcaaggtatttagtatcgagatactaggtaggatcgttttttatttgtagtaccataggatcaggatactatcagattttagaaaatacatatttttatataaaatatgtaatatgttgtataaattaaagtatataatattgattttgataaatctaattggttttcatataaacttgagatatttattcacattattgatatccaccttttttaaaataatattttgtaggattgtagggatcattgaatcgggatactacataagatttcgtaggatcgtgtggaaatgaatagtaagatcgagatactatgaaatttaggatatttggtgggatcggtatcgtttcgacttggtaggatcgtagtatcataaggtggatatgaatcgggatattgacaaccttgcttgtaggtaatataacatttggaacatgtgtttgattatgtttacctgcatgatcttgattaacattaatattttattaatttggctcaatggttggttcactgtgccctttcattttgctgctttgtgtggtctgaactaataaacctggtggttttttatattttgttacttctaaaagctctgtattattttttccttaggttggtcgttcagggagatttggacaccttggtttggcggtgaacttaatcacttatgaggaccgtttcaacttgtaaggatgctttgccagagtagatcctgttgtttactcttgtaccaagattctgacctgttcatcttcctttataggtatcggattgagcaagaacttgggacagaaataaaaacgatacccccacaaatcgatctggcagtgtattgtcaatgatcaatgtaacattgtaacggtgtttttatcatttacttattgttaggcaagtacatcagatgtacatagcacctcatcaggtaagcagtgaatttcttagctgccactctttcaaacaacatgacatattgtttcaggtaataattgaagttcttttgtatacccagggttttatttggtgccttgatgacacatctaagcttatattccattagtgaggaagtgttttctgtcggcactgatactaatcatgttaactgtggacttgcatttttggctgcttgaagacgctgcttgaagacccagggctgcggccaaactgaacctttttcttgctccttgtatctgctcaatatttgctttatattcatttgctagcgacagttttggttgtgttatattaggatactgctgcttgagtctgttaccgtcactgtggttccttaattttcctttcctttttcccttttcttctcatgtttggattggactagtagaagtatttccctcactgtattcctcgtgtcaatttctattatccttggtgtagactgttaactttctttaatttaccctcgtttcgtaatatgtatccttgctatttgtgatgttttacacctacttctgtttgacccattacaagcttattacaagctgcaatatataatctgttacatagacattaactttgcctacttaccgaaaattcgagatatcacatgttccttttttcctagaactgagataaacgaaatattttgtgtttctattgtgatacatgtagacagggtttctcttacagcgggggtaagcggtagtgcttggtggattttgagcaaattaaaaaattccaaaaaaatggaaaaaaaatcatggatgtattaacgatagatggtgaagaagtttgttgaaagtgcaagtgtaatagaggatcaaatttgtgggcaaaaccgataatagtttagggtatggggaatggaaaaaagaacatagtgttgggggccttcctttgtattacggtactcttgaattatcatgctatgaagtccataatatagaaaaggtaagcttatgctgaatttttgtattttatatccacaagttaggtttgcaagtatcctatatatttttctaattatccccaacttctacacgcatttaagtgtttttccatttttttagcatttttttcattttcttttcacattttctgccatacatgtcaaggttatcatgctaatgtcgcggttaccgcggtaaaccgtgcacttaccacgaccaaactgtgaaaccgcacaaattttgaattcaaatttttgaagatggaattcacacggttaccgcggtaaccgccttaccgcgggaggtgataacccatcccaaacaataagttaaaccctgtatatagatcgaattcagtattgcatattcgagatatcaagtgatatatgtttttgtttacaaagaatttcatgatcatatgaatagatataaaatagatataatgtctctccatttgacttaaaaattgacttttccccgtatatcccgccattacagtatgtatatctgaataccattttggttagtgatgttaagtcctactagtccactaccagcatgagagctgatcagtcctctacacttgatccttcaatgatgacactttgatgaacataacaaccattcatataaatggcatttttgagggagtataacgaaagggaaaacaattttatgattggcccactgacttatgggttccatcctgagtcagccgccacattggttaaaaccgtcatcaatactgccatgggacctaatgtgaccctgttttgtaagatttggtatatatcatatctggtattctggttcatggatgattttgaaactcgacgacaagatgagggatctcaagtgaacttcttcctatcgataattgttgagcaactacttagcattgtgcgccacttcgtgcgttgtcgctttgtgttggtagagggcaacttctaggggtgaaaatgggcacgaaaattcccgattgactgtttccaatttttacctgacgagcaatgtggaaatggttttgtcgctttgtgttggtagagggcaacttctaggggtgaaaatgggcacgaaaattcccgattgactgtttccaatttttacctgacgagcaatgtggaaatggttactgacgaaaacaaaaatggaaatgatttttgctgcatacctaccactttcaactttttaattaccatatttctaaatacactaagtaatatttatagtctatttctttatttgaccagtagtttagatacccatcaacttctcaaccaaaatccctaacttgggatgaggttaaaaagagacaatttataatttatatagcataaccttgaatttattttatcgtattatataattatgcaaagttaaacgtatgatttattgtcagcttcctcgataccgacatgttttcgttcgtacagtctatttacgatatctcctgttttttttgtttccgacttcatcttttaagttttattttcgaaaaaaagatatgattatgaaaaaaaaactaatatacggaatcccattggaggcacaagggcactagataaaagaggggtaaacattacatatcttctatatacgtttctcctagatttgtttcccccaccgatccatttttctcccccaccgagtaacaacgcttcgtcttcctcctccctctcctcaactccttgaccattgtctccaacatcgacgacatcacctatcctcttttcccccttcctacactggatttagagcatgtgagagaatggagattggcgagggcatgggggttatagccaaagagggagccagctatgactgtgaggttgggggttgtcatgtgtgagcagaaggaaaggaaggtagtgaggctaagggggacgacatcctgggcatcaacaggaaggtggaggtggctggtctcgaagtagatggcgaccttggagttgatgaagtggatacttcaacaagatggtcttcgggtttcttcatgctccttgtcagcccatcacttctactactcgatgttgtgtacaagtacatcacagtcgatactttaggtaccaggagtcgattccaggacctgataccttgggtgtcatgcctggtacccaggtaccagacaagtactagggtatggtacctcaagtactacccataggtatgaggtgcatagtattatgtattaggtattgggtctgatacctatggtatcaggtatcggatcaaggcgtgagcaagaagagcacgctgtcatcgtctggctgaccggcaagtcacctatcgttgtctcatcttctcttctcccttcctctcattgacatctccctccttcctctgttgttgctgtgaccggtgggggcaaagagctaggggtatcgctgctttgtttttttacaacataggagtctgtaagtccgaacatggagaattttaaaagtgaaagattagatttataaagttatcctgttggatcagaatcccgtgctctagtaatcctctttttatgaaaatctccgaccgttttcattccatatacaaaccgcggccaccgttcaaacaatcaaaccagcccaacaaaacaaaattgaataggaccacacgcagtcactcacgctcgccgccagcacacacctccgtgaagccggcgccacggtgaggcactgacgccgtgggcccacgagtctcccgggcccacgcgtcatcctctccatcccctcgtcgtcgtccgctcgcctctgcccccgtgccgaccttaactgccgccgttgtcttctcctccacccaaaagctcgcgaatcaatccacgcttcagagagagagagagagagagagaggcaggtggcgccgccgctgtcccgctcgtctccggtggccggcaggcggccgcagatctcgtctgtccaggatccagtgtgtgcggccgcgggccgccattgtttgggaggaggaggaggatgggtagtagcacaagcgccttcgtcatcaggtggatcaacttcttcaccatggtcagtcgccttccactcctcgcttgctgctcagttgccttcggctcgctgcccctcctccgcttgctgtgttgagcttgagccgcctcacggtttctttcctctctgggctggcggctgatttgctgaaaatgagttcatattgctgccgcggcatttgtaggattcgttgtttggttgggttcctcggctgtttctgtttgtgaagcttagctttcctgcaccgaattcagcctgtttgattcaatgcaacacatggattttgagttttcggttctcctaaatgccaaattacaatattcttttattgcattttttgccttcacatttgctctgagtttcttgtcttcctaatttcttcttctttcatttagtggctactctcaattaatcaatttcacttcttttggatactagtagcactcagtttccagtttaatgttggcacatatccaggctccacaaaatactccacgaccatacggaaagaaacattgcatctttcagcatcaatgcattttatgacactcttaaattctcttcttggttggcagatactggcactactggtggtggggttcgggttctggatgagcacccacaacgacgaatgcaggcggtccttgacgatccctgtcatgggtcttggaggagtaattttcctcatgtaagaatccaagtgtgtccccatgatgttaatctgatgaaccatggtgatttgcgccgtcttaacccggctcagtgttgatgttgcagatcgctcgtggggtttcttggtgcttggaagaaaattgcttgcttgctatggacagtatccttttatttctgaagaaattgatgcatatgatttttttattttatttttcttgtacttttggagttagctgttaccttgacatgtgggtgtctagtatctggtaatgctgttcgtggttttggtggcaatcatggtgttcacagtgcttgcgtaagttcagtttgttaacacatttgatgcagaaggcctttttcagtccaacctggttacaatcatggagtacctttttatttaaaatttgctggtttgtacatcaattaggtgatagaattgaattctaccgcaccatttagggattaattatcaatggacttggtagcttcttctagtggttgcatttttataaccttatattggcatgcactctttgtctgaaaaaagatactggcatgtactgttgcaggtttattatcacaaataccggaactggccattctgtctctggggtgaggtatgtgacagttagtagtacttgcacaaagaattccaatcctaaattaactaacacttgcaatatctgaagaacacaaagaatcttacatgctgttttgtttaatcattctttgcaagcacacttaatggtgtcaaaaacagttttgctgcagcatgcttatgtcaccacacaagtcgtaaatcgtttctcatgtttatgcagatacaaagagtatcgtctgcaggattatagctcttggtttatcaaacaggcatgtcctatttttgtctcaggaaaattcagttgttcattttcctatcatgcagtagtacgttttatattctaaatattttgttcattttctcatactcagctgaatgacactgaaaaatggactcacctgagaagctgtcttgtgaaatcagatgattgtaatggcttgtcaagaagatacaaggtcccccctcttcctcacatattcttactagttactactgatgtgctcactataaagtcgaaagtttctccatttccatcaatttctgccatgtcaatcttacctgtactcttctactccctgcagactctgaaacaatacaagcttgcagatcttactcctatggagtctggttgctgccgtccaccggcagagtacgcattttaaacatctcacagtatattgcaaacttgcaactgttcatcatcaggattttgccataattatcaaatttctctgaacattgtcaggtgcgggtacccagctgtaaacgcttcctactttgatttgagctatcatccagtcagcacgaatgtcgactgcaaactgtacaaaaacgcacgctctgttctgtgctatgattgtgattcttgcaagtaagctccctggttgccaattcccagcttggaattttggaaacatcaaagccattttaagaaaccaatgcttatatgaattgtttgattctagagctggggttgctcaatacatgaaaacagagtggagggtggtagccatctttaacgtcatactgtttgtcatcttggtaagccacagcatcaaatacaacacatataatgtctcattttttcaccatataaatggtagattttccaatccatcttgtgttatttttgacattaattttttctcaaccttttcttttctcttggcttttgtttgcgactagtctttcgtctacttcgtcgcgtgctgtgcgcgccgaaacaccggagagagcgactccaaggttcctacaagatggcatgcatgattggcagatgaagcatcgtagagttagcttttgctattgcttgtagtggcattgttcagtcaagtctcgttggtgaaatggaatgcaagggcttttcctttctggtgtgggatgatgatgttctttgttgcagttggcttgtgaacattttaggaataagttcattttaggtcccttaactttacaccgaatccgattttcatccttcaacccaaaaaccagatacaatcggtccctgagctatcaaaaccggtgcaaacgaggtcccttggcggtttagaaggcggttttggctgacgtagcgccaacgtggctggtttgatttggtcttcgtcccacgtggcatttgacgtggccgttatgtggcaattctatcccagaaaaataataaaaacagtggccccacatgtcagctaaacacaaaaaaaataataatggtggggccctgggccccacctgtcagcttcgcctgccttctttcctctcccctctcttcaccagccgcacgccgtcgcggaggcgctccacctccggcgccggcgactccctcagtctggacacgtcggcgaccgccaccaagaacgcctcccaccacagcacgtcggcgaacagcggcgtgtacctgtcggcgaccagcactgtcacgcacaggcgacatgtcgtcgccgtcagcccgtcacgcaacttcgcggtcctggattgcgaacaggacgaggaagtgcttcgggaggtggagcgcaaccggaaccacgagcggcggtgggctgcccaggggctggcggggcggcgctgggcgctaaagatgatggagaggaggccgctcacgaggacgacagcccgcgtcattattcttgatactggccaattaattcttgattctttgtagatgcgatgattttagcttgagcaaaagcggtagagcttgaatgcttgatactgtactggttactcaacttcatcgcaagccatctcggtcgctgccgtcttgcttggcaccgctcgccgccaccctggtagcagtagcagcaaacaatatgcgagattcttcagggaaataccaagttctggcgctgataggcggcgccatggccgtaacggcagcagtggttgcgtccgtgatgacaagctacaggggtcgagcatggggatctcgatcttgtccgcctcctcctccttgcttgtgttgctctgcgcatcggccgagtcgccgctggagcctggagcagttggtcgtcgcggtggaggatgacgatggcgagggggacgggacgagcacgtcggtccaggtcatcttcttcttgctcttgcccccacccttcttctgctccggcgacacccgcttcttgaggtgcgtgctccacctcgccgttggcgtcctctcggcctcatcccgtcgccatctcccaggagctcgccgccactctccactgctccacccgccgcccctctctccgccagtcacccctcggcatcgcggtgccgtggccccttgcccctgctccggccaccgccgcttagctccactggcctgctccggccaccgcccgtccagctccgccccgcctgtcgcctccaccccgctcaaccagtcaaccttgctctgcccaggtgggagagagggaatcagctcctctgacttcagccctcacgacggcagagagcagtcgaggtcatccagccgtccacgttcgatcgaaccgtccgcccaaaaagcgcacggccgcgtcatgagtctgggccaaggccggcccaacaagccccgtccccgtttggccgccgccatcgcccagccgtgctcgtactcctcgtctggccgccgccatcgccgtcattcttgtcccccgcgccgccctcgctctcgccgtcgtgctcgtcctcctcgccgccctcgctctcaccgtcgggctgcggtactcagctgaggagatggggaccggaaggtgtgcacgatgcagcgcttggtcgcggccacggcgcaccggtgccacgagctcgatgtgcgcgtgccgagctcgagcaggccatgcgccgcgacaggcagcgcgcggcgaatggaggaggggagcgagtggaggaacatagcggcctcctcggcagtcagggagaggaggaactcctcctcgccgtctctcagcagcgagcgagtggaggaacacagcggcctcctcttcagctccttaatgctgcgtccaggagtgttgctttgttgtatgtcaaaccgaatggcattctggagatactgaatgtgcagttattagaatgatagattgttctttacacaggcagcagaccacttgttctgaaaaatggggttgcatgtgttctgtaatttgtatagaaagcaaaaaaactctgtaaattgtttgtagtgagaatggcttgtccaacaaaatgatgaaatggccatttgtaacttatcactgcaatgaaattatgttccaattctgggcatatggcctgttcaagagaaccaacagtttttgtcccccaaaatgcttgctatctgctgtccagtaccaagtgtatatgacatactaaactgtacacactaaccacaggcgtgtgcattcagttaataaaaaagactgaaggtgttcattgatccggcatagcgtcgtcctttcagaagagccttgccatcagaatcctcttccaagtgctcaacaccaatcatgtcatcccctgcgttcagcacctgttggcagtggtgaatgggggcatctgcacatgttcagtaacaaacaagggaggtacaaccaatggatgcataaatgctcaccttgcccaaaagatcaagctgttcatcaagcgtgccaaaagaacaatctcggcaggtgccgcagcccgcagagaccaaaagcctattcaccaaaaccaaactccattgctagaattcaacatcaagatcatcgacggttgctccctgaaaaattaaagaaaatttaaactctgtcgatgttaatactaattgatcatagcttcgaaatattaccgtcaatagttgagagaaggtgttgatggccatgtatggttcagacatttcttccatgggcaaagaggtactaggatatatattttgccctgctggattgtcatgtactgatgcttcttttccctttttcttgcctcccgtctttgcagtcttttgttccttcaaataaaagaaataaaactgagcatgttcccattgaacagtgaaagagaaacaaatatactttgaatactgaacatgttcacatacctttgaaccttttttctttctcttacctcccttgttacttccattctttgtggacttgtgcagcttatcaagccaattttttttgcgctttgaggtttttgtttccacctcctttttctttaggcgagctgtactcaccaagtcacttggaggagtaatatcagtgggacctagagctatggtatcagtaaatccattgatttcttcttcaacttgcttgctaaggatatcaagtgcgttgtttactaacaaggtagaccctggatggctggcagctcgaagtgccaaattgagaaatttgcgggtcatatctttgtagcgaagcatctcatttaatcttgggttctctataatacttcgtccatggttatcttgtactgtcccactatgtgctccacgtgtccatcgcttcagtacatattgtgatgggagagattttatattcatcaaatcaaggacttttaaagcatgtgcacacaatattccagttctactgaacatcccacagccgcatgtactagtttgctctaaaggatcaccaacaactttgtactccttctcaaaggtacaattttcatctagactgccaattgccacaagatagcaattgttgccttccaatgccgtggtgcatgctaccataggtacaattttcatctagactgccaattgccacaagatagcaattgttgccttccaatgccgtggtgcatgctaccatggatctttcatattcagcttgaaaagcttcgaatatgattggtgtgtatagcttgctagcttggattagcataggtgtcctcatttttattctgggtattttcttccttgattcaaattcagcatttagctcattttctcttttatcttccaccaccctttcaaaatgctgaagaaatcgaatgatatcaaaatcagatttgaaatgcctcttgagttcactatttacactctcacttaactgtgtacttctcatacctaatgtgaacacatccttcatgtaacattcagcccatttttctttcaccttgtatatactatccaaccaactttgcttgctcgcctttgccctatggtgcaaatgcttgttcaaatgtttcctcatcttcgtactcaaacatacatgcactaaaatctgcgagaatacttcgttcttcctcgttatcttcggcagtctgtttgggagaattactggattcttcatcctcgagttcagctacatgtttaacagcattctgcatgatatggaaagtgcacaaaccatgccatgattctaaaaacactttcttaattgcttttcccattgcagaatcctgatcagtatagattgttttaggttgcttgccattatgtgcttttaggaaggtctcaaataaccacttgaaggactcatatgtctcatcatacagtagaacagcaccaaaaaccattgtttccctaaactgattgaacccaacaaatacaccaaaaggcctactttccttgtttgttccaaaagtagtgtcaaaactgacaacatcaccaaaatatgcatagtcagtgagcattttagcatcaacccagaatatgtttgctatttgctcctcactatccatctgcaatgcatattgaaatgacgggttctcagcaattttatcttgaaaatgcatgagcatgcttcctgcttgaccatataccatctctcgttggcgtttgccccgtaaataattcttgtggtcacggagagtgcaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgtttgagtacctttttctaacctcgaaacctttttgaccaccatagctaacccaaaacatccaagcctcatcaacagtattgaattccatgccaacttcaggtaacaaactaggtagcacacccactctacaggaacaaaaaaaaaatgatttggtggtcatcgaacaagtaaaatctacccgatcatggtgaaaaaagtaacaaccatagctttacagacctgttttcttccatctcaaatatgcagattttgctggaggcttctttgatgaattattccaacactgtctaatggaggaggtggaagacaatcaaataatttgctgaaaaaaaggaagagaagaggccagattacttcacctgtgcttgatcaacggtggaatccgtgctgaaaaaaaaaggaagagaagggttcagatgatcgcctggcgctgtggcctcgtttggcgccaaaaaggcgagcacggccgccaaaacgcatctgttcgcggtaaaaaggaataggagcgagacagacggcgctggaggacgaggcttgttgggccggccttggcccagactcacgacgcggccgtgcgctttttgggcggacggttcgatcaaacgtggacggctggatgacctcgactgctctctgctgtcgtgagggctgaagtcagaggagctgattccggagagagaagatagagagaagagggatgacatgtggggtcaaatgggtcccaccattcattattattttgcgtgtagctgatatgtgggccccatgatttttatttttttagattgaattgccacgtaagcgccacgccacgtggaatgaatacctagtcaacggagccacataggcgccacgtcagccaaaaccaagtacaatactgccgagggaccttctttacacggttttataagtatgtgttgtacccggttttgtactaaagggatgaatttcggactcagcgacaaattaagggacctagaatgaacttaatataacattttatgataaagaatgccatctcacttcagcaactgcaacctgtgggtttttatgctcattttgcaaatgcgctgctgggttaaacaatggcaatgcagggatagagtgatagatcaatatccaaaaaaaatatattagtagaatgtagtaaagcacgagatgtaaatttatgtagctcaactaatcttgaaattgagcaacgtttgatgacggaagctgtcaaaacagaacaaaaaaatggcgtggcgtgataacatagccatagacgtgggcatcggtatctgctgaattaccctccagtagcgcagctaaatgaaaatagcaacaaaaaaaataagtctgaacaaatatgtgactgatagttgttcaggtgctacatctggttcatgcaacgtcagatttttcacttcatcgagcttcacttatcgttcacgagggggctgtaaatagggtaccacatcttccgagccacaaagtcgactgtgtccgcctgtgcacacatgtaaaatgacacatttcagacgccaaactggcaaaaaattcaacttcagggatttgaaattatgtatgatgcagtacctcagtcatgctcttgaggtccctagcgtctacatcacaacgcccctcggccagatcttcatcaacagcggcacggacgactgcggcgccgacacgtgcggtgatgtgcctgatactgcatttttcatggtggtatgttgattagcaaaagtggaatggttggattatggtatcatgctgcctatcagtctgcaatggcgcaggttggatggaagagctaaccttgagattgatggaaagaggatgccttttcgaatttcatcgtctgtgatgtatgacgcaaggctgcgtcagaaatcactagattagatgcatagctcaagccgagtttagttccaaactttttcttcaaacttctaacttttccatcacatcgttctaatttcaaccaaacttccaattttggcgtgaacacacaccctcaatttaccaggaaaaaaaacaaatcatacaaaccatccaagatacattaattatagaaattgtgcaatttaaggtggagaaaacactactttgtcaaaaagtacggctgaagcgtgtaagctttttacgtcacactgtctaatatgctggacatcagtaattgtacttgttagtgcagttgagatcttaagaaatagagctacaagacaacaagcgaaaatatgatccgatcaaacaacagaataaaacttaccactcagctgctgattggagcatgccatctgtaatatgccgagcacctgaaagaagggctcctaaaccgatactgaattatacagaaacgtccatcagaataacatataaaaaaggaaaaaaaaacaagcatttcaaggtaagctataacagttgtcatacccaggaaacagatacatattgtttgcttgattagcgtacccttgtctaccattgcctgggacaaccacattataaaataagtggtcttatgcaaaagtgctagcaaaatgaaatgatatagagaatgttaaatagggcatacctaaagtgacattactgaaagggcttccactggcaaatactgcattgtctccaacatatttgaatacatcttcaggagtacattcggctgtaataagaaaaatataaatatcaggcatttatgtttgggtatcctagaagtaaatattaatgggtgaggtgaggaacctttagtagttgggttggacattgcaaaaattgcaggacgaggggaatcggattctttcatagccttgagaacctgcagaggtacaaagataaagttaagactccaatgttgaaatttataagagagaacatatgagtataccctaacagatgaaatccactaggatcatgatttagcacttcgcaacaagccggcttaatattattacatttgcaaaggagagaacttttgaaacctaacaacacaaatacatatttgatgctcttgtaaccatggtttactcacaaatcataatgaagcaaactaaaacagtatagaaatggcccattaatgtaaacctcacaaaatcctttataaggttggagaaaatattctaactcaatgtgctaccaatcactagcat

SEQ ID NO: 58469 - DNA, 2608 bp, Oryza sativa
ataatattttgaaatgttttactatatattttatcttttgtttatagtctccacgtctcttctaaattgtgcatcgatcatgcatataaagtctaaatttgcataagttaaccgcaaagtttaatttactttgcattttatttgctttgcatatgtgtgtgtacttttatgcttctctctaacccacctcataaaaagaattgccattgatgatagagattcaccaaattagaattgtttgaaggaaggtagaaggtacctaaaaccaacccactttgttattacaatgtgatccccacacctgggccacctctgttgttctgttattaatttgttgtgacaatgccaatgttcaatgggatcagtatctataatcctagcttaatttccgtgaagcatctaacacaagtctccttcggtagatatccatacgtggctacgtataatgaatctctggcaagtcattaagtcaagacacgcttgattgcttttcataccagaagaccaacagtttgtgtcctgatgacaatgggtattgagacagcacggttttgaccacacatatatttgggagcagttcgacacaccaagtgaattttatgtggaacaaatcctaccctggaaatttcataccaagtctaaggccaagtctactattttcacactaagtcagagctcaaattgttgttagagcaggcttaattacgcattgatcgaggccggtcagctgctcaggtgctgcatgggtaccacggagaagttttcgcactcacacatgacacatcaaacacccccaatgattactagtacaaaactatgcaaatgaactaagggcatgtttgattcaaccctgagataatactctatcttaaatgtgatctacatatcattgagatatcaccaaacttgctctccctccgatttttagtatttaacgccgttaaattttttatacttatcaatcttattattaataaaattacgaaacttaagagcttatagtatgtactataaggacatgccctcgagagcttggacctgttttgtagggctcttgctcttacttcacatccgcttgagttagagcttaatcaaacggtttcagatccatctaaaagaagtgtgacggatgagagtaatctgaaaaataaactagagaagtgaacatttaatattacactcatccctacatccaatagaagtgggcatttaatattacactcatccctacaccaatagttgctcacagtttccaggtataaaacataggacctatttagcatagctccagctccatcgagctagagctcaaccgaacaatttcagcttcacctaaaatgggagcgaaactgggtgtagctctctcacacaatgaactagagaggtggatctagatttaaccaactccacaactccattctagactaactactaaagctaaatttgtaagttggaactctaccaaacaggctcaaaatgttctcgtggcaggattattaagcggaactctcaaaagacatcatattttaaggcactctggaaatagtacttataatttataaaccaaggattcctatattatatttgtaagactgacagtagtattgtttgttgaaacttcctttggacaactaacttctcacatgatggctgatccaacaaccccgatgaatattagatattgtgatcgccatcacaaatactatatatgtttttttcggcactctttattcttaaacaggtgatactttaaatatgcatgaatagtcaaatctccaaatattttgctaacatattgaaaataatatagtttggtatgggagaaatgaaattgatagacttatcattaaaaattacttgtgtatagacatattttgataatttaaattaaataagaatatgagtacaaaaaataataataaatatgcatggtaagttatgttgatatcacataaagaggtaataaaagtaatattccagctgtatgaaactacagctatctcggtcaacatgattccatctgtaagaaacaaaacaaaattaaattaactcgagctggctagggagattattttaaaaactttagatatatgcacacacttcactcttcccttaaaatacatgccaccgcttggtgtcgatatttaaagggcatgtttgtgaacttaatgtttcgagaatataagaaggctgggtctactaacttctaacatttaatttattccatgagtccaataactatattttttagaatttggttaacaatagtctattgtttgaatgagctaaagatgctgaataaaactacagctactataagctgctcaaacagggtacatgaagcataatagacatatgaggtgccacaaccatatgtccatactaccatatagatgttactccctccgtcccttcgtcctaaaatgtagcaatctaaaatatgatgaggcctattctacaactttgtaacagctgcgataattgttctaactattactatatggttcacacaatcgcttaacctgtaaatgtctaagatgaaacttttacaccccggcgtcatgctcaaaaatcacgaagcctggcaggacatgtctcacccttcgca

SEQ ID NO: 58470 - DNA, 70472 bp, Oryza sativa
ggatcccccgttttttacagatggccgacgtcgaccgccgcttgccggtgcggcctgacttcccgcgcccctgccgccgtagccccttcctctcccgcagcgcgcttgcccaccgtcggccggccgctccggccctcgccgtcacccgcttcgcccaccggccaccgcttgcccggtcctccggtaggccggtgcggctgccacatcgccggtcgccggccaccggccactgaacctcttcctctcctgcctcgcctcgttggcttcctccccaacccgccggtcggcctgtccacctagacgaggagaaaactgagagagaagaggcgacgggcagagtggcggcctcgctggcgcgtgcctccactctcgcccacgccttcttcttcggcttccacttttgggtcggtgccggcctctcatcccgcgtggcggccatcggtgcctctccgccactgtcgcctccgccctctccgccacacggctcgctcgcccgccaccacctctctgccacgacgctggcccgctaccttccccttctctcgtgtctcagccaccgccgcatcgttggccggccgtcaaacctctcgccctggcgaccccctccccaccgccggccagcatgccgacgacgtggcatcctaacatgttgagaggaaaggtagggagaggctggcttgccaacgtggcatcctgacatgtgggtcccacgctgactcagccgccacgtcagataaaaccggggtcaaaatcgccgagggacctagtttgcactggttttgtaagttgggggatgcgttgtattcggttttgtgattggggggcgattttttaacctgatgagggaccttcggtgtactttttcctaagttgggcgggggaagaaatccaaacggtccaattaaaagagcgaagtaaaattccaaattaattcgaagaatcggcgtcaccaaatcaatctcgcccttggttaatcttgtacgattgttgtgaaaatcttaacatcaaattaagagattgatttaatcaaacattacaccaaattaaccgatacacgtttcagcatgtacgtaggagttaggataggagaaaatcaccagcaattaagccattaattaacaatgaccggaaaagggagcgcgtgatctacctaccaataattccaattcctaagccaagaaactaactaactaacgtacgtgctcactgccattgtcgtcatcgataatcgtcggttgcaatatcctcttttccgttgccatttcgctttccaagcctccaacttttatgctgttcatgagcatgacagcgtgcatacatggcattacagaatctacagatgcacaggctagctgctctgctgagataggcgcaggcgcagcgcaatccaaagcagctgacgccttttgcatcctgccttctttgtaggcttcgtcctcctacctctgccatggctcagcgacactggccatggcggctcgccgtgttcgtcgccgccgtcgtgacgccggtggctgccgaggagaggctggtggtgggcatgactctcctccaagctgccacatcgacaggagcaggcgaggaattcttcttgttcttcttcttcttgttgttcttcttcttcttcttctctgtgtgcgatttcttagtgttcgatcgattgcattgcaccgccgcgaatcgctggcgaggtcaacgagaaaggaaatggagattcatttaccaatttaccatgcaattggaaaattccttaattagttgaccttgctaggcacacacgtacacatcgtttgcattcttgatcgtgcgcgttgtttcaatcgatctttgcagtgtgcctcgacgggagcccgccggcgtaccacctccaccggggctctggcggcggcgccggcggctgggtgctccagttcgagggcggcgggtggtgcaacgacgcgccgtcgtgcgcggaaagggccggcacgcggcgaggctccacgcgctccatggacagcctcgaggtgttctccggcctcctcagcaacgatccggacatgaatccaggtgcgaagtgtacggccaatataaatttccaagttaagtcactgtgtttctttctcaaacaacaacaagtagcattgcgcaaaagaagaaaaaaaccattgatttatactcccttcagattagtaatcttaaaaacaaattttatcacacattttatatgataatatctatgctatttaaaatgatattagtggttgtgtccgagtctgcctccaatatcatctgatatgtggggtcataagtataaaatcatcaactcgtgaatggtattggaattgctaattgtaggaattttaaagggttacatacacaaccttcaaatttacctttcaccctctttatctaaaaaaatttacctttcacccatagatgagttataagcgttcaattttgtatatccgaccaaatggcttgtgaaaatagacgaagaggataaaaaaaaaagaagatcatctagcaacatattttagttttgactttggatatgacattatatgtctaatcgagtgactatgctataaccttataatttttttctttgcttttatcacttataatatccactataacacacgggtctttagctagtatacagaaatatcaagaaatatatgattttatcgaagtatttcttttttaaaactggtctatacatattatgatctccatatttcaaaataatattttagaaattatttctagttaaatattttaaagattaatagcggtctttttttaaaagattaatagcggtaacaataaatattatgaatgcggaggtagtagctcgtaatgagatgcctttttcttcaaataacttcgtacatttaccagttcatacggcaagttgttagcaacaacagacgtttccgttcttggtggtacgtgagtttgcttttgcaaaaggtgacagcgagcaagtacagtcacaatcgggtaggtaccatgaagggatgaacagctcatggtcaagaatagttagtgccgggatggaatgatagattcactatgcaaaatgtggaatcgtgcagtagtacatttactagtctagactctagagtcggcacatcgacatcaggctagtgtaaattcaggttcatcaacctacaacacaacttattaggtttctcgagttttagcctttcaggttgttgttttagaggattcataatgtatatttgcttgtttggtgatgattcaatcgttcgactagtaatttcagactatctaagtgactaattaagttggcgttcctaatctgctatatcacttttttattctaactttgattactttgatgcagacatgcagattttatacagtacttttgttttctactttctccatttcatatcataagactttctaacattgcccacattcatatagatattaatgaatctaggcacacatatatatccacatattcatgaatgtgagtaatgctagaaagtcttataacctaaaatgaagatgatatttgttcttcttttaccgttcaattattctatttatcatttaaacaaaaatgtagggattttaacatagtgtttgtcgtcaatttggcagatttttacaactggaatcgtgtcaagctgaggtactgcgatggtggctccttcgccggtgattcagaactcagaaatggcgtacgcttccctgtttccctgactgaaacaaaacatgtcttcaattgaattgcttgtgtttttttttcttctgcattgttcagtactcaactcactgttttgtgttttaccactttgcagtcttcagtcctctacttcagaggtcagaggatatgggacgctatcatcagtgatctccttccaaaaggccttgcaaaagcccaaaaggttcattggttctcctgaaaacagtttgttccatttcagtattttctgcacaaactcattttacaattttcatcgcgattaacttaagctggaatccaattctttgatgccaatgtaagcttttcaacactaacaataacttactagctactccgagaatcctaaacggcatcataattcataactcactcattcttcaggcttcagagcttgccctgttgcctttgttcttaacaagttctgaatttttcaggtattgctctcaggctgttcagcaggaggcctagctacattcttccactgcgacgacctcaaaggacgtctcggagatgctgtcactgtgaaatgcttgagtgacgcaggatttttccttgatgtgtaacagtggagtctaatcaagcaaaaaaaaattactttggttgactgattcttgaactcattgggttgaaacacaaaaatttactttggttggtgtcctgcagggatgacattactggcaacaacactgttgagcctttctttaggagcctagtagctttgcaggtaaccgactagttaagcgtgtttctgcacattggatttcacattatttggtagtgttttaatttttaaagccatgagtttttcacgcagggagctgagaagaatttgaacaaagactgtttaagttcaacagactatccataccaggtagtatcaattaagatttttttttatcttccctttcaaagtactgaatttcattgttcaaaagttacaactttttataatcttcttgtctcacttctctgcgcagtgcttctttccgcaatatatacttccatacatcagaaccccttacttcattttgaattcagcttacgacgtatatcaggtaaaaaaatgacatggcgcaacttgatgttttttagcatatggttatacaactcgcaagcaaaaacgcatgatttttaccttttttgaacagttccatcacaattttgtgcatccttcatgtgatcctaaaggccaatggagccactgtaagtcggatcctggtgcatgcagtacatcccaaattgcgactctccaaggttacctttttttttctctttcttggtagagctaaatactaatctgtgcaattttcatataaacaataggtgcaagtctattgctcttacgaaattcacactaaagattattcagatttagattccattgaacaggcatatgtgagatttctggattcaagttgttgtcttcgtgacattcttcagagttctgaatctgtctgcaggactcaggaatgcaatgttgacggctctgaagccgttccaaaatgaacagggtgtagggatgttcataaattcttgttttgcacattgccagagtgagctgcaggaaacatggttagcaccaaattcgcccaggttgcataacaaggtactggcaatctacatgaaaatgttgtgtatatgcggtgtatttgcaggcagacatagatgatatctggtttgtttcagacaattgcagagctggttggtgaatggtactttgagagagggcctggcatagaaatcgattgcgcatatccttgcgactcaacttgtcacaatattataccttctaatcaggtttgttccattctagaggagtttttttttttaacacaaaaatacagcattgtatcatgtaccatatccaaataactgtttgcttgcaattcaaacaaaatgaatgaaactgacaaaaaatgcttggtgactaggaattggggatttaggagtttggcaggggagcatccatgcccaactgtgatcaaaataacaaagatttcatttagtttggtgaataaactgaaggatgaacactgttacaatgtaagtacacttctctgcagaacaaaaagacatcttaattggataggatcatcggacagaaggttagcattaatacaattcatatctactgatccattaaagtaaatgcaagaaaaaatccaaaacaaaaataaagtaaaatgtatggactacttgatcttagcctgatagaaattgggtgttcagttgagattgctgtacgttgctgtggatgttgctgcagctgcaaccacaataactactagtttatatcaagctatactaggctactgcagccctgtgactgtgcagcactgcagccacagccacagccacagggaaccgaacatcccaaatgaatatgcagacacagttaatcctgattcctgaatgaaccaaatttcagtccaaacaattcgacatcttgcactctgcatttctgcaactaaagactgcacccatgttttatgagttccaacatcacttgattcatgttactaaatatgcatctgtttatgcagaatggagactcaggcatccacaatggaggtccctgcatgaacattcctcccaaattctacagcatcagcctacagatgattctttacctgtctatattgcacattgcagaacaattcataatttcatacgacatttgattgaacagtaaaacagagccaatgctcttgtaaccactgatgttctgacacttctgttttcctctcactgatacatgaagaaactattaagtctataacctcagcagagttaacaaaaaaagcgagagaatatgcattgcagaagcagattaacatgctacaacagtatcaaaagctctacacaattgattagcacttgagatcacaattgcagaagcaggactcatatatgacactgaactgtaaactctgtaagaggctaaagagctaaaccatgcacatctgagtcatgatgctatcactatctttaccctgatttgcttgagctgcttgacaatacatgaagagaaaaaatcgaagcttttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgtccgagagcacgaggaggacgtggccgagcgactccacgaggtagtgccgcctcagctcgagcgacgggagcgcgaaccccgtgtccctgcgctgcaccttggggttctcgtccgcgagatcggcgcgccacagccgcctccgctcgtcgacgaggtacaccgtggcgccgacggcgacgacgtcgctgagggccgcgtggtggcggaaccccggcgcgcgcagcgtctcccacccctggaagtcggcgccggggcggcagaaggcgaggagcctgtccgcgaccaccccgaggaagcaccccgcctcgccggcggcgggagacgcgtgaggacggcgtggaacagtgcgttccacctggcgattgtttaagaaacgatcctctggtcgccggtgatggggttgaaaagcatcacgcggcgcggcgcgtccacggcgaccatgacgacccacccgtgccccgtggcgacgcaccggtgcatgtccctcgagggcacccggtacccgtacgaccgcccgccgggcacgtcgtagaacacgcggcgcgccaccgcccccgcccccgggggcgactcccgctcggggagcatcagccaggggaagggcggcggggcgtggccgacgcggcggcagtagaggcgccacgcgcggtcgacgaggcggagcctgaggtagtcggcgaaggcgaggaagggggcgaccgcggcgaggatggccccgcggcgcctagggtttcgtgggttgcgcgccgccgccatcgccgcctccgccgcgcgccgccgcggcgcgagcgaccgacgcatgcagcccacgcgacgcgacccgacccgacccgaccgaacgggttcgactcagccgcgtgctctctctctctctctctctctccgcgtctcctcgtgcgcagcgcacgcacacggccacacgcctagcctttgtatgatcccgcgacgccacgcccctctcctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggaacggatggagtatatttatatgaataaaaatgtgaaatggggaatttccagaaaagcaaacttgaaatctaaaattggatacaaatgaaatggtttttatttcagtatagtgaataatattgagggagtctataaataaataaataattaaagagctttcaagagaagtggattaattatttaatgttagtctatatggttattcaacaggtggtgatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgctacgagagaaagccatagtccaggatgtaccatatctctaagaccgcgtcactactcactacccaaaacaacatattttctttatataaaagaaatatgtcttatgtgcttgcgtaagctctattgtttgctctttggcttagcagcggcaaccaaaaaatattttttaaaagttgattttgatgtttttatcgtatttatttgtcagcattggtttttaagcaagtaaaaatacatataggaaattttatgtatattttttcgctaataaccgttatgattagatgtaggcaaaacgatgggactgccaatcgcttgatcaagtatcttgtaacgaggtggaggtcgaacaaataatttatattttcttttgaagattttgatgctgttttaatgtagtataattttgcatgatctccaaataaatgcagggtcttgtctatattggtatagcaaatctgctgctttgatttgcagcaataactcgagttggccttttcacatccattccaaaaccaaattcaatgtatgcagtatggcacagctaagcatcctgcagccatccagccaaagggcgtttcagttctcgtttgcatgcaaacaaaaggtcaatacttgtagtgcactggcatgcatacacggtgctagtccaaaaacaaaattcaaatctcccccaattcggggagaaatcaatttgattagcccaattcggcctggattcggagcgttcagagcctggttctcggactgacgtggcggctcatgaaggcccacccaaattggatcactgctaatcgaaatccatattgggccggaggagaattttggaggaacagcccacgttaattgggtcttagcaaaaaggcccaggacaggtggcatcgttgtcgggcccattttagcccatccaaatcgagacacatagattggcccagacatgtaggcccacataagattgatcggcggactggtacggcccatataaaattgcattgtggcccattttggaaatccacgtggcccaataaggtttggcccaccagtggacagcccgccgttactggtgctcgtcgccacaaaactctgcacttctctgacaaatcaagtggtaatcaagtcagcgagatgattctatcagttctcaaaataattttacaagcatttttaggcgcagctacacctacgtagtagttttggtttcttggcaagtaaaccgctttcagtcacaaaattcccgacgaaattcatatatgtaaatgtaaaaaaaaaatgttttttttcaccgggcaatatagatttttttttcaccaggggcaatgtaaatgtgttcttgttccagccagcactaggttcttggaaacagacggcctagaagcagagagcagtgctgaacaaacggcaacatcgacgaacaatgtcaactctgacagagaaaacaagctaagctatgttgaccttgatgatgtcctactgaacaatcgatctccaatcctaccaactaataaacaatctaatcctttttatcgtcttttgcacaatcactcgaactctagggaaaagtgagacgatcaaattaagcaattcgattcataattctctcgagaaagcataaggtcaaaccatttttttttttaaaaaaaacagaacatcctctatcctgtgcattaatggcgggtacgtgcaatgcacgccctctcagtactagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgctaatattgtattcaggcatgctccccttgatgatggctgtggctgccgtttcatggagctcatgtctctcatgctctgggcaatggctgtctctagccattggagtcattctgacgacgtttttaccccggatttagcatgtcttttctgagttttggctgcacttcttccacatttcaagtttctagatactaatttcatgttgaatctgcttttttttttaaaaaaaaagggggaacaccagtgacattatttctaacgaaaaagggggatacagtataattacatggaatagtgtaattcagattgtagcaactagcaacaagcttgctgcttaaactgaaaactatcacttcaaataggtgcagttaatagcaaactgtaaatgatgctctcagattacgtgtaggtaagaaaatggaagtgtcattaggcttggaaatttatttatttttttaaaaaaaggcttggaaatgactaatgagcatgcagttagtacaatattgtcaagctatcagcatagctaaacatgcttgcacgctggggcctaattaaactaaaattaattaaaagcagaggcacaccggccatgcaaccacgctgctgcgatcccaacaacaattttcgagagcttctatgctgctcgtgcgcagctgcaactttctcccctcaaaagaggcaaccggcctgaacattctgaacgtgcgagagagaagaattccattgcagtgccaatttgtcatttgtttaatctcctaatccaaaagaaaccatcctctgtttagccgtccgtaatctctgcaccgtccattcaaatctcctaatgctaaaaaaaagagttattttgcacgtcacacttctatcctactctgaatctctgaagaatttcaactctgaatttgtaaagttcagagctgcgtgaggttgcacgaaacagtgtattaatggccgtttgtgccgtgcaagatggaaaggtcgatcagagttcttggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttggagatgacgacgacgatggcaatgcatgcatgcgtccaattgcacaaaccctgtatgtaaagaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgctaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagctcggaggcgaacggcggcgggtgctgctcgtcgtcgacgacgccgagcatggacgcggtgaacctgagccggactttctccgacgtgtcgtccttctcggaggagcatggcggcagcggcagcagcgtcgaccacagtggcccgttcgagccgccgtccgccgccgccgtgtcgaggctgatcggccgccgctcgccggctgcggcggcctccgctctcagcctcagccgcctcagcatgaagccccgggccgacgtgctcgaccggcgctccaccgacgacgagctggagctcgtcaaggagaggttctccaagctcctgctcggcgaggacatgtccggcggcggcaagggcgtctgcaccgccgtcgccatctccaacgccatcaccaacctctacggtacgcagcgcgatcgacatgatcgccggcgaacttgttcttgctaatccgtgaccaccatgactaatccgacgagctaatgcagccacggtgttcgggagttgccacaagctggagccattgccggcggggaagaagacgatgtggaggagggagatggactgcctcctctccgtatgcgactacatcgtcgagttctacccctcctcacagactctccccgatggcaccaaagtcgaggtatccatccatgatccatccatggacgattcaatggatttctacttaccaaacgccatggctgattgattgcttgctccatctccattgctgttcatcctgcaggtcatggccaccaggccaagatccgacatctacatcaacctccctgctctggagaagctcgatgccatgctcattgtaagatcccaacaaatttgtcgcaaattaaaaacatgctgaatttgacgaattttggatgagctgaatttcgaatttgtgcaggagatactggagagttttcagaaggcggagttctggtacgcggacgccgggacgaggtcgttcgggtcggcgacgtcgtcgtcgacgatgtcgtcgtcgtcgttccggcggtcgacgcaccggaacgaggacaggtggtggctgccggtgccgtgcgtccccgacggcggcatctccggcaaggcccgcaaggagctccagcagaagcgcgactgcgccacccagatccacaaggccgccgtcgccatcaacaccggcgtcctcggcgacatggaggtccccgactccttcatggccatcctccccaaggtaattaaacaacatcaccaactccaatgcaacagtaacatcaccatttttttccgataatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattctaacggagcttactcccggcctccgtatgaaatgcacacggccacaaaacaggatctaactagaccctcaacacaaaacaaaaaaattagtgactatcaagccgtagactagatcgccacccatattccagagtaaaaaaactcctatgccacctgatccaaacaacgcgataccaccaacaatagtatttgtcgtcatcatcttcttcttcgtcttgttcatcatcgtgttcttggcagagtgggaaggcgagcgtgggggacggggtgtacagggcgatgctgggggcggagaagttctcgccggagtacctgctggactgcctggacatgtcgtcggagcacgaggcgctggcgatggcggacagggtggaggcggcgatgtacgtgtggcggcgcaaggcgggcgccagccacgggaggtcgcggtggggcgccgtcaaggagctcgtcgccgacgacgaggagcaggacaagaacgtgatgctggcaggccgggcggagagcctcctcctctgcctcaagcacaggttccccggcttgtcccagaccaccctcgacaccagcaagatccagttcaacaaggtaatcaaactaactaatctacaattcatacaaatgcaacagcattagcatccaacattagcattcaactaatcaaagtacgcgaatgcaagaacagcattggctttcaactagtaagagcatgcaaatgtaagaacaaaattggtactcttgattcagctgatcaaagcatataaatggcaagaacagcattggtattcaagtagtaattcagagcatgaaaactcaaggataccattggtattcatgatccagctgatcaaagcatataaaatgcaagaacagcattggcattcaactaattcagagcatgcagatgccagcattggcattctgtgatctatatcttcttttcaaattcaaaatttgatacgttcctgaccaaatgagattggcaaaatttttcatgtaggatattggtcaggcaatcctggagagctactcaagggtgctggaaagcttggctttcaacatcgtatcatggatcgatgatgtcctttttgctgacaagacggtcaggaaacagtgagcgacagccagagcgtctggactctggattgaagcttcccaacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgcctccatgatcctactcaattacatttcatatacttgcgtccatcgatggattgtgtctttgtattcaaaatggaaaatccaccgagatgataagttaattgcatagcacgagacaggtaaaaacaggataagatctggttaaacaaatatagctcctcccaagagcgaattgctgacatacaacgatgattctctcaaacttttgctcggctgtatggcatacaactcgaagttcaacccaaatataaacgtggtttataaacattacaacggtgaaaaagtgtgataactaacacaaatactaacttagttcaacttgaaaataataaacataatagataatgcatactactcataataatcactcgaagcaacatggccactctcatacagtgttccatcttctggatgcttaagctcatctccacagaaatagcagtgttgtttgtcaatgggaagacctggaacacctcttggataatgaactctggcgccatagtaaccacctgtaaaagcaacttgtatatgttagtaacattttaaatagaatatcaaagttttgagttctatttttggactaaccaattttttctttcccttcaagagagaccatgcaagtgggtatatatccattgttttcccagcgtacttccgcgaaaaataactcctccgagttcttgcaatcgccctttgcaataaaatttacatgaccatgaaaaccttcgtccagatttccacagctagtgatcgtcctgactaactcatatttgatctatgtttcaacaaaaaaaaacagataccagtaattaggccacaaagatatagtgtgcataatattgcattaagaaaatgaaaatataccaagggccaatttcaaacaaattattcaccagactattgccacgaattatctacttgattataaggataaaatcaaatattttaagaaataaacttaacaaacgcacacaagcttccggtgtacacacaccaactaataaatgttataaaaaattccagaaaaaaatgtatacaagtacttccaatagtagtacacatgtatgaagtctaagcatcaaattatttttagccgtaacaaaaaaaaaagaacatatgacagcttgtaagagtataaatctgccagatttttttcttcttttctctctccatatgatgaatttaaagatgagactttacgcataggtgtaatactattaaataaatgtacatgtacaaaatttgctagaattttttgtggaattttttagttggtgtacacgatccatgcagacaaagttgttttctcaccggcggtacaaggaaaaggactgcgagcgcgaaaagacggaaaaataaaaaactgaaacttgttgctcctatagaggagagaggtggtggaggaacctcccaatctcccaacaggtcctcaaatatgctaagctattctcgataggggggctagctaatttgaggatatgataagtacctcgagctcggacttgaagatagatttacagaatgagctgttggcaactccacctcgacctccataagctgtggtttgtcatcatcaggaagtggaggacttttaacgaataaaagaagagaaaatcaatatatatataatataaaagggaaaaaaaaggaatcagcatcacttttaatgaacgaacaaaaggagaataataagatcaaaatcaatgaatagagcaaagggtaaagaggcacaacttgagatccaatccgtgttgggtctccgaggggatcagcatgttgatgtgagcggaggagggaagtagaggcggtggtacggacgcgctgcggcagatttgattgattataagaccaaatccctccaaattaacaacgaacttgtggtgcttataagggtggagagggatggatgagctagtacaacttacgcaagaggttcgtatccacctcttctgaaaaaaaaaaaaacaagaaggccttctttggttatttttcttcggagtaagttcactttttgactctgaatcggattcgtataatttgacttgttttggagagcggtttggccttcccgacctggggacttggggagagtgcttcctcgatgccttccggacctcagcgaggagggctgcggtggcggaggcggatctcggggcagtggaaaaggggggagctcagcggcgacgtgcgacgggcggccggtggcttgggcggcgtcccctccatcgccggcggcggacgacctcctcggcccgccaccgccgccgctccgtccctcgctcgccgcccaacgccgccgccgctccagccctcttcagcccgccgccgccgatggccgattggctgaagaagaacagaaaggagagacagagggaggaagaaggaaagaaagagggtgatatgtcagtgggtcccacattttggtgtgaatgacagtgtgtcccacacgtatttttttaattttaatacactacgttaacttcacgttaaacaaatcaacacgtcacatagacatcacgttagcgaaactatccttttaaatcaccgaaagaatcaaattacaccggctttaatagttgtggttctaataaattcggtactagtgtttagggacacgaatcagatcggtcaataatttagggagtcagagtggacttattcctttttcttctaacaattccattccaaaaaaagcagtacgtacacaattgggcttctttcttgggcctccaggcgcttccgcagccccagcctatagcacttggatttgtggattcatagtttcgggagtggaaataagtctattttgcttccatcgaccgtaaaaccggatataacccgtctcttttaactcccaaaaccgtctcttcttggcttcccaagaagagctttagatggttctgttagtgtagcttccaagagataaaattaagggataaagtaacagtaggtagagtacagtaggtagagtgattttgctgacctagagagggaactaagctttagcttgcaacaattatgtcttgtatgaccagcagtgcttgtatatggagtactccctccgtttcaaaatgtttgacaccgttgactttttagcacatatttgactgttcgtcttattaaaaaaaatttgtgaaatatgtaaaactatatgtgtacatggaagtatatttaacgatgaatcaaatgatataaaaataataaataattacttcaattttttgaataagacaaatggtcaaacacgtattaaaaagtcaacggcgtcaaacattttaaaacggagggagtatgaagtaatctgctctgtatcaaagcatggtagtactacccaggtttaagagagtgaattctgtggttgctaagaacctaggactgactgactgaacatgaatgaaaatacctggatacataaaaaaaagtttcagtttaaatatagagagcatccaatttaactgaatatgggcgaaactaaaaattaatcaccagtcgtggggataacaacgcaaaagttgatggatcaaatgccttctgcatacaaatttagttgaccacaatgtaaataatgctactagttgattagctacaatgtaacagatacctgatttctagcactttttatgctctttaatctttagtaagccatcagccatccctgcacaagccaaaaacaaaaggaaacaaaaatcttcagtgatagcagttacaataaacatggtaactcacatacatcacaagcgtggatttaaataaaacgctagaaatatcttctcatcactgacataacatgacttgcaatatacacacataacaaaatatctgaaaaacttaaaaaagtagtcatcgatagaaaattgcagataaatttattgatcagagcagccgaaggggcacttttacccaagttctcccggttttgtcctaaacatataatagcaaaaatgtactccttgttgtacttcaaccaacaattaaaaagagtaagatccatgaatacatggcaaaaggaggccaccctgattcatattaccaatggattatgggagacccaaatcttactagtatacaaacacccccaaggagaactccgactaactatataattatctatgtcataaagctaaatttgagctaccttgcaatgcagcctactaagcgcaacccttaagaacaaaggagatagtttcaataaattacatctaggaactatccactccagggttaaactgagtccatcttgattggaaaatgctatagcactcttccacaccatgtttttaaagtacagaagaatgctcgatgcattgcacatatgtatttacaacctacgggtttgcaacaaaattatgagggggaggtgataattgcgccggttagctgtcttcatccagagagccaatgtaagtcaggtcagtcctcctcacccttacagaatccttgagaaagctgcaagctttcagattggcatggtcaccggtaacaccatttgcagaattgctgccactgttggtatttggacagcttgtaccgtcttccagcaaagtccaaggatctatttccatgttaggatcctgtgaaggcaacgctgccttgcatcttcttgagagattggtaggaatccaattgaggggaaattgttggtgaggccctgcagcagatgtactgcactggaatggtgatagtgcagcagaggacagtagaggaggaccacatgttatggaggagaggcgggaagtaggtagaatcggcatagccacttgaatccgccgcctgattgttgctggcaactccatgcgatctaatgcacactgcaatagagcagataatgcaaagaagccatcagaccaagtaaagagaagtcacaggcttgaataattgcagaaagcaaaagagagcaataatatgcaaaaactaaacagacctgcaagctcttagtgacctctttatcaattgcagaaagatcacgcaaaaatttaacagctggcttggagcttggcttagtcttcagccaacttggttggctattgccaagcaaagcttgcaggacacataaaagcctatcgaataggctttcacttggacaatcaagcaggacatcatccatgtaaggttcaagtgaatctgcatcttcatagaccacacgtgttccaaccaagcttaataaggaggaagctagcgtttgcctcatgttactacaaaatatccaaagccaaaaagttagaatatagcataaatatttcaaggacgtaaagtgcaactctgtgaacttaagatgtcacacaactaacaattaaagcaaaagtatcgcaaggaaagattaagataacttatttaagcatgcttaaactcatatttatcacatttctccagctattcatggcaatctagaggagccagaacccactcagctaactaatccagtcaagctcgtaatgcaagtgattcaattctctatctaaagtcgatgacatgattgtcataaccactgaaggcttgatttgcaacaacccactacccaagtactaaccatcctgcttaaatatttattaagttctgttagttgaattccagatgccactcgctgatatctactgataattgaaaagtagccctctattttcataaaggtgttcagattgaagtcccagcaaacagaaaaaaaaaaaactaaatcgctgactgttcgtcccagaccggttttctaatttttaggacaaatcatgtaatgctagaatgtgccacaaaatcattaaatattacctgtctgcaataattactggaagtagcctaatgatgaattgcaggcgcaaccatattgatgatcgtaaagctgatgcggaaggagtagttgaatcattaggtacagggctatgcttcctgatattcggactaccactgaagattcctttgcggccattgggtttactcaaaccttcatttcctgaaggatttgaactattcagtttattaataccgttccacactgctgctttaatatgctcactgatcacacccatatgtttgatcaaatcaccagcaaatacaaagcgaaactcgctagaacttctgtctatgcatggcaaaactaactcagcaagggcttcctgagtaaatatttttgggtagatccatgcccttctgggcttgtacccacatttagcgacttcctattactggattttctagaatcaatcaagccatcaacttctctttcctcaattgaagtaacttctaacttccttttggagcttttattagcattagcatatccgactaattttgaccatcccccatggcttccaaaactgggtcttcattggaaatcctttgcgctgagtcaagtaacaagctgttgtcttacagagttgtttcccaaaagaacatcttgcccttgtaagaaccatttgatacccatcacgaatgactcttgtagctttccaagaaggtgaataagttctgagtatagaggagcagcatcaggtctgacaagtagcctagacaaaataacttcagtaagccccttttccctttcagagagggtaaaattctcagcattaggggatagggatcgaagtgcttttacatatggcacattctttggtttctcaataagagattgctcatccaaaagcagcctcaactcaacccattgccaatggaactttgcaggctgtaggacattcagaatttctataagcctctctggaaactttacatcattcttggtactagcttctgcacaaccaggctctaaagcatatgtaccatcgtctctcattgttactggtatttcacaatcaagaagagcattcaggaaaacccgggcacgaagaggtgaaagagctttcaaacattcatcagggcttcgaagttcaacgattgcagcaaactctgaatcaccaacatccgcagccagaagatcatagaaaagatgcatgttacggaagcagacatctcgaaaaggctgatgtcttgtgatatcactaattgcacccagtagagactgataaagctgaatgtcttcatgattcgatgtactggtgtcatataaatatggtcgccaaaggaccatagcaaatattgaataagctggaggaagaactatacccaatggaagcgtccgttgcaaccttgaaaaggcaaggacataagaatcacctagaatctctgcgatcactccattataaactgtcttacagttccctattagaatcttaaaccaatgtaccaaaacttcagtggaactgtcaattttgaaatttccaatggagtgggtcacaccatttgtgctagctttggaaattcttaagaactgcagaatgtccaaaccttcttttaatcttaggaccaccatcatccgctctagactgacaaccccataaataatagctccaacaactagtgcagaaacagcagcagaaacttttacagccttaacattaaaacattttgacggattacttggaacttcatttgcatgatttccactttcatcatgggtctcagaagactgttgactgcggtgagccttaggaggagcaaaagatgctgcaacagctgaagaagcttcaacagcaagagatatttcaaatattctactaaatcgatcacctaaagtttctcttagcaaggccagagagtttatgtggatatccaaaatgtgttgaatcaagtttaatgaattaattgaggtaacacctggattgttaccacctgaaatatccaagtgtttagctattgcatgcccagcattgtcaacaattgcagaaacagcagaagcaactaaagaatgatctccatctggatttgctcctccattttgtctgatacagtctgccaatcccaaaacaatgtcatgagcagtttgatagctatcttccgtttcagaaaaagatgggttctttggtgctgtagcattattttcccttaggttgcgtaaaaactcgtcagtttgccgttgcactatctccttcatacttggaagtactcctgctttcccattcaattttttatggacatgcccatcaagttcttcacctgatgaaattccagaaataattgaatcaccagtgattgactttccactatccagttcagcaagcagccttttatcagatgtggacctaaaatttctttcccacctagcaacactagtcacatctctgtatttccttaagaaatatcgagcataagcaaaagctactgaagtagactgcctttcacctgacttatgaacagttctattcattgaaacactcaaaacctcgggcaaaagatccattgcaataaggatgttctcatacctgcaatatccaaaagacaaagaaaacaataatgtgaacagcaagattgattttttagaaacaataaaatcattagtacagttataacaaaatttgaacatgcatgtctggttccaactacagttgatccattggatactttgtactacaagatctcacatactcttcagcaaacactaagtttacatctgcagctgttgccactgcagtgtatttgcccatttttcacttcacacaaagaaaaatatgcatggcattgtagtttacacaggtcattgataggactcactaggtcatgatgaagtgatgaactacaagtagatgcaccaagagtgttttccaacaaagcattcaatgacgcaaaacagtccaaacatgattgcttgaaaatcagatgcattgccctcttcaaacaatcaccattaaaccatataaatgctacgtgtatataatgaaaaagaaacgccttaaaatattgcacaacacaaatacagatgtattatagtgtgtttctgtacagccaatgacatacgatgacttgagacacaacttgaaagcaccacaaagtatattggtgaatctgccatcccctcgagttgatgggatcttctaagggtgtgttctatactacatgttcccaacttctactccctcgttttccacgtgcacgctttccaaactactaaataggaaagttgctttaaaaatcatattaatccattgttaaaaaattttatagctaatacttaattaattatgtgctaatgagccgccccattttgcgtgcgcgggggagaagttcccaaccttctctcccttctcttccagacacaccctaaggatgaataaatatttcttttgtgcatgtggcttgccttttttggttggatgttcgcttgctaattctatatattttttccgagaaagatacaatttccaagttaaaaaatttgatatattatttgaaattcattgcagtgcatgggtattttgctagtttggaaagcgtgcacgtggcatttcagtgtctaagaagggccaaacagagaacacaaccgaactatattagtcataaatagtagtggcagaacagagaaaccaatagaaccatagaagccataaaaaaatagaatctgcccagaatattttgtgcaaagatggatgcaaaagtacaaaaccaacaaacagacagagacaacacaagtaacagtttaattggtgttttcacgcgtttcttttttttttttgcactcttttaccatttgcaaattcatgcaaagacaaatttggaaagaaatttcttagttacattataagtgaatttaaaggacgaaagtcaacagtacttcagaagaaaacaatagagaaaaaaaaagcagcttacctgagcaaggatgagaacagaaaagcttcggctacttggaaaacttggttttctttatgttttgggtgcataacacctcttccaacttgaccagatgtggtccttccaatataaatctttgatagaagccatataagcaaccttacagaggagagtaaatcacaacatgtatccattatgtacagcactgacagaagttcatcttctccaaacctccatccagatgcaattttaccactatgctgcacagtggaggcacttatggagttattagccttagaatgtttcacttcatctccttcaattagttgttttatggacttcagcagccagattgaaatggatcttctttcaagcaatctaagtctcttaagtgatttgccaacttcagccagagtcaacatactcatatgatcagcgtctttaagaatgtcagagttagtgccaggtttatggtggggacacctcagattggttatcacacacgtgactagtagatgccccctggctaccatcgattctaccagctgcaaagtgtgctatattttgtgtctttgcactactgttgccttacctccacttgtttgttcaattgactgatgtattgtttcaacagtaaacaattcctgcttctgctctttccttacccaccaaaaatcttcctcatctgattgaaccaatggggacccttggaaaggaaacacgttcttatccaacttctgtctcttggtcctactactatccttacagccagtttttgcatgcccaacatcttcttctgagtctaccaaatctgtttgtcctttcttggttttttttgtttcttctcttcctgattcagccaagagtgtagagtatcccaaattcaacagacctgatatcataagttttacctcttctacttgaactgccactctgccatgattatcatctgttgaatccattagaagatcaggctgtttctgaaggcaggaactcaaagggaccctgccttcaacatttgcatcagtagccagaccacttgaaagctcagaaagcacaagtcgacgctcactagaatatgttgacacaatttcataaaggacttgatcttcagcaatcttagcttcctcaaggatattaaataagcaaaaccctggcaggtgcttcagaattttgtaatgcctcgttttcttttccagatcaaacaagctatcattccaaatggtgattccactaacaattagttgtctcacatatgtctgaggataaaatataccactgcgaataagttcagtcatgaaaacatccacacttttaaatcccgaagcatcactaatctcatgttgatccaaccagcatacaataatgtcatgcagtggacctgggctgctgaagatatcctttttgttattctcatcaatgctacctgtactgtctctaaatccagaagcagtctccattgctgtcaccttgatagaagaatgattcagagtagcacttttaaggtgatccttcattgcaagctgactgctgctcttggaagaagataaattatttatctcattcattttatccttcaacagggaaactgccatatagacctgagagaaatctttgcttcctgaaaattttacattttggcattgtgatgtacggcaatcacggaaagtacatgttgcccactcacaaatgaaaaacacagagcagacaagggataactcaacagctcccatccacatcagagaagatcgcaagcaagggctgacttctttaatccatgtttcttccatcagggtatctgatagataattgaatactgatgtatatgctgctgtcaagtttccagttacaagtgctttgtccaaagcttgcactacgttggctgccccacgaacttgaagattaggattagcaactaaagaaagatcagatgcacgtctttgaactgaacaaatggcataaccacaagagaggtgtcgagatgcattctgtctcctagagctagcaattttaccaccacctgctattttcagaagagcacctttaccgtatacatcaggagccacaactgatggaagtggaaagcaatccaaagaaacaaatgtatcgggaacagcaagtatcaagtactgcagtaactcaactaaagcagaggtaatggatgacctttttgggttattcttaacacttaagctgccaggagaagcatcactgagacgttgaatcagtatttccaccagcatgtggatatatgtctgtgagagggttatggtatcaaccaaagaaagtacaataggcaagagtaattctaaaacctcagttgagtctctctcctgaaaggaagtgggttagaaaaaaaattggtattagaagatcaacatagcacttgagaaacatcactaagcatgaacctactttatcaatgcactctgtacctggagctgattaaatacccattcgataagtaacgacggaacaagtaattgttccatgagatgacattgaacaatacgaatcatatacgaccatttaaagtgtagcgaaggctcctcaacatctgcactagcaggtgatgccccggtttttaacttaattgggctgtctccagcaacaaggcatggcaatgactgttcttgagaagatggaagtccaaaaaagccatttttagaacacaattcgtccaaaagcagctgcaagtattcaataacatcctttgtccagtgctgagatcgcaaactatcaggagcagcagatgaaacattattggatgatgtttgaacctgcaattaaagaggcatcatcaagcgaacatcatataattttctaataagcatgaaataacagaactaaattctagtgagcagtggcagtttggcacagaaataacggacctgattaaggtaagtaaccttcacaagccatgatgctcttaacagtgggacattatatcggataagataattaaagagtaacttcctccgaaaaccacgaggaacttgctctgctaatgaccatagacgcctgtttggttgcacaagggcctgcaaaggaatgaattacacagccatttcaagtcaggtggaagattaaggttgcaatgagatccctcgcagatcggcaagacaaaaaaagaaaagactttagagaaaatcgttttctaattatattgcagttagtcttcaattctaccaaaaaaaaagttggtaccaatgtcgccctaaatctgtagtttcttaaatgaaacattaggtgagatggacggcacagtgctcccgtttatacatagtgagtccagtttgaaatgcatcagtttgatacagtatgaaatgtttcaagaactcataatatacagaaagatagctacttaagatgaagggttatttggatggcacactcgccgcacttaattgtagcaaacttgcctcactttattcaataaagtgcataaatgaaatgaaatattacattacaggaaaagaagatgaaaatgacaggctaatttgattgacctcgatccattttctgcgtgtgtcttcattgctatgcatttgctctggatacatcccaggttttgtcagcaacgagccagaaagagggaccccataaacttggccagcctgttaggaaagagtatttggaatattttagaccaatattaactttaaaaagatcaaagttttgcaggaaaaatgtaaatagatgctagctatctagaattaggtggtaaaaatctaattaatgcagttaagtccccatttgtcaaattttcaatacaaacattttgaagttgtgaaatggtttaacaaaaaatatccttatttacagcagagatcctaatcatagtaactacaacaaatcaaaataccttcctcttctgagcacgagattcattgatcgctctgaaccgcttctttagtgccttgataaataaaaaataaaattgttagtcaaagtataagttttttcacaagacatatcagttagagaaggaaaacacaataatcgggtaggtcaaagggggaagaaaaatattagattcaatccattcaaccattcagttcaatccatcaaccttagggaaaagaagcaattcttcagcatcttccatatggatctacgtattcacataatattaatcctaagtttctgacagactatgcagccagtaacaatccaaaggtggcaattatccaaaattagcaccaagtaggctgtagagttttggctgttaaccccctgtgatgcatatctcagcttatatataaaagatgtgattcccataattctacccatcttagttcctgatctccagcagcattcaatcatgccgcataccaacctacttctcacttcactctgacaggaagaaatgttctaacaacataagattgcatgaaaaataaagctagttaggttgatgttggttgcctttttacctccttgcattttgtagcaatatctggtttgctcaagtatggaatctgactgagtacaatctctctggcttcctgtaaaaacaccaccaggaacaaatttcagtcaaaacaaaacaaagaaattgcggtcctaatgtacacaaaattatggactcaagattttaatggcatgagactcgtgaaaatgagacaaacaatatatgaaacaagattaaccctagataagcagtgtcacaaaaaagggataggatttgaaacttttggtttctggagcacacctcaattccttcaacggtatccttgtacccagattgcacatattctttggttaaggtctcttctgcacaactcaatgtctggggatagaagtcaggtgcaccaagcctacaaaatccatagtacaaaggaaacactaacttttagttgttttcgaatacaaatatgcaacttctccatgcaaatgaaaaaaaagtaagaatattgaagaatagaaaagctagatatgagaaaatggaaaacatttatgtacatagtcaataagacaataggaacaaatcagttgttgagtaaaacatgcctggcattgagtgattccttgtcacacttcagcttgtaaggagctaccagtggttgccgcctgaaaaatagaatcataagcatattaggaggttcatatgctcatcagtcagcactaagttaatgtcttaacaaacataggtagaaccttagtctgaacaaaatgtagaaaagtcctttgaaaaaaattaaatgtggaagatcatacatttgaaagtgctactcctacaactaatacccccattcttcctgaaagagagaaaataaaaaaggaaagagctaatgttctcctataatttcttgctgagattttaaagcaaaattgatgcaaacagaactattcgacggtgttggcgatagctgtttcctagaatcaatattctagcaattttctcaaaaaaaatattccagcaataaaatattatccatgtgagatgtcacagtacagcattggccatggttacattctcagctggtgcaattgtagtttacccgccactaacaaataatcttcccatcttcagctggaaaataagaagaatacaatcttgtcatccatgccaatctaaatgcatttgaagtccccataagaacaaccatcctataaactacccgtcagttacttggttcaaccatattgcttagcaaggtgcaggagagatgtgccagagtgatgtaacaggatcttgtgtttgttatctttgataatggaacgtggggagttaccctcatggaaaaagcattatctattgatcaataggtataagctgatagttacattatgcaaacaggttttttgtctgttccgtttgccgacctctcaaactgctagtaagaagcctccatcagccagaataaggtaaaaagtactccctccatcccattttgatcatttcctaaagtttttgaagtcttcctaaaatgatcatcatctaacaagtgtctttttgtttatttgtgcaaagagtacatgtgcatcgttgaatgtgttacatgcaaccaaccaagattaatttctattggtgcaatggcatgcaatatttaaaacatgagcaatccacgggacacgaagcgatgaaacactttaatcgatgaggattaatttgagaatgatgaatattttggtgtctttggtcttggtgtcatttacttagaggatgatcaaaatgtgatggagggagtaacaaccataaaaaagagcactgtacagtgaagattgtttgacctactaaagaacaaaatgttttctctttcatttaccataactaacagtgatacgttttcaaatgatatcacaccataaaaattaaaaaggcaatttttatgatattcatctagtttttgaattaaaaaaatgtccatctgattcaaaggacaaatcccactagagtagactgcgactgattttgattgaatttttgttcagaacacaaccatctctagtgccataattttaaaaatggacctgatcagcagacagtgactcatccaagttggacacaagataatcgaagcaagtaagcaactctgaactggtgaaaatacaattcgatgagctagtttcatgatatattgaagcagcggcggattcagggcccagccagcatgggcagctgcccgggctcccagtctttgccgcaatggacttcggtgctgttcctctgctagccaatggcatttgctcccgggcaacaaacggcaccaggcgtcatgcttctatacggtgcagtttgtagttagtatggtgtcctgcacgactatttgagcaccaaagcaggcttttaattgtgcactagtttaagacaggtagaaaaaaatggcaaacaagcagaacatgttattggactcctgatgctgatagattattgtcagaggtcactatctctcttctgctttgttatatttttttaaaactatggataattaatacctaattaaccataccctaatcactcgtctcgttttgcatgtggaccataatctcatcatagatgtcatctcaaacacagcctaagcatgctcaggctcaagaaaatttctggatccaccactgtattgaaggaatcaattggaccgactacttcacaaatcacatcaaagggtttacatgcaacatgggtttcgaaactgggacaatgagcttgaattaactacttattcataccaggaaaattgtgactgtttctaccaaataacaatcaagtatcatttttccatcttttcattaaaccaacagttgagctgttaaactgaccaaacactgaacagtcaataaattcaccaggatgaacactggcaagacttttgaagcaacaacaatggtccaaaagtttgctattgtttttctgaattcctttttatattttgagatgttccttttaacttctgtaagaacaaggttttgtaacagactacatggcagtggccaaagtattactgaataatatacttaaaaaaatatcagtatgaagttcttgtcttcttgatatgagatggctttcttcaggttaggtcatcacgagtaacgacaaatcacagtaaccattgccgtggtcacctactggttgctaacgttgccacattatcgtcacatcatcgtttcttctaccgtaacgagttaataacttcacagcaatcactatcagcaaatatcacagtctacaaagccgaatgcattggaaacaagacaacttgagaggggaagaaaaacagcaaccacctcaagttcgcggggtaattggcaccatggaacgaagaaggctccagcctgcccttctccctccctcctgccaccacccccctgcctggcacgccgccgccaaacccagcattgtgcccagcgcccgtgtacctttgcatcttccctcgcaatcaccacaacactggcccagccatggcgacagagctaacgcaggccatgcctgtcccaactgaactcccatttttattaaaagaaaataaaaacaaattggtattagtaactccaagcatcgaagcaatccgggggaagagaactgcatgtgctgtgtttggaatggagggcgaagaaatcaatccatgtcggattgatctccattccatccacgcccgcctcatggaagcgttgcgggcgaagaggaaggaaggaggaggaggaggaggagaatgaccttgaatccgattcgagccgaggcccgcgccgcgccgcgccgccccctccgaacctgttcgccggcggcgcgcgcgacgaggccgcacagggtggggaggaggcggctagggcgggcgggcgggcggcgcgggcgggaaggagagggcgagccggttttctcgccgtgactccgggcctactcgccggcggcgaaggcggcggcggcggcggagacagagaagggcgggggcgtgtgcctccggcactgccgatcggaaaacgcacaagggagatggagagaggtattggagtggagagaaacaaaaatccaatctctttgaaattgtgataattgattttaaattggtttctttttgggttatttatttgacaaaaaatggcccctttacacgtcttggttttgttttcttgttttctttatttgtttgtattaggtgctttgggctaaaaacaaattagtaaagtataatagttggcgtagagatattgagaaaaatgaagagtctatcacgcaacgagagagaggcccgtttgaattcacatggatctccgtagcacgcacaacaaactagtttcaattcatgtgggtctctatagcacacacaacaatctagatagattggagcaaccgtgttgtaaatagatgtgagaaagtgaaatgcttgttatcaatagataaactaatccaagtttgtggggatctttatagcgtacacaccaaaccaagattatagatctataggaaccaactcaataagaaagtagtaggaagtaagcgaaaagtcaaccgtcaaaacaagaaatcaatactattttggatagatctcaacaccattggaaacaagcttaaagattagcgattgccagggtaaaaataacatggagaaaaggaaaaatccataaaaaaagataaaccaatccaagttcatatgaatcttaacagcatcaataacaaactagatggatcaatgcaacaaacttgagaaattagattaaaagcaaaagcctgtctcctctaagagaaaccaatatgagttcggatagatctccaatctatttcggttcaattacggagtagagggcttgaaaaactataccttttagtcagacatcttggtggaagaggctttgacgatgtaccagaggagagaaagaggaactgatgcgagaaatttgagatgaatagcgaatagaagatggagtgacagtgagagagagagagaggaagatagatacctcaagggaccaaggaggggtgtatttattgttgttgctagtgctaagcatgtattgtcgcctgctatcatatatgttgctctgacgtcatatgcatcgttcacgtttgccatatcctctaccggtgactcatattgacaccctctcatcatgctaagccaagcttctccgtcatcaagcgcaccgttcatgttaaaacatttctaaggttgatgactcaccttgacaatcgtcccattagatatgataagtatgtcatgatggcaactttcacgtggcgcatatgagagtggaattgcatccctcattacacatttgtaatgtgctctctctatatataaaaagagctcaacatcgtcaatttttttatttaaagtgcaacatgctaactcccttttctttcgactttggtaatctaatatatccttatatctttcatctttgctaactccttgtgaatttgttgaatagattacataatgatcaaaataatttgaagtgcccatacttttaatctcttaggacatttttttttgctagggacatttcaaatctctcagactcttactccatccttcctaaaatataacaacttttagccctctgggtttgtcccaaaatataacaacttatccaccaacattctattcccaaccaatcacaaccttccaccattcacttttcccacatacctccattactcattcaatcacaaccctccaccatttaattctacctaatttcttaataaccgtgtctaactataaaacttcatatattctggaatggagggagtaccttgttaactgcagttttttttttaagaaaagaagaagaagaagaaaagcctgttgctgttttgcacaagcacaactgcgaacgcgagaggtccagtgactagtggtttaggcccatcttgcagcagactgaaaataaaataggcccagtagcccatcctcacaagcccataaatatccggcagggctagtggtttaggcccatcttgccgcagaatccgccagctttattaattattaacctcttctccgccattttttcgctccaccattttcgttctcgcgctctcgacgaaccaaccatggcggacaaagtgagaggatcgtgttcgtctcgtcgcccaccgaggagaggagtccgctccagcctccagctgcagaccagccgactaggtgagtggatcgatccccaaaatcccaatgaatccgcgttctcttttcggggtttattcggttggggatgtcgaaaatcggcagcggcatttgggagtagtagctgcggctgccctcgtacgtgccgattggagggagggattggtgtttggagtgaccgatttgccgttcgaatgcgtaaaatttgggtgaattacgcgagagatttgataatttaacactcttttcaatgggtttctattatttgacatcctagcccactttcattcactcagatggtcccatatattatcctcacaaatgtcaattaaagtaattggacaacgaagaaagtgtcaaattatcaattttttcgaattaagcaccgattggtccattttgtaggaataatttgaatcgcttcattttattttattttattttttgctgggttgttgggtttgggggcagtttaaacccaatgcggcatacatggggatctcacggtgtctggaattttgaacaacggatgaactgcgtcctgtgccgactgccgagtgcttgggtggtgtgtagtgaactggttaatcccaagctcccgcctcccggaacttctggattgggtggttttgacagctgagccgcgttgcaactaatgtagtttgcactttcactcacattaggagttggattttggatctacttgttttaccggttggtgtgcatgttggcaattgatttagtagggatgcttatttctcatcctttcagttgcacaaatttagcgcgcaagtgattctgttatttgtgctgtttggatttggcatgctcatgcttcttggaggtttacatgtattttgaagcataattcaaataactgaatgcatgaaaactgtaagcttactgagtgttgttcaggaaaagaaaaaacctcagtggaaatgtatattgtgtgatttgtttagaaagccttttacacatgtacttacaaatacaaacatgtacattgaagtgatctagccctctttgttgacaagcgtatcggggtaaggttcacaaacatgcacacaatggacaagagaaaaattcggactgctgtatgcctgggtgcctagaggcatggctgttacagactggccaatttcatccaaacaaactgaacaagtcagatattcacagcattgtaacttcagctgtcattcacaagaaactgtccactccagtcagacatttggaccagtaaatgtctccccaatcacatgatactttccttgggccgccagaacatagtgcccttgttattcttccgcataaaatgggttattgtcagcatcaaaatcaaaacctctacagttcatctacatactgcctatactcgtcacaaagcaacactgataagggatctgatcagaacttcaaatccacaaatcaaaaaccgcctcatctatcaattcatctaacacaaactcccatatctccacgacaattccttctgtctttgatctaatgtccatccatgcctgaacctccaaatcccttttaattatctgttccaatgtacttgggaaactacacttgagataaccatcaacatatttgtcaacttctgagatgagtttttctcctaccggaggtgtccgtatgtcatgtttgacaaaagataaccaagaagagagtctaaaatatctctcttggatctctgttagtgcttcacagatgcaatcaaacaaaatcttcatatcatctattcggtccccttgattctgtagttcttcgaacatgcaagggctgattaattcatcctctagataccacacctctaaattttgctctgcacataattctgagagctctagcaccagcattatataatctaacctggcattcttatcctcccaaaagacctttacacctgattcattatctgggaagtacagggtcccacaggaaacttcgtgcagctcatctgtatgtcataaaatggtgagtaatacagatactagagtacataatattttttatctgtgcagggaaagaagataaactaatttaaaccattgttcttgcaaacaattgtattaattggacttacattttttcattgttttgcattcaggagagctgtcatcttcatcgaatgaatcaagaaccgatacaggacttggctgttctttcttctcattgctttgctcaggacaaccatctggtaattttggtgatgattttggttcaggtgtttttggatcttgttgctccaaattttcaaccatgctctcaggagagctcatgaacatttgaacaggttcttttccttcagttccttctaatatttcctataaatagaagtatgaacatgtacatcttaaaatacactaacaaaagatggaataaggctaggcattcatttgagcttactggcaaggggctgtctgtgtattgttctgctgggatgcactgtatgttgcaaattgttttggaacaatccaatttgccaactccttcaacaggcacggtgtctacctcatcagtagcatatatgatacctgctcaatattcagagttatttctatttaaagaacaaaagagcactacgcagaccactctgatgataattgtgaatactaaagttaccttcttgggtgtcttctttgatgccacattcttctagaaccgccacctgatcatcaactgctacactagtactatatgcattgctctctgagttatcatgcagttggcttctctcttgggctggttcttctacatcaacagcttttacaagacaaacttctggctcttcaggtgagaaggcattgtggcattttcccctatggtcactcctaggaggtgacacgttgtaatgaggttgagaaagcattccttccaaagattttgatacttgggctgtcggatagctggcagattgactagtgttctttagcatatctgctaaatgcttcttggctttctcatagaagatagatgctcctgttgtatgatcactgatttcactctggctgtcattttgttgcttttgcttactgctggctgaaggtttgattccattcttaaaatttgatgcagctttgtctggcaagctcccttcagtgagatgtctaggatccttatcttcaacgacagaatctttgagctgatgtgaatctcctggaaggttctctgcaggtattgcatttttctctcttttgctgtcaccagtcacaattttgaatctcctcctgacttccttgattgaaaattttgagctttcccttccactgaattctggagcttgcgatgtacatggttgctgatgtaaatatcttgaacttgtagtctctgtctcatcaatccgtcttccttgatttggctttagtataactattttgctaacaggctggggtctattggctctttctggcttttgctttctatctgacctatcctttctccagaagaacacatgcttggtctctttaccctgtgcttttgtagccaactcatgatttgagccccttttctcttcaagaatactagaccgtccaagacttttgtcaggttctaacttggttgttaacctgctattttggtattttcggatattgtctaatatatgtgaatttggcttctgaagcagcttcaggaaaagttcattgtttgaactcagtatttctaccgcatccttgaattctttgaattgagctgccctgctgttagaacgactattctcacccagtagcccttctcccttgctctctggagattgctcattaccatgagtggcatggggattatttaaatcattgagcttgttatggattaaggacttcagtgaaggacacaattcacccttattcttgcaatcaccatgcgggcattcaccatggcacctataaatttcacctaaaaaatttgccaagacagattcaagatcatattcttcagaatgattcaagctcttggaaccctgagaatacactgatcccgataaataagacgcgaagatgtccgtgtgctgatttaaggctgccactggtttatttgtatgctctgagcctccatctagggagacatcatatcccaagtcaggtaatcctctttgaatctcattgcttggaatttttttcaaaagatttactttccccaattcgtcctccataagttttttgactgttcgtttctgtgaagcgcattcttctttgttctgaaaagaagaaaagtaaaatgatgtttaggaaagttgcgactttcagatgcacgcataatccagtatactgaaaacaatgatttggttgtaatacaaactagccattgagttgctttgtaacaagatgctgtccaataccaaattgtgtcagtgttgctattgataacaaagatgattttggtgtttatggttaaaacaacaacagatcatgagacagttacttgcttagttcttgtaacttacatcatcatcatcatctgtttccacaaaatcactggaattcttaactgaatgccttccgtctgaaaaatacagcgtacatcatcagaataatcatccaacagcataaaaattggatagaaaatttatgcgttactcagttgaactatcgtagcaatcaccattgactaattctcgactgtaaatcagatgcactgataggtcttatatgacttcaacaagtgatgcagagaatgaagaaactacgctgcacaggctcctgaattaagtaatgaagccagcaagaataaccaagtacacgcaaacaaaattttgataacattagcattttttttcttgtttttattgaaaagatagtgagcattgggtcaaatgacagcattttttgaagtaatagaaacttgaagcaaaacacgtagctttttccgtactgctataagaaactacaacttcatagcaactatgattactgaagaaattacctgccagctcccggaacgtatgcctcctgctcacttgctttgtatccaataagaattttgcatcacgccggaaataaagcatgcgcatgaggccccacacgcagcctacattgttttcctcttgttcagtggaccgcttgtggcttcgccttcccatttcagataatcagcgttctttctgtagtggaaataacttttcttgtatcttctattgattgttcagttcatcagggagttcaccgctagccggatttcagaaacactgcatgcagatcaagatcagcaaccggacatatattgatggaaaatggcaaatatctctggagaagccaaaacagaagaactgtgctttgttcagcagcataagggagatggctggccatggaaacctgccatccaaggtatcaatgtactgttcttgtttttcttatattaaaaaagctaatcgtttgtacaagctgttaaaccaatccaattaattaaaagaaaacatggtaaggactagggagaacccctgaatgcttgactgaataatcaatacagaaccatggtaaagagaaacctgatgtcaaaaaagaaaaaagaaaccgaaagtttcagttaaatttctgtacaaccaatccaactaatccaaacaattagttgcataatatttcataagtttcccccctttcgcaagcatgggagctcatcaaactccccacttcatggattaaaacagaactccaaactttcaagggttccaaacaaagcagagacaaaacagcctaacagtacaaaaccaacaagaagcacatccaagagcagggcttcatgcaaaacctacctgggaatgcagagatcatgaagagaagctccagcaaccggccctctctttctcccctcctctcctctctctcactcagcaagtcacatacaagaagagccaacagattactcagaacatgttcttgaccatgtgaacaggcgttgggacctgcaaccttgagctgtccatcctttcggcaatccggcgacgacgaaaggaatcggaggcttttcttgcgctgttagctagcctaatccaattcctggtcagtatcaggctatcagctttactctccctctcttcttcttcagtcttctcttccctttgttttccttcgctttgctttgctttgtggaatgagcgcagcacgctagctacggcaccacagcagcccaccacatgccatttctcaagtagaatggactttcggcaagtgcgccaccgctttccagtgcagaaaaagtggcagtagacaatagctgcaagcaagttacaattgctggacctaactctgattaatggctgtgtggttaatccctgtggtaataataatggactaatggtaagtagtagtacaatgaatcctgtgggggcacaccgatgaaaaagattgacaccactaccatggatggaatcgtgtaatactaggcaatagaaatctttcctttgaaaagaaaaataaataaataaattggtttgagataatatcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccagttcaaatgagtacattacaggttcataggagtacattacatcacaagctaagtggttaacagaatactgaaacatcagtttcacaaaagtacaacattctggaataaagacaacagtacaacacaaaggtcatcaagaattctggatagtggatactaaattactaatatgaggcaatattgcaatcttcatttcttctagtcatcaatcatcggtctcagagacatagggagagggagagggtgacttatcagaatcagaagtctgcattggaataccatcatcacaatcttctgagtcggatgatggagcttcaagatgcactggggcattgcgcatcaaagactgtaggcttctgactttcctcttcttagcgtgcacaggccttttccttttagctggtgctgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaaagctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgttgcataaacattacacaaattacaacaaaaatgatattcagcaataaaattaagttcacatgttgagatctgaacctggattgaaatttttgttctttcgctgccttacggcaatttcgtgtccaaaactcccatgctgatcttgatacaagttgagttcttcaattattttgtcttggatatcttcatcatcaaccaacttatcaatacaggaaatcacacctgctctaaatgatccatcactctcgatctcttgcttatttgggtagtagtagtaggggttcaaatagtacccagccaggtgtagtggagtcttgagcttgttgtcccatcttttatcaatgatatcccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatctgatcactttgctggctttcttccccttggcctgcttcaagtaacccaattgctccatctcatctgatttaaatagtcttactaactctttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttcctttttactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataattcacatatagtaagatctacatcataaggcaagtatctgaaattagaggtaacaaatatggacaacttgttcacatattgtaagatctgcaacatacaagcaaaaaagagaggaggatgtgagaactgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgctcgaagcagcagccggcgccggtcgcctccacgagccacctgcgttggtcgatccgcttgaagccaccgccgccgccggacgcctttgcgccgccgccgccggccacctccacttttcttgcagctggagagtgagcgcttcgaagttggaatggatagtgtgctgctgggagcttacgagctagggtttgcagcactttacccacctctcgactctggtctagttgggccggtttcctcttgggccagaccggccgtgttttacaatttagctacgctaaattacggccagtttagcggctattgccggctaaatggcgctattagcgtcccgctattcttagcgctaaaaactgcatctcttagctccgtccgttcccagcagctatctccggctatagcggcagctatagccagagatttaaaactttggataatattgacatttttgtttctaaggcccttgctgaggaaaagccaaaaagaggagcgcgtgttacatgtcaaatattgagatggcgattgagtgctactttgctagatgcccaatacgacacagactttaattgcccagcgacaatctgcaggggcgattgatagtttgttacctgtccatccgagagagagatgctatacctcacctccgattttcagagagcactagttttaaggaaaaaaagaacttgcaatatctgtttctgcctacacgttctatacacagtgtagtgttgtgtactctgccttgtgcttaacaatattccagataagtctacaagttaaacaatcaggtaggagtaaaaaagtaacagtatgctaagaaaatatgctcttccaagatcagtttgtttgatatacagctaatttttgcaagatgcattacttatttcagctctcagacaggagttagtggtttagatgggatctatctggtgggccaaatcctgcagttttctatcctcgctttacacctggaatccgattcaaaaggcaacctggaccccacctgtcagcgactcccatccactattccaacagggcttaggttagtgtagggacttaaccctaaataatacagtactcctactacccttgcgttccacggaaggctgctgttgtgacatggatcgtgtgtttgtgaggtgtgatgcaggacacggagacagcggtggcctgacggatcaccggagcctttttgtcatcaccttccctccggtttggttggcctcacgtacgccaccaaaccaaatagtagtaaccaaatccgttaattaattaattattaactcctactttggggaccaaatcagccatcagatttctcctactgaatagtagcaataatatgttagctcaatgcgatgcagtattgaggtgtgtgttggtggtgattttttttctttttgaaacctaagccatctaccgctggttttatattaagagagggaaagactgtactgatgttggtggtgatttgattaagatattactttggttggttgggtggcattgtactgtacctgcaaactactcctacagctacatgagatattccctatctttgccaatcaaagttgggtgtacttaggaaatcaagttgtggccgtccactccaatattgttcttgtaagaaggaatttctttagttcttttgtagagatttcagaccctagatttataatgggtacctccaaaatatttttgttagaagaatcacatcatactacatgaaaatctaggccaggcataatctgtgagcatgtagcagatagtagtagacaacatcatagctgtctgcccttcatcaattgataagtctctctaaattatgaccatctcgtccccatgcaccactcgataaattcttgtcccagaagaaaaggggcttctttgtgtatcattggattcgattgtgagcggggcatcatgcctgcctggatcgaggtttcgactttaaagtatgctgtagcttggctgatcatggaaacacactctggatgagacaacacctttgcaaaactgttttcgacaatctctcattgagtcctgtacagtcatctgccaacttttcttggtacagtatttctttcaggaaaagtgagaattatttgtgttgcttacgatacgctactatttgtccttgggaaattttgatacaaccctgtatgggaggacgatcgagcaaaggaaaaatagtgtaatttttttcctacacaggatttctcttctgcttaacgaatgaatggatgaatgcaattacacatgcttcttgagctcctaaactttacaattctgtgaaaactttatatgaatttcttaagaaatggttttaaatccgttttgaactttataattaactcatttatttgtactgttgaataattatcacaagtcaataagctatttaactatttgcccgtacctcttttctcttcctttcagaagtctaagctacatggctccgaatccaattaaatagcaaaaacttgagcaaattagctatatcaaaaccctcctttcttccaacgtttataatacatgatatcttttgcatgcacaatcctataattccttcattttccccatcatgtggttttcaatcatacagaaaacgataataaaaaaaaaaatacatgcactatcctttttcacgaacatgcaaaaagattgcacgtcaatagaaggaaaatagttgttccacaatgtaattagccagacaggcttttgccaggggaagagagaaaaagcaaaacaaaaattgcagctagaaaaagagaaaaactactactgtggctaaacgtaactccgattagcacgaagggagcagagccatactacattcccaagaaacgccaaaaataacaatgctagctaaaaaccatagatgaccctccgagaggatggacaccataacaactgagaccgaagagagcgcagagtcaaaaaccctgaagttatgttccttccacaactgctaagagaccaggaggaccaaggagtcgaagccggcgcgaatatgctcaggtaagcaggccctagaagatgtacaccagacctgaagccagctgtcaggggggagagagggtaagcctaaccaggaggtgacagcacacagtgccagacctgtcgagcgaacacacagccgaggaggatgtggtttgccatctgaagatcctgattacaaaagaggtaggctgagtggctattgatgccacattgccactatctccaggtacaacaaaactttaagatgatggcactctttgtataatgatcacttctttcttgtgatcaatctgcaaagcaaagaatcgtcgtgctggcttacaacaagtgtcgacaggggctcgtgcatggtggtcacattcagggcgaagcctacacactcctgttaaatctgatgaaccccagcctatgaactcctattaattcatctgttcgttgaatccccctggtcctttctcccctgcctttatgtctcatccgtctttgttaaatgggggccgtgaaacgcaatggcttagacgcatagtcatcaggttcggtaagatcctaataaaacgattgttaaagcaaagcgtagtaccgagtaattataatactgacagtgcttttgtgtgcttagcttgcaatatactatgtgttcatgcagtatggtcgatcgctagctgtcagcactatactatactgaagtgatgcgataccgtaatcttggcgttgagtagagctagcgtctctgtctgtccctgtctttttatcataagtttctgaccggctgcatgtacgcattttgccgagcacaggtcacacaatgacaagagcgtagggtcgtcaacaatgcattaaggcataacgaatataaatcggatcagttgtgagctgtgatctggggtgtgggcccgtgggtggtgtgggttggtgagacagtgagtttctttgttaaatgcctgattcgctgtagtagaaggggagagatgggatggaaggaatatattgactatcagcagcatctactgctactatatgtatggccgatttaaaaaagataccagtcactctgattcttgttataagttgttttaattttttaatcaaattaataatacattttcaatataaaacaaatatattatgaaaatatattcaatgctagatttcatgaaattaatttggtgttttagatgttgataaatttttctataaatttggttagattaaaaaattaaccagaaaaaaggtaaagaaaaacttataatagaaccgcagggagtataatccatagattattacaactaatatctatctgataatatagataaattaagtatttaaaaataaactcaataaataggttagaataattggtctaaacaacacatttgaaacaactttttttagagaaaatatattttgaaaaaatgggctaaataatctacggtaataatccaacaaagtagaataggcctagttgtttgctgaccaattaaggcctcctatggcaatggcaagctcgggatgcgatcacgttgcaatttgatcgatctacttcaatttttcggaggggtccaaatccagggccaagaaggcaagaacatcatcgatatcaaaatcttttgaattaatttctttctttcttttcgtgtgaagacaatcaatgtataaatagcatacgggatcaatgtgtacgtgtacgacgaaacacatctaccatcgtcgtgtttataaattttggagagaaaattgttgcaaacaggcacacaaaactagtataaagcgtcatagtaaagcattgtaccgtggacctagctatgacctgatttgataataacagggaatcgtgacagaacaccttcgctagctagcctcagacagttggacccatatctatttctactttgattgcgtcatatttaagcctttttctacgatctacgctatattagtaaggaaactcatctatttttctattttgataccgtaatagctaggaacagcatgttgagatgaaagagtgtaaatggtgtaattaattcattttctagcaaaagaaagaaatgaccgtggccagccacgttgaggcaccgaaattaccgatccacgggaattagaccgtagactctgtaattcattaatttgagaacaaacaatgattgggaaaaaaatccatgaactatataaatactcctattgtttttcaatagatgacgtcgtggaattttgaacatacctttgaccactccatttgtcttattaattttttttgcgcaaatacataaaatataaatcatacttaaagtagtttttagtcataaaataactcataagaaaataaatgataattacataattctttgaataacatgatgattaaacatgtgtcaaaaatcaacgacatcatgtattagaaatgggtatattactacttaacgttcgtatggttagtttcttcattcatcattttgccggattttccttttttgtctgaataagagcacgcgcagaggctcccaaggaaaaagatgcagcagtgtaggtggagggccggtaagggcatactgggcctcggttgtctaggtattgggcctagctctccggacgattggtgaaactccaacaaaaccgacgaacgaatgtccccaatggcctaatcttttcttagtgtccggagaaggattatttcagcctttttaaaatgtactcccatcatcaaacaagtgttaagcatatttttttctaaaaaaaattgatcatatttgtagtttttatgtactaaattaattgttaatctaaaccctagaagccatcataattcattggttgcatgcatacatatagtttattggttttgttaaatggtggatgagttaattcctccttaattttgatgataaaataaaaggttttatactttttagatgtaagagtactccgtaggtacttcggtagagtgtatcctatcatcattcacgttggacgtggtttaggggtgcgttgtcaaaaacaactttttcatttgaaaacagtgtatatccacttattaatgtagaggctggttttttttatctactagaaaataggcgtgtcatgtgtgcatgataacgcggtcgtccgagtccaacttaataaagcatcgtgcgtgcacaagaacgcaactgagtgcgcttaggacacattttttttctcacccgcatcgcttccccacgcaaaaaccaccatattcagtcaatttatactattattatatttgagcttgctatgatctaacaagttaatagtaaaaatcattataatgaaaatagataaattatttttacctgttgcaacgcatgagcatttttgccagtacatcttaaaactgagtcactggatcactgaaccgatatctatactttctataaagttacagcccactaattctaaatctcaacatgcaaccatgccacatcatcatctattagcaatatatatatatatatatatatatatatatatatatatatatatatatatatatatatatatatatatatatatatatataatctcatgtaagcatataacattatctacaatttatttaattccataaatcaatatgcaagcatatccaataaccacactcacatcatttgcacaatattttaacaaatatatctattatttttataatatttaacatatacttcatgataagtactaataaaccctgatgttttactaacaaaatatattgagaattctcgtagcgaagcgtgaggaatcacctagtatcataaaaatgagcgtcaatataaacgtctcgctgtcgaccgtggtccgctctgcagcccttgccaccgccttggtgaggcaggcgccgtcggtcaatgtagcagccagctactcccttcgacctcatagaaaactaagctaatactggatgtgacatatcctaatatttcgaatctgaacataggctgattttttatggaacaaaggcagtacctaatcgatttttgaagttcattcactcatactcctagtggtattaatatctcatatctgtctgttttcaacacatagcacgaccactacgagtagaatcccttaaaaagaaaaacagatggaaaataaaaggcagcgatggtcttgggatgtgaatgtctcatgtgttttttttccctgaaaggctgaaactaccatcaaggaacttgtaataatagatccattacataaaatattcatattcatcatctagacctacgtatggaaagcagacatcactgtggccacccaaatattgagcacaagtgggatgcctaagttccaactcccaaacttggcacccaaaacaatgaactttaaaaaggaaaagaagaagagttattagtacatatttaaaccaacgaaagaaaattatcatgtcatgtgttcacaaaagagagaaacagttgagatccacctcagcaaagaacaatgtaagagtgccatctgaatctttcaccacaaagttgtagtgtgcatatactttcccatgttcatcaaaaagagtatattctttcagttccataatctctaactcggcaggctgaaataaacataatgatattagtccagatatgtaaatcatttccaactcccaacccataaaaaaaattttcaactttgcccaattagcctaggcaaaactaacacttctagaacaagacagatttagaaattttggattgatgatcgaaccaaaatatatcgccattaatttcgtggttccataccggcatatttttttgcttggcatacatgcgtagtggtattttcaacatcttgcattcatcctgtcgtttgcgtttttccaaatcttcaggcaatcgccacttctctgcgaagggcttagcatagcgttcgcaggcagcaataaaagcatcggccagttcctggtcatttttatatggcgatgatcgagtggaatcacgattgtccaggggctgtaatcccacatattctcccccactgcaagtggatataaataaatgtaaacagaagcattcctatagcttgctattctcctacttcaactaaagcatgcagtgaatagattatatttctaatactaggcctgttcatttaactattttgttgttttggtacacaataaaaacttggcttagcttaccaattgaaagatggaattcaagctaaggaggaattggctagttacacatcgagcaaaaaccttaacttttttccttttaggaattcaaggaagcttatggtcctagtttttatcgaggaaatagtagaactactcatatatatcattaaagaagaagcaaacaaaggcagggaaagaaaaatcagatttcagcgaatgccacaaagttctaaaataattatggtttcacatgtttggagcgtgcacagtctttccatctttcagtgttttactctagccactgtggttcaaatccaaatcctgtacaaatatttatgcacgcacagtgcgcgcttcaataagctattgaatattttaatattatggaattttccaagaatctgaatgctagaaagcctagaacgtttgctaagggtatgaaactcgtcagggtgtgtgagttcgcctattccgtgtaacaaacaaaattgggtgcctctttaatctcatcatggaccaggttacagcgagcacagctgcgtagagcctgcaatctttaagctaaaattgaaggaggccacatacctgtcatcatcaatttttgggatagaagtatccgaatcgctgcccggcaccgagttcaaatccatcaagattgcttgttccttcacaaaacgaaaaaaaaaaacccaatcagtaagtgttggcagtctgcaatgcagagatagatatagtccgcggctccgggcgagttggggatcaacaactcgtttggggcgggcaatcgcgttggcgcgaggggatcagcagcagcagcagcggatgtggcggcgagggcgtgcagtgctagggctcggtcgcttacactttggacggagaacggcagggcgaggaggggatcgaatcgggcggaggagtgacggatattttcctcggaagaagtatttatttcagcctcctgcctgattttcccccacatttgagtaggtttccttcaagtgtatccgatcaggattactacaccttttggtaagatacagattttacctttctcggtaagatacagattttatctttagttagcatgttttttcaactactgaacggtacgatttatgtataaattttatatatacagttgttttaaaatatcaaatatatctattgtcaagtttgtaataattaagacttaattaattaatcatatggtaatagacttcccgttttaaacttcggatttgtcttgataggagttgtccgctcattttttttaggtgtttggtagaagttgtccactcatttttttaggtgtttggttgaagcgcaagggtagcatatgatcaccagatagagaacattctatttagatactgaatgggtgcatccggtcgaattggtcggacgaggcacgccagggggtggctcgcccttgtcgctcatacatggtggagagctagtcacatcccgtaggttccagttccaccgctcggaacgaatgccatccccttacattcccgtaattagaattacattcgctctttgcacttgcaacacatggacattttactatgaacttaaaaatacaggtggataaggtcccctactgtgttcatcacatatggcacagtatagcctccataacagaactagtacataatactataacataaatttaacgagtataaaatgaatggaccaagggtgtgttcgcaacccctttttctaacccacctatctcgttttccgcgaacacgtttttcaaactgttaaacgggtgcgttttttgtaaaaagtttctatacgaaagttgcttaaaaaatcaaattaatccatttttgaaaaaaaatagctacagtaatacttaattaatcacgcgttaatggaccgctccgttttccgtggatactgttccggctggcaaccataaatggcgaacacagcccaagtcctgtggagttgcagcccctttatttagaccgtgtttagatccaaagtttttcttcaaacttctaactttttcatcacatcaaaattttcctacacacaaacttccaacttttccgtcacatcgttccaattttaaccaaacttttaattttggcgtaaactaaacacagccttaaatataagcggtctgcagcacagatatcctggatgccttaaatataacatgcaacttcatcatctatatctgagaatataatacagatatccctatggccaccgaaatagtcagcaaaagtgggatgcctaagttccacgccacacttttggcaaccaaagcatttacctgaaaaagggggaaaaggagaaggcattagtgcatgtcttatgaagaaaaaaagaagacgacgaaagagaatataattatcctgccatgttttcacaaaaaagcatagatgctaccattgtcattctcttccaaagggcagcacaggtaaatgccactgtcctctttgcagcagggacatgtctcagcaaagaacaaagtagttgtgccatctgaacatttcaccaaaaagttgtagtgtcggtattctttcctaccttcatgaaaaaaactgcttcctttcaattccacaaattctaactcagcagcctgcaacataaatgagatcagtccagatgtgtaaattgcatttccaacttccaatccacaaacgaacattcaaactttgccaactttcgcctaacacttacaaaataccgctgaattagtaatttatgaggttgactagccaaaatgtatcatcattatttttgtggctccataccggaatattgttttgcttagcataagcgtgcagtgctattttcgcgatcttgacatcacgcttccctttgagtacttccatctctttaggcaacgtgagtggcctcatatggcgtttggatgcagcaacaaaagcatcacgtagtttgttgaattcgtcctcactgcatgtgaaaatatgaaaacataatctaagggtggtgttcttgctgctattaaacaaaatcaggtagtgaatagattatgtttctaacactaggctattcattttgcagatttgttgttttggtccatatattctagcgaaaccttatttgttttctttgcaaataattcaaagggggtcatgaatctctctccctctcttatgaggaaccagtggaagaattcacatgtattattaaaggagaagcaaacaaatagctaaaagaatagaatagctttaagtgaaaaccacaaagctgtatataatagatatactttcgaatgtaaaaatagcttcaagtgaaaagcacaaagctgtataatggatatactcccttggacgcatcctacaaattatttgcatctttctctattgcatatgtttctcccaagcatcatattcataattgttttactccacccaccaatcccggaagcgtgcaatgcaatctttaacctaaaatcgatcgaagtaggccacatacatacctgatatacatcgagatcgatcgagattgctcgttccttcacaaaaggcaaacaaaatcagccctaaactgaaatcgcgcgcagatcgcgagttgggaatcaagagcggagatcgcgaggggatgagcagcagcagcggaggtggtggagggctggaacgaatcgagcggcgccgcgccgaggagttgcgtgtcccccaaactgtttgatatttacctcgtccggaacaagggttatttcagcctcctgactttcccctcatttaagtcggtttcgacttaagattcttgtaataatctgattatcgaatcaaattactataaactagaccttccttttttgaacgctcacgggggaaagactccccacctgaataagattaaccaaaaccaaatactgtacaagagctgaaaacaaagaaaggggcacaggcgccccagaaaaaaaaaaccacaacaggcagcaaaagaagaagaagacccaaaaacgggcacagactaagtttcagcaaatgcagcggaagcgagaaaatagccttccagatggagaccacaaagcaatcgttacttcggaagcggtcagaccaacgacctgcatcctagatacaggcctgagaaggcgatcgatgaactaaggggatcccttggataagctatagtagaataagtcatgagttatttgtttctctggattattaggtttaaaaagctaatgtctataagggcatcaccaatgtttactactttctccgttacccaatgtaagtcattctatcatttcccacattcatatcgatgttaatgaatctagatagatatatatgtttagattcattaacatcgatatgaatgtggaaaatgctaaaatgatttacattgtgaaacggaggaaatacctactttgtgaataatggtaggtcttgtttcagtgggtattagttattgttgtagctacaatattaaatgaacaaaagtgggtggtaagctgggtcccacaaccactagacatgagagagggaggagagaaattatttgtttatttcttatggctaggtagtaagcatattacctggtatttgttgcttactactcccacagtgtatacaaccgggcagtagtagtattttatttcttaccacccactttatatgcacattgtgaatgctctaatgctctcagctattgtggaataggtggaggatgagacggcgacgacctggggaaggagccagggcattggtgggggcttggagaaggattcacgcgcaaggttagggtttgagggaaggatccacgcgctgggtgcgggcttggggaaggattcacacgtgactagggagagagaaagcggatgcacgcgcggccgggggagacgccgaattcgtgcacgactaggaagagagaaagcaaatgcgttgtggccgatctgttgggttcgatgacaatgttgggtaatttgcataaaacttttaagggtagtggggctttagctatccaataatatgaaaaaaaacacattagaggagattaccagattatagtaatatggcttatagtttataattataatctacttgtttgtttcagattataataatcctaagctgaaataaatatgaccttagtataaaccaggatttatagtcagacgtgacgtagagaatgcgtctcgtgggaacgttctatactacctccgtcccataataattttatttctaaaaaattaaaaactgattaacaaccaacataatttaccgcaatagcttttttttttaactatgctgtttgcttttcttcgtatcgaaccagatgctatattgtacatcgttgaatatagcgtccaggtctggacatttggcgtccacacctggatgctctggtactcgcggcaactattagaaatcgacctatgatttatagtactataagttaattaatgagttattaattgttatacaaaagcatacagtgtacatcacaatattgtagcaccgttccagagtagaacctacacagaacataaattacatgccgctttgctaaagcccatccgagaaaacgttcagcaacacaacctttctacttgcgggtgattctgaaactaatctgttataagtaggtacattaatattagtcaatagtcatcaaaacaatactctacatctatatattcagaacagatatccttgtggccacccaaatagtcagcagaagtaggacgcctaagttttatatgctgcactcggcacccaaaacaataaccttatataaaaagaaaaagaaaataagttaatattagtacatatttaattaaacaagatgaatgaaaactacaatttttcacaaaaagagaaatcttatttaccattgtcattctcttccaaaggacagcacaggtagacgtccttctcctctttgcagttgagaaaatccacctcagcaaagaacaaagtacgagtgccatctgaatcattgatcaccagaaagttaaagtgtgcatatactttcccacattcttcaaaaagactcctttctttcactttcataatttctaacttggcaggctgaaacataatgatattagtccagataggtaaattcatttccaacttccaatccacaaacaaatattccaactcttacccagcctaggcaaaactaaaacttatacagatataaaagtacaaattcagaaattcgaggatgtctagccaaaatgtatcatcaatgttattttcgtggatccataccggcatatctttttgcttggcatatgcgtgcagtgctatttccaccatcttgcatgcctcctcttcttgttcaggaaataaaatctcgtatgacgaggggaacacaccgctcttgtaagtagccattaaagtaacatacagtcccgtgtcagatatatatcgactaagtagtctaggagtgggatcatcctctatctgtagtcccgcaaaatcaccttcactgcatgtgaaaagatatgaaagcataatcatccccaaaatgcatgtgaaaatctcatgactcgaatgatatagtgagcatcgattatatttccataaacctttaaggtggttcttgcttctaaaatcaactaagcaggctgtgaatataatatatttctaaggctaggcctattcatttatctaatttgttgttttggaacaccagttaaaaaaatgattggctcaatttcatcttactcacaataattagaccgagactgaattgcttggtgtcaccgaatgcccttccctacctgcgggtcaaattgcatacccgcgctgctccgatagatcaccgggtgcaaaactggggtctgcaccagcctcaacggggaaactaccaccctaagctcaataagactttgactaaccaatatttttatcaccttgcattattgcataggcctcatgtctacaattatctaagttatacttttgaataagcatcagtccctgcgtgaggaaagccttcaatccatgtctatctacagtggcggacgcaggatttattggtcaggtattcactcaaacaattgcaagcatcttgtgcctgatgtttggtggactagggttagaagatttgaagcagttgactaactaagtgttgtgagctaggagtgcaggagtatatttgttgagaaaaaatattagacaatcgagtatatatacatgtaaatacctacatatattaagttcttttgtgaaatttttgggtattcccgattataaagggaatacccactgcttccatcactgtctagctatccctatcttgaaggttaaactccttcggtgtagtagtagtttatcctttggtgtagtagtagagttgtgggtgtatgactccactcactatggttgaaatcctagtgtcaacattgatgcatgtgaggtgggcttcaaataggaattttttgtatagggattttttaggaatttcctggcatccattctgtggaaggtttgttcaggggaagcacttgtcagtctatgtccatctataactaaaaagaaaaaaaatattctagttgcctctctaatttcgtttaaaactgacaagggggtggaggtagatctaataaatctcatctcatcaggaacctatggttacagccttacaggtagcacagaccatagagcatcagattatttaacccaacgacgaattaagattctgggttctaatagggtcgcacaaactatgccgcgagatataaaccttttgtcaacaactttgtttcgccttgcctcgtgttgtaactagctggatgtaattatttctcaattttatactccttctgttttatattataagactttttagcattgttcatgtttatatagatattaatgaatctatatatatatatatatatatgtgggcaatgctagaaaatcttataatatgaaacgaatgaagtaatacaaagatacgcaagccttgtgcgtgttctcgaaacaaaaagaaaaataaaaatggtcgcatacctgaaatcacagtgcttgcgacggcatgatgaatcgagggtcacatacaccgtgactgatcgttccttcacaaaacgcaagcaggtcagtatgtatatatatttacagtccaccgagaagagatatcaatcactccaaggacacattcacacgagaggaagaagagggcgctcacctgaatccgctggcagatcgcgagggcgagggcgagggcgagtcggggatcgacaagagcggtggaggtgacgcggtcgatcaacttggcgacggcgaacacggcgagggaagtagcagcggaggaggcggttgatggccggcggtgagggcgtgtagctagggctccctcggcgtcgtcgtcggggttgccgtcgcttggaatttgggggaatacatagcttccgcctcaacgcgcaacgaacgccgaccgagggaacggcggccggcggccggcgaacggatcaaatcgagcagcggcgagggaaatcggggggagagagaaaggtgtcgatttatttcagcctccggcgagcgtgtccggaatatacgtagtgagctgcgagcgtatccgagattccgatcaggtttcacgccctgattgttactgctccggttaaagttaaactgcttttaaatttggatcaagtttatagaaaaaataataaaatatttataatattagattaattttatcaaataaataattaaatatattttcataataaatttgttgaaaatattattacttttttctgttaaacttcaatcagtttgactttaaccaaaatcaaaacgtcttgtaacataaaacgtagagagtaattacgaaaatactttacctcggacgactggcgcgggggagccggatcgggcgctccccctgcgcaccctccctccgtgttgggcccacccacttctacctcccttttttccacgaaagatattttacctaatgtacttataatgtttcactatttataaatctaatgttgcagtgaattaaaatattattttgcaaaaaaaaactcacatattttggaaactctctattaaaggaatttgatttattttttgttccaccaaaaatgtttcacctattgtactcgtaatatttcactatgtatagatctaatgttgcagtgaacgaaacattccattgcaacaaaaaaacccacatattttaaaaccctctattaaaagaatttggtttatttttttgttccacggaaaaatgtttcactatgtataaatctaatgttgcagtgaactgcaacattctttcgctatttactgaaacattgtttttatataaggtgaaacaacacccgatttaaacgagtgaaacattttcgatctacttagtgaaacaattctgatatacatggtggaacatcttgcaacatttaaaaataatttaataataagcttttttttttgttggaatatatccatgtgtggtcttgttttaaagatttaattgcaatgaatttaatggtgcaatcgaatcatgatttggataagtaatttagaagaaaaatcagtttaaaatagttttatacgtaaatcgggcgctgacgtcagcctgattttactccaaacggatcgatcgcccgagccgtatgctcgtccgagtaattaccaagtcattgataaaataaaaagtcattttttttgtgtgggatatctaaaataaaataatagaatattccttctccctcttcatttccttcccatacctgatatccatcgagattgagattgctcgttccttcacagaaggcaaataaaaaacaaaccgcgcgagggcgagttgaggcggtcgatcgcgtcggcgaggtagtggagcgctggcggtcttacacttgaacggacaacgggcttccgatccctgggaacgacgaccggcggcgaacggatcgaatcgagcggcgccggagaatcaatcgggagcggaggaggacccgttgtctgatattttcctcggaaagaatggattatttcaccctcattacattctcccgtttaagaatgtttccgtcggagtatatccgatcaggattatattcaagcccgatgctccgttcaaaaaaaagcccgacgtggtgtacaagtgcatgggaacgttgtaaacagcgtctatataaaccaaacgagaaaattatcttgccatgtgttcacaaaaaaaggaaaagaacaagagttatcagtacaaatttaaaccaaacgaaagaaaattatcttgccatgtgttcacaaaaaagagaaataaatcttcttatattcgtaccattgtcattcgcttccaaaggacagcacagaaaaacatccttctcctctttgcagttgatatccacctcagcaaagaacaatgtaagagtgccatctgaatctttcaccacaaagttgtagtgtccataaactttcccatgttcacgaaaacgagtatattctttcagctccataatctctaactcagcaggctgaaataaacataatgatatattagtccagatatgtagaacatttccaatttccaacccacaaacaaaatttctaacttcacccagttagcctaggcaaaactaacacttctcgaacaagatagaatttagaaatttgagattgacgatgagccaaaatatatatcgccatcgttttcgtggttccataccggtatatttttttgcttggcatacacgcgtagtgctatcttcaacatcttgcaatgatcctgtcgtctgagtctttccaaatcttcaggcaatcgccacttctctgcaaagggcttagcgtcgcgttggcaggcagcaacaaaagcatctctcatttcctgggcatttttaaatcgcgatggtcgagtgggatcgtaattgtccaagagctgtaatcctggatcttcttccccactgcaagtggaaattaataaatgtgaacatatatacatatgctattcccctacttgaacttaaagcatgcagtgaatagattatatttctaataccacgcctgttcatttaactaatttgtttttttagataatatttaactaatttgttgttttggtacacaataaaaactttagctcaccaattgtaagatggaattcaaggaggaatgggctagttacactacatcgagcaaaaaccttaacttctttttcccttttaggaattcaaggaagcttatggtcctactttttatagaggagatagcataagaactcatatatatctttaaaagaggagcttggcaaccaaaaaaaatcagctgttttcagatcctgcaatcttaggaggccacatacctataattaagtactatttgggtagaagcagcgggcttgcgagaagatgatccggcgaggggagcagcagctgaggtggatggctgggggtgagggcttgctgctgctggagctcggtcgcttgggagatacattatccttaaaccttccgatctccggcaacgacgaccggcggcgcgactgatctccggcaacgacgaccggcggcgccggcgggatcgggattcgggagcggagtgacgatattcagcgggcactgatttttttttccttcccccacctctttttaagaagggtttttttttttttttttttttttttttttttttttttttttttttttggggttgagtccgatcaggattcatgtccgacgtggagtgcaagtgcgtcgctgggaacgttgtccagaacagcgtttgtactccgcccggcggccggacacgctaacggcaatcctaaccggaatcgtagaaaatataaaaacattaaatttttataaacatttatctagattcgtagctacaaatatttatattttgttggggacggaaggatatctaatatatgttagttggtttctcatgtttaaaattaactagcaagatacacatgctttgcaacgggttgaattatatgagtatattcatatgtgttaagaattttgttcttttttgctgtatctggtggcggaaacagcatatgacgaatgttgggttgttcgatttcttttcttgctctcaattagtttctctcatgttccatttccactcttagtgatggaattcaaagaataacggatcctccatttttcccacggttttccgactccactcttagtgattgaattcaaaggataacggatcctccatttttccggcggttttcctccagttcgaatgagccctcattaaggtgaagggatatgtatagatggccacccaaatagtccgcagaagtaggatgcctaactttcacatgctgcactcggcacccaaaacaatatctaaccttaaaaagaaaagggaattaagtattagtacattttaaaaaaatgaaagaaaaacataattgttacaaaaggagtgaaaattctaattatactaccatcgtcattctcttccaaaggacaacacagatatccgaagatgagattgctggttgctgctgggccagtggtggtggggggacatcccctgaccaaagctccgtgcgcgactaggttggctggcgaagttgcagtgtatgctgggcgtagactaggcgaagtggtttgttgacgcccctggtagccacaccaccaacctttaacttgctcctctggcaattgtcgtcagcggaggtgaaactgcttgttgtggcagttggatgctttgaggaagacccgcattcacttgttgaggaagatttggaattgtgcctagaggatcgatgctaggttcaacctagactgtgatgtcgaaacctatgtcgtcaaagcaacacctgggactatagtttggggcggtatcatgtgagcctaccagagagattggacttgggattgaagcatgttcggcataggtgctcgtgcagctacgccgactcttgccgacaaagctactgttgttgctgcatctagtgaagcatctcttgcaacttgactacctcataacctcatactccggccttgggaccaaagcagcttagctcgtagcccgtaggcactcaactttatctcctcttgaggcttgcttgtccgagttcattgccagaggtccctcgagctaggctttggcttaggcttctaaggcatactcgacataatcttcgacagcacccgcatacctctgcagaaccaccctccttcttgtcaatcttctcttcagcggcattgactttggctaggctccccacggacggcgccaattgttgtcgaaagacaaacacttgtcctggtgtacggaacaaaaaaaaacaatagttgtattttttttattgaacgccctttacaatacactacctgagagctatctataggtttacaacaccaaatctaaccctatggtttaccatgtataggcttttacatttttacccctatatgataagggtatctacagggattttttttatgtccttggctcacttgagtctactaggccttagcaggccaggcttaggccgccagataggcgttgtcagcctactccaatgcgtttcaccacagctcagctcgccttcgccttgactcgatcttggtaagagctccacttggcttcaccatgttccatcgtgcttcgcttgcttcgatgggctagtgaaagagcctcctaacctgcctccaataatacgcatggacaaagtccccatacaatcttttttttttgccgggtcggcagaagaaaggcttttttgccgggtcggtggaagaaaggccgatcaaatttcattaagatggaggctatgtacaaatccccatgcagtcatgacaatatcacatactagcaccaatctaagtagaacccacaacaagcatacgtagaacatgaattgactatagctagtacaaaaggaaatggtccagtctggtgaagttccatgcccctttgcttaaattaccttccaaacatcgatatgaacgttcagcgtcacaaccttcctacttgtgagtgatcctgaagccgatgtctttagtaggttcattacataaattcgaaatattcatcatctgtatctatgtacggctcacagatatccttgtggccacccagatagtcagcagaagtgggatgctgaagtgccacgtcccactctcgacatccaaaacaatgaccttaaaaagaaaaaaaaagtattagtacacattttaacaaaatgaaagaataaatacaattattcacaagaaaggaaagataataccattatcattctcttccaaaggacagcacagataaacgtccttctcctctttgcagtttagatccacctcagcaaaaaacaaagtatgagtgccatctgaatctttcaccaagaagttgaagtgtccatatactttgcgacgttccgtaaaaagactcctttctttcagttccatgatttctaactcagcaggctgaaacataatgatattagtccagatacatttccatcttctaatccacaaacaaatattccaactttacccagccaaggcaaaactaacacttctaaaatagggtgtgtttgaggagaaggggattgaggagattgaaaagatacataaaacgaggtgagccattagctcatgattaattgagtcctaactattttaaatttcaaaaatggattaatatgattttttaaagcaacttttctatagaaattttttgcaaaaaacacaccgtttagtagtttgaaaagcgtgagcgcggaaaacgagactcaacctcccctatctccccagaacgaacgatgcaagatttagaaattcaaggttagacagatattcgtggattggtaccagaatatttttttgcttcacatacaagtgcagtggtatttctaacatcttgcactcattctgttctctgagtctttccaaatgttcgggcattggcatcttgtatgcccagggcaagttacaatttttgcaggcagcaataaattcatcctgcagttccttgaaagtatattcatcagatggtccagtgggatcatcccaggtttgtagtcccgcaaaataactcccactgcatgtgaaaagaaatgaaagaatattatcccccatgcataggaaggtttcatagtcaaagatattgtgagcatggaattctatttccgtaaacctgagtgtggttcttgcttctaattcaacaaaagtaggtcgtgaatagaatatatttctaaggctaggcctgagtattttggtatgtcagtcaataaaaaaaatgattggctcagtgtaacaccctgaaaattcgaccgacaaaatcaaaactctaaaaatgcagatattcaaaaaaaaaaacttttcaaactaattgcaacatgccgattttattcgcctattttacctggatttgatctcgaagaatattaatagtgagtaaagaacagttaatcaggaataaaccttaaaaacaaattggtaaaataaatataaattaaaaataaagattaggtgtggatagtaataaataaaatattatcgcgaccataattggatcaattaaatttaattgcgatggaataagaatttaccctaattaaaactcaaataaattatataaaaataaaatatgagtaatattaacctagggtgaattcattagttgagataatacacatattgagtaaacttcgtttatgcaagatttagaaataatagaatcaaattcatataggaaataacctaaaatcgggaataatagggaagtgcactattcattgcccgcaaggtgttcgatgtggtccctagcctttccccttctcccccacctctgccctagccgccccgagcccgcgcgtcgccgccttgcgccgctcgcccgccgcgccgccgtcgccatcgtcgccgtcggcctcgcgccccgtgccgccgcctcgagccccgtgccgctgcctcgcgcctcgcgccgccgttgccacgctgtcgccatcgccgtcgcgccgcgtcgtcccatcgccgcgcgcgtcccatcgtcgctccgagccgcgcgccgccgctgccgagccgttcccatcgccgtcccgctgccgcgccgcgccaatgtcgcccgtcgctgccgcccgcccatcccatcgccgcgcgcccgtcgtgtcgccgctgccgccccgttccgtcgcctcgcgccccgcgcaccgtctcgcgccccgcgacccgcgcgccgcttgcccatcgcgtcgccacctcgcgtcccacgccgctgccg

SEQ ID NO: 58471 - DNA, 9505 bp, Oryza sativa
tgaatatgatagagctagtttccgaccgtattcgatccgttttcatccctacttattagtggtgtgcatagattctccccatgcattgccaaaaaggcaagaacacacagggttaaagctggaactttgacatggctgtatttggtcaagatacaagacaaaattccataaatattgctgcagttgctatgctgcatcttcatatttcaggaacaagaaaaagagcacacattgatagatagcgcttttgacacattgcgctttacacatgctttggtaatggctacaaaaagaatcttacagagcgctttcaaaagaccggcagcctaatccacttaaaaggtgaatggtaaaaactaatggagatcacaagttaaatagattattctattcagcaaaaaatgtcctaataggtggaaccttgagcctactgtcttttataactttacagtattttgaatctgataatcaaaataattccatatattaacacaaactgggttgtagttggtcaagtattatactagcatctgatcaattaacagaattccatgtgatcaatggggaaaatacaacacaggtggaaactattagaattcacgttgtcaacaatcgaacaagcacacacgaacacacggacacgaaagtggagggcaatcaactttattgatgtttctctctctgttacaagtattactttgccctcaacctcactattgtatttatacccacaataggatgtcctatatggatacatacatatatatttgatataagcctacttcattaataaggaaacagaagaatagaaggaggaggtaccgtgatcctcacgatcatagtcctacaaatccgactccttcgggagatcggtttcataacactcccccttgggcgaataccgcgctatacatatgcctcatcgaaactccttccaaaaacccaatgggagaaaaatgaataggagaaagagtacatagtacacgctacttatattgcactgttgcctcattaaaaacctaaatgtgagaaacttcaaagaaaactcactaaagggaaaaagagtacaaccataagctaatctactggataactctatcattcttcaagaatgatgtactaatctgcatgatcaatatcaacggaacacagtcagggaagtgctccccctgatttgttcatatctctcatcctactcataccgatgccatgcacaagcttctcaaaaacactagttggcaaagacttagtaaataaatctgcgagattttcactagtcttggtgagagtcaccttgatttcttctttcttttacaattcatgcatatagaagaatttaggtgatatatgttttgtgagactcgtcttcacataacccgtttgtatttgtgcaacacaagctgaattatcttcataaataatggttggagttggtgtgatattcagcccacatgtattctgtacatgttgtatcaccctcctcaaccacatgcattccttgctcgcttcaaataattctataatctccgagtgatttgttgatgtcgcgaccatcgtctgcttcgttgacttccatgagatggctgtaccaccacagagaaacacatacccaatctgtgacaatgctttatgagggtctgacaaatatccagcatcagcatatcccgtcatggtcaaatcttgataattttctaaagaataaaccgagatcttgtgtgccacgtaaataacggaagattttcttaacgccattccaatgccgtttggtaggagccgaactgaaccttgcaagtaggttaacagcaaatgcaatatcgggcctggtaccattcgcgagatacattaaagctccaatagcgcttaaatatggacattcagggcccaataattcctggttattttcctgtggtctaaatgggtcactctctactgctagagatcttactaccatgggggttctcgttggatatgaatcctttatattaaatttctccaatatcttctggatatatgcagactggtgtaacaataccccttcatgagtgtgctcaagctgcagacctaagcaatatttagtcttacctaattctttcatctcgaactccgtctttaggtaagaactagcttccttaatcacctgtgtggtcccgatgatattcagatcatccacatatacagaaataatacaaaatccatgttctgatttttttgataaacacacaggaatcatcattcttgatgaatccttttccttctaggaattcactgagccggttgtaccacatcctactggattgttttaacccatacaatgatctttgcaatttaacactgtatatgttgcgttttgtttcttcaggaacttgaatcccatcgggaactttcatatagatttcagaatccaatgacccatataaatatgcggtcactacatccatcaattgcatttctaagttcaaattgactgccatagatattaagaaccggaatgtaattccatccattacaggtgaataggtttcatcgaaatcgatgccaggtctctgcttaaacccttgtgctactaatctcgctttataccgaaccacctggttgttctcgtcccgttttcggacgaacacccatttatatcctacaggggatatccctacgggggtacgatcaacaggaccgaatacttttcttttattgagcgagattaactctgcctttattgcttctttccatttgacccagtctgaacgctttttgcattctgccatggactttggttctggatccagatcaatgatcttagcgatcttttcggcaaagtatatgtcgacaatagtagtctctctattgtatgtttcacctgtatccacataactggtggatatttcctctattctttcacattcctgatcttcattgtttcccgcaatgtttaagtcaggaatttccggtctcccagtgctagtagtaattgcgcgcgcattctcactgggttcattgccatccgggcatatcactgcaggtggctcatctacctggtgagctccttcactattctctggtgctgtggtattctgtccaatctgttgtttcgtaggacgtctcctagaaactttagtttggttgtgtgcaaccggtggtctccccctcttcctagaagttggggtagatgtagaaattaatttgaaaaccggttcctttgcgtcatgaggtatttctactctttccggtgcattcacagcaggtatatgagatttcatgatcccctttgggttagtgaaggcttctggcagattatttgcaattctttgcaaatcaattatggtctgaacttcctggtcagattccttagtacgtggatctaaatgtaggagatttttagtttcccactcaatttcgcggcattcgaccttctgtaggtactttcctccccctaatgccgggaaatgatcttcattaaatatacaatcagcgtattgacccgtatgtaggtctcctatcaatggttctaaaaatttaacgatagacggagattcaaatcctacatagattcccaattttctatgaggacccattgacgtacacttaggtggcggtatagggacgtatacagcacatccaaatttgtgcagatgggaaatatttggtgcatatccacgtgtaagctgcataggggatacaacattgtatgcagtaggtctgatttgaagtaacgccgctgcatgccaaacagcgtgtccccaacatgtagttggtaggttgctatgcagtagcaatggcctagcgataagcttaatcctcttaattaatgattcggcgagaccattctgagtgtggacgtgtggtacagaatgttccactttaattcccaaagccatgcaatattcattaaataccttagaggtaaactccccggcattgtccattgtaatggattgtatccggttatccgggaaactggctctcaaccggattatttgggaaataccggaatgatccagacatgggattaattggtccacatatgtttccctgtattcgttgcaagaatactggtgattctgcgttcacctttagattagagggtctaacgattaatttcgctgttgcacaatcagtgcaaacaaaatcttcttggtttgggaaatcgttagttcgtaaattatggccatttgaagttgagatgattcttgtcatcatccctagacctggatgtcctaacctatcatgccatattctgtatgactcaggatttttaaatattgttttcagtgcaacattttcgggttttatatgagtgtagtacaggccagatttcaaggaagggagtttttcaacaacagtcttacgatttccgtttaatttcgttatgagaagaaatttgagtttattctcatctttggtttctacatgataaccattagcacggatatctttaaagcttagtagagtacgactggactctggatataatagagcatcatttataatgatcttggtaccatgtgggagaactactgttgctcgtcccactccgacgatgtgtgcattgcttccggcaatagtagcaatttgaccagtctttttctttaaagtctggaaatacgtggtatctcaaaagatagtattggtggtacaacagtctaccagacacatctcctcttccattgccatagtacgtaacactattcttatcataaagcatttaaatataatcaattcatgaccatatagcaaaaattaacactttaagatagaaaaataaaaatctgggaaatatattaaactaaaagagttcactcaattattaagataaccattgctctgaaggagcttacagaaactatagttctgctaggaacacaaactaaatgcacacttgaaaaatcacctaactttagtctattacatagtctaaaatttaaagtaacttataatgtaggaagctaagatacaaattggaagacttaaatgtccccatataactgatcagagtccatgagatcatctgagagctttagctctgcgtctgctgcattctgttccatcttatcatcgatgtgcattgcaaccactgccttctcgtcgacctgcttgtcgatattcatggcagccatcttctcctctgagtgctggatctcaacagtgaagtgtgactcatgctccgacttcttcttcccatgcttctcttgataaagctcaatgagatgcttaggggtgcggcaaatgcgagaccagtgtcccctagtgccacacttgaagcatacctgatcttgttttccatattcaccactagtagagcccttcttagacttactgttctgatttcctttcttcttgaaagacatcttgttaactttgccaccatttttccagaaattcttccctttgttctggttattctggttattctggtttttccccttcttaaaggagctagcatttgcttcgggtgctgctgaacttccagtggggcgagacgtatgattttcagcaagtgtctcatcttctccttgcgcttccatgagcacggagactagtttagaatacttctcgtatttatcctggcggtattgcctctgaatattcacatgattggcatggaaggtggacaaagttttgtctatcatgtcagcatcagtgattttctctccacatagcttaagacaagtgacaatgcggtgaagaactgagttatattgctccacatatttgtaatcctggaaacgtaagtgaagccactcacgttttgcttttgggagcaaagcctttacttgatggccatagcgatccttcaatgagtcccaaaggacattcggatcttcctcagtcatatactcattcttgagagtagtattcaaatggtgcctcaggaaatgcagtgcctgatttttctcggctgaagttggtaaattattaactcctccagctgatgttgcaatagttgggtcctgaatgcagttcaggagtttcttagcaccaagcatgattttggcatctagtgcccatatcaggtaattctagctgctgactgctagttcagcaaaatctctcttagcaatatcagtcattttcctacactagtcatgcaaaattcaataagtactgcaagtaagagcatgacaagtgtgcaaatagtaaattgtctggttatccaaatttagtactgtgtcaatatattcccataattctcccaacatttctcagaattgttgtactatttatttaggtaccaaagtaattactgaattactaacccattaaatagtatcctgaaaaaaaaataaaacagctaggaaaataaaccataaatatgatgctctctcgtgtgtactaaatttcaaattatgagagctcatttcctaaaaaccatgtctctaggattctatggttgattcaaaaattaactaataaacagttaatatacagaaaattgaaagtacggaataacaaaaaaaaaagtgatattctctgtaatttctatgatcccgagggactattccgctaaaattccaaatccgcgtgtatcctgaaaattcaaggacatattcagaagtttgcctttttcgggccaaatttcgattcgagcccgactccttttataggcctaatttatactcggcccacctctatgtaccggctattcaaaggttaaccggcccgtcgggaccgtcgtcctgctaatggccttggcccatatgcggcccaacaagggcgccgcaccttatccaatcgggtggctagggttgaaaccctagcccctaattccaccgattcgatggcggcggcgggtatcccggtggctcatgcgggcgaggcggcgaggttgacggggctcgtcatcacggcggggtcgacggagctcgtcggcgcggcggggtcgatgatagaggcggagcggcggtgaggctacaagcagcaccgacgccggcgtggttggctacgggccgtatccggcgtccggcaaacgcagctccttgctgtgcgccggtggaatttggctcggcatgcgggtcggcgaggcggacggctatcggcggcgggaggccgcggcggcttcgacccccatcccagttgcgtgcggtagcgcgggaggcgtgccgtgcgtgccggcgggggggggggggatgcgggcgcggtctcctcagcgtctctgcgggcggcggccgttgacggcgagtgcgggcggtcgattgaagacccgtcgactggcttttcaagggcgaaccgacgacggaaagccgatggcacgattctgcggccatcggtgaagcgggtggccggcgacgcgtgctggcggcggcgagggcacgacggcgcatgctggcgtcatcgactcggtttcgtcgtcgtcaacttcaggaggacggcggcgctggcatgaggatttgggccgattcgttcggaatcggcaatcacgttagccaggtacgcgattcttcttatgtgcatcgcgattacaccctgaacatagcgtcgcccttcgaggcatcactagttctaaaccgtcgttcttgcagcggcttgtctgatccgttcgtgcgtctagggcatacggtatccgtgtatttgtttgcaagaaaagaaacccagcgcaaaggctgggaacagatctaatcggactatagcgataaccgcttctcgttcgatagatcggttgtacaagggataaccccatacgcctgtcgcgcatggggtggagagccgcaaactctcctgctacgtgcgccataagggacaaatccacatagtacaacccatcgatcaaacgattagcggagaaataaaaataacagaaaacgatctagcaagtttatcgttatccctatagaacgagattaggacagatcgatgttgacaatataccttggctgaagagcacctcgtgctgataacgtattaggattcacgttgtcaacaatcgaacaagcacacacgaacacacggacacgaaagtggagggcaatcaactttattgatgtttctctctctgttacaagtattactttgccctcaacctcactattgtatttatacccacaataggatgtcctatatggatacatacatatatatttggtataagcccactttattaataagaaaacagaagaatagaaggaggaggtaccgtgatcctcacgatcacagtcctacaaatccgactccttcgggagatcggtttcataacagaaaccatgtgatcaatggggaaaatacaacacaggtggaaacaacctcttgcacagtgcacacttttacaataatatcccaccctgatctatcttttttaaagctagctcatctcgagtaattttattgggccacatggcagtgttaaattttgagataaatctaagaaaattaagcataagaagaaatagccaaaagaaaaagaaaatacacaaatccaatttctagaggcttcccagtgatccatccttttgagataaatctagagaatatccataagaaaagaaataccgagaagcaaacaaaaggcacaacatctagattctagaggcttcccaaaatatatttcccctttgtaatctatctcgtgctggttggtttcgtgccagttgattggctgccctcaccaagagcgacacgtggcgagatacaagcggtggaaagagtgtcgggtaagaaacgctctctataaaactggcaagcgctcaagttatgacgttgaattgaaaaaaagagagaagaagagccactccatacgcgtagcttaggccacacagcaccacaacccaatagtatgtgattggaccagtgcaaacacgtaaaagagagggaaaaagaaaaaggaaaaaaaggaaaaaaatactttgtaaaattctttgcacattattcggggcatgtatcgtgatcatatatactatgtttcgagaaactaaaaacaataaatagaaaaactaaatgacataaacaatttgctcttttctaggattgaatcaaactttgtaatcctgataaccattttctaaatatatgtataatctgcttatactacaaaagaaataatatgtaaatctttcaatttttaaaaacactataattcggataaaacaaacacttatgtcggtgttgtagtcttatttcatatctaaacatcatgatgctcaaaatcgtacaagaaaaattaaatattttgtatgttaataatgtggtttttaaagaccaaatacataggctaatcagctggcgcgctaaccaacgcgttgatttttctacttaaaaacaaaacatggaccactagaatttttataaagatatggaggagaaataaaaaaacagggacattgagtatatggaggagaaccatagagaattttatgtgggtatggaggagaactaaaaacaaagggcaactgaattttaggatgatataaaagacaatcatgtagaaaacacaagtaatgaacattaaagaatgagtacaaacagtacatttaagtcttggggtagatatgtacaagttatcaatcttacaaatatatca

SEQ ID NO: 58472 - DNA, 12307 bp, Oryza sativa
cgcaaccaccaccagcagaagcatctccatcgcagccgcccacttcgccattgctcgagctagctagcgcaagaaccgccgcttggttactagccgaatgtgatcgaatgtgatcgatgtggtgtaagggaaggatgcacgtccccggtatttatagacgagatcgaggtgttgtagaaagcagaccgtttcgtgtactctcttcataccaaaataaattgatgtgtagagtttagactttaccatagtggtagtagtactataactgttcttctttagctgaacggaggaagaatgaatgaagaagaaagagacatggatcctctcagtttcgtgcattttggatactcgtatttttacatatatgggtctctttgactagtaacagtgggtcgatatgtacacgtgcagcaaattggtgtctgccaaattaattgaatcacaacacaagaacaggatagcacccaagaaaatcgtccaagcagatgtacaagactgcacgcaggcatccattggagttcatttggtcatcttatttgttttttcgtggacacaggaaatcaattcaacactttttacacattaatatttgtcaagcttaatttaaatgttgttcggtttgaacgtcatagtcactccacctgtttttaaaatatagttgttatagactatcaccgtgcaaaatgtatcaagcgtatatgtttatagctccattttctctctcggtaccagcgacgtcgtcatatccatgaacggtggttgcttgagcttgaggagcatcgccttctcgagaacgccctctcgatgtgtatcttcttcttaattaggccctgttagttgcttcaaaaacgaggaaaattttctgcgcatgcaaaattaagaagctcgataacacatgattaattaaatattaaattttacatatttaaaaagaattaatttgattttttttaaaaaaacttctatataatttcttttgaaaaaacacatcatttaatatttgaaaaaagtgctaacgaaaaacgagaaagttaaccatttaaccgtttgaagaacgtgctaacggaaaacgacgaggttaaagcttgaagttgaaaagaaaaaaaaaactaagccttagtcatcgtctcgtacctgcactgcacggcacctgctctaccggattgctgaacgtgacagcgccaaggagaaatgatagaagaaaggaagaaacgaaggggggtcggaacgagagacagacgggcagatcagatgcattcggatttttgtcagttcgcgcagggagagtatacgcaagtgatcgagagatttttgtttacgtgggttctataaatcgatgtcaaaattgtagcaatagtagccagagttttgtgcaccttatgtgaactgcagcttcgaactagagctagagctgcccttaattcatccacctcgatcaggactctgttcttatagtttgatgtagtctttaaatgaaggaatttcatggtattgagctaattcatgcaccctctgtatttttaatgtatgacggcattgaccattcgtcttattcaaaatttttgtacaaatataaaaatatttatgtcatgcttaaagaacatttgatgataaatcaagtcacaataaaataaatgtattacataatttttttaataagacgaatgatcaaatgttaataaaaagtcaacgacgtcatacattaaaatacggaaaggagtatttttgtaagatctatgcgtttcaaaggaggctttatactggtacgagtaggactcaacaatattttttcatctattttaactggatttcatgtctacatggtttagtggcgtagatctaattaacccttgacccttgttgttatcgcagggattgaaggtgctattttcatagtcaacagggccaacattacgagggctttagaattttttttaagaaaactgaggagagaatagaaactatataaaaaaattacaaattgcatatctctactgttataattttcggagccgttcacgtgagggacgtgcggcggcgagcagactgcccgagaagccggaaaggctagcgagcagtgaaacttcaccttttacttgttttttcagtttcagctgacacgcgctactctttttattttctctgtttccattttctgcttttacgtgattcttatctttaatatttcttcttcgtgtgattctccccatattttctatttttcgttatagtctttctttaatgaaaactttttatatgaattatttctaaaagacggtataaagactttatatatttaaagtttataggtagatactttatgtgtataaagtttataggtaaaagattttatgtatataaagtctatgtgtaaggaatttaaagtttgtatagataatttgaaagtttatttaggtataaatttcaataaaaatacaaaagttggtctataactagatattttcgttaaagaaaatagagtccaatcctaacaaactattttttttccaacgctggtggtgacttcgtaaatctctccaggaggatttgccggtccagtcttcgaagatgttcataggggtagggttggtgtgcatgtgtttatagggggtgagtgcgtgtgcgttgtgagtgtctgcactgtactgtgtaatttaaaaaaaaacttgataataagaaaatgataaaccatataccaggtcatctaactgaaacaacggaatactagtgcttgataggagcaaattatggttaagcacgtcattacaacagaaaaggagtattttacagttaagcgtatcattatcgtggtttgatcagatgattgatttatatatatagtgaggggtggatctagcgtgagtgctgggggattcgaacccgctagatcaccattgatagaaggaaagaatgaagggagaaaaggaggaagattagtggcagctcaaggaggaagaaatagatgagtcatcctatgttcttaattattctggatccgtccattatagttcatactattcaaatgttttaaatttgttgatgattttgtctatgagaaatttcagttgagagattggtattctgaaatagcatttcaatcaaattgttaatgtgtgactaacagtgcgcgcgccctcccccgcggcgaggcacatggcgcgcatggagagggccgtggtggcagcgcgtgcacagtgtgaggcccgcgtggttttttttttcttttttttctgtttggttttttatttctgttttttttttcctctaggaggcgatgctcctcaagctcaagcaaccggcgtccgtggaaatatgacgaagtcactagtaccgagagagaaaatggagctataaacatatacgcttgatacattttgcacggtgatagtctataacaactatattttaaaaacaggtggagtgactatgacgttcaaaccgaacaacatttaaattaagcttgacaaatattaatgtgtaaaaagtgttgaattgatttcctgtgtccacgaaaaaacaaataagatgaccaaatgaactccaatggatgcctgcgtgcagtcttgtacatctgcttggacgattttcttgggtgctatcctgttcttgtgttgtgattcaattaatttggcagacaccaatttgctgcacgtgtacatatcgacccactgttactagtcaaagagacccatatatgtaaaaatacgagtatccaaaatgcacgaaactgagaggatccatgtctctttcttcttcattcattcttcctccgttcagctaaagaagaacagttatagtactactaccactatggcaaagtctaaactctacacatcaatttattttggtatgaagagagtgcacgaaacggtctgctttctacaacacctcgatcttgtctataaatactcgggacgtgcatccttcccctacaccacatcgatcacattcgatcacattcggctagtaaccaagcggctgttcttgcgctagctagctcgagcaatggcgaagtgggcggctgcaatggagatgcttctgctggtggtggtggcgacggtggcggtggcggtggtggtggcgcaatcgccgccgccgccgcagtgtgaccccgggctgctgtcgccatgcgcggccccgatcttcttcgggacggcgccgtcggcgtcgtgctgctctagcctgaaagcacaacaggggtgcttctgccagtacgcgaaagacccaatgtacgcgtcctacatcaacagcaccaacgcacgcaagatgatcgccgcctgcggcatccccttgcccaactgcggctaggctccatcgccgccgttcgccggtgctggctatgatgtgtggcagcatatataaatatatggtgtcctatgtgctcgtataaaataaaggacgatgtgtggaagcatatatatatatatatatatatatatatatatatatatatatatatatatggtgtactgcatgattgaataaaataaagaatgtgtgtttgaatacataaattaccgatcgattaatgcacccgtgtttggttgatcgatgaggtgtcttctgggatttaagtttgagtttctaatttccgatcttgtgggagcgtgaaatgctgtactttaagagttaataagtattctaagatgatttgtgttttcaagtttgtctatcgatctctcaactcaaatttctcataaacaaaatcgtccaaaaatttgaacacttggatcatatggactatagatagagcaaccatctgatcaaaaccacgatgagctatgcacttctcttcacgtctatatgaacgtgtgtaaactgtagtgcgtgctggaaacgcgtgcgccaaaaatagtagttctgggttgtttgcatggataaaaaaaatgcattcttcctcagtcctcgacgagtgttccgtacttctcgaaaaggaaaaatatactctctttttttatggaaatttatccaactgtcaacctttttcaccaccgtaactttactggtggtcttatgttcacctaaagaacaggtaatgtattcacatcttgagcattcaaaatttattccaagattgagctttccacctaatttctttatctcagtaagttacaactaacatttatttaatttctctgcacacttgttcatctcaaccagtaacaaccatctaatccccgtcccttcctctctctcaccgacggtgaggactggcagcggtggcagacttggtggacggcagcgttgggcgaggatcgatgggggctagtccgatgccccttcccctgtctccttcggacttcaacccttagtgagtccctatgatgcccattatccgtcagccctgctcgctcacatgttcacccccttcattggtccgtctaccaccgtcgcatgcctctctattgttaccaagaccttaaaaatcaaaccgtatcatcacccttttaataatttttagaagttccgccagtcgttaccacccttctgctcgtttgctttatgtcactcctcttcgttgacatcacaatctttaaaagtcaaaggtttgatttttatagtttttaggtgccttgcctatggccaccttcctattgttttgccctgtgcacctctacttccctaccacccaccccttctctttgttgtcatcatcaccttcatcggagttccgctcatctgcacgaacgcaccttctcttccttatcatcatcttcatcagggttctgcttgctagaccgcttccccttcaatttgttttcattggcaacttaaacaatcgaaccttattattgtcgcctcctccctactcatttgccacccctctacctaccactactcttcttagttatcgttggcactttacaaaatcgaattttatcattgtaagggctccattgtcactgccttactcctttgtcaccccttggctcaccctcccatggcaaccgccgtctccctactattttctcgccctttcactcacctgcctgcagcccttcctttgttatcactgacactttacaaaattcaacgtgttccctctaaatcgaacagtaaggtgttgcgttagtgcctcaagcccatgtgtcatgaactcagccatatttttttccacgttaccttggcaagttttagtactattgatgggttaggtatgagactgtagtcggcctactatataatactctcgtacgaaagattatataaaaaaatttattctggataaacataataaattaaattattgatttggaaaaggtacgattgactgtatatagaatatcgcttacatgtctacatacatatcggatgtatctatgagactatggaagattaatttacaaaactaatctactaattacccgatgcgtcctttttggagataatgaagtttcgaggtacacttgtgagtatgcatagcaaaggggaacttaggaggtaataatcatactccattgtatagtatatatccatgtgtatacgttgactggctataatgcacgtgaatgtgttgggttggcttcctgaccactgtttggccttctgaccatgcgtgatgctcgtacgcgcggctggttccgtggtcttattcatgccgtatgctcctgtgtcccgtggatcaatatgacgccgactagctagtagatcagagcggctatcctctctgcagttggcagtacgatgatggaggtctcgtgatcgataatattgaactgatattctccgcagtagcagtgtcttgaagttttttccatcccaatagattgaattgtcagacagcgatggtttcgatctaaagggaaacgttctccaattgggttatatctctcagagccaaagtcgtcggagtacccttgtcggaagatctttaatggcaattaatgtcttgatgaagattgtgacaccattgcttcctggtcttgtgaacgggctttgtgatcgatatgttgttcttggcgggaatacgttggaggaaagatcgatgacgtagcagcaaagaccagaaaagtgatggatccaacttggagaaaagtaaacgtcggttgggtcatatctcctaggccagggcgatcatagaagtcgacatcaaaaaatccgcctcgaactcatctcgtcgaaatcttgaagcaccaaatccctcaagcgaatacggtgacgcgtttcaatgctgtcttataatgatataatatatataataaatagatagataccacgaaattcattcatttaaagacgacgtcgagctctaagaacagagtcccgatcggagtcccgatcgagatagatgaatgttaagggcaactctcgctatagtttgatgctgtagtttatacaagtaggacaaaactttggctcgatagctacaatgtttaatatcaactagcatggtggcccgcgcaaattgcgcggctagcatccttatgttttctctcgtataatagcatatatatttctttttttattaaaatatctttaaataacaacataatttaaatttctatttcctaatttctattatttctaaattgtatttctgtatggactctaaacttctctttcaatatgtctttttttaattccgaatttcagttatttttaaaatgtatttctatatggactctgtattcttcttctgatattccttttttttaactcgaatttttgttatttctaaattatatttctatatatactctaacctttatttttaattttcttattttttttaattccgaattttcattagttctattgtatatcgttatggactctagttttctcttcctatattccttatttttaatttcgaattttagctattttaaaattgcgttcctatatagactcatattttttaatttttctctgattaatatgagaatttgtagttcatgagagtgaacgtggcggcttcgttttctattcctttaataagttaatagatttgtagaacccaccccaagccttccattctggtgatggatccagaaagtagccatgatagacagcaaatcatgtcaaccagttactgatccaatcagatcagacccttgtccttggtgctatcacgttcagtatctctgtggattaggtgcaggacgacattgatgaggttgggtagcgcaggtacgagaagatgactaattattagcatatgaataattaagtattaattattttttaaaaaatagatttaatataattttctaaagcaaatttttatatagaatgtttttttaagaaaaatatcgtttagtaatttgaaaaagtgcacgaaaaaacgagtgggttgagttgggttgggaacttaaacaaaagaacacaagcctaaagatatgcatgtcgaggacctctctaaggaggcgatgttcctccaactcaaaaaactggtgaccgtggatatgacgatgtcgccggcacccagagagaaaatggagccggggatatacgcattcaaagcaggtgtaccaacagccatgtgcaacaaagaaattttcgtcggtcgagttcgactactccctccgtcccaaaataaaccaatatcatattaggttgtgacacatactaatacgataaatttagacatactaagatgtgtcacgtcctattataatgttgatttattttgcaacgaagggagtacttttgaagtttgatttttttttctctgacacgattggcacagtgtgttatgttcggttttttttttttgagtagttttgattttaacttcagactggatgctcttatgattcgaaccaatatcttggccacacttgaacaggccaaacgtgacaatgacacctttacagtcagcttgtgttatttcacgtgaaaacgcttacgatagatattgatttgtacgattatgtccaaacgccttcagtttatttagcatagagtctgttcatttttgtagagcattcacaatgacattgaaggccaaacagattagcagaagattgatgagccatttattagggggggactaactatatttatgacaccacaaattttaaaaaatagtcaaatattgtaaattacatacaattaaaatacattataattatattgtaatttttgaaaattacaatctaattttttaaaaaattacattataattatgttgatattcattgtgtaagagatgggttacaaaatattaattgccgatgttgattatatatcaaaatagcgttgactaacaagcaaattgaaaaacgaaagagtaaggcccactataatttttaataagtctctatcacatcggatgtttggacactaattataaatattaaacatagactattaataaaacccatccataatcttggactaattcacgagacgaatcttttgagcctaattaatccatgattagcctatgtgatgatacagtaaacattctataattatgaattaattaggcttaaaaaatttgtctcgcgaattagctttcatttatgtaattagttttataagtagtttatatttaatactctaaattagtgtctaaatacaggaactaaagttaagtccctgtatccaaacactaccgagggatacaaatgtctctaacggcaagatatacggacgaacgcatgcaagcctcaatcactttgtggctgcagaattttagcaatacttttagcggacggacgcatacaagcccataaatcagtcacgaattgaggcggcatattttagcaatactgttagggcatgtacaatgttgtactcctatttaataaccgttctcttcgtcgacatataaataaatttaacgatatgaaaatccgcatgtccgaaacggcacgacacaattggcagtggtacagtactatgtacctactggagaagtaatagtaataaaatcttggtagaactgaaggaatcgatccaaatccctcgagagatatcctctcgtgtatctttttttctttcaaatccaatataaataattatgaaaaattatttaaaaaatccaatataaataattgtgaaaattatgtaaaaaattgaaagtttagattatagtgatatttgttagtccaccaaaaataagctcaaatttgacctacatgttaaggcaaaaaaaataaatttaggtgcaaacagtacattgttattcatacactgattttatccatttatatctttgacatgtaagttgagtttggatctaatatttcacgaaatgatgtataaatgttatatgagtgttaccaaaacttttagaattttttctaactgattaaatggtttttaaacaaacaagggaacatctcgttcccttcgaaggatcatatatatgtatatatgtatatatatatatatatatgtatatatatatatgtaaatttgtttggtgctccatggtgcccgggcaccacgattgaaatttactatatacccaattcaaatgagtatgaaactttttcaaatatttaggtattaacgttaactactttactaactagttcaaagcaagtttgaactgaattcaaacttgcttttgttagattttgattctaggtacatagcatccaaatatataattagttaggtatgtaataatggattgtgaaataaagttaaatttgagttgttttgttgctaggtataggtatgaatcgaatacttataactaggtatatactcacaatttgaaaattttgaaaaatttggacgaatttgtgtatttcataccatggtgcccgggcaccatggtgccccatatgagtgtcctatatatatatatatatatatatatatatatatatatatatatatgtatatacatatgtatatatatgtatatatatatgtatatatatatatatagtgtgtcccgtagaatcaatatagatatgccaccacctcaatttatcaatagcatttttttatagcagaatttataaatcaatgtttaaaatcacctgctgataatactaccaattaagaccatcataaagttactcaccattgcattgtttttatgatagcagagcaatataaattaaacatcaccttgattaattcacagtactccgtttttataaattttgttttgataaagtgatcaaaatatgcctacataggatgtttccccatggaaaagtaacacaattgactcaattcaatcaaacttttgaaatttaaccatcaacggctcctaaatgtttttagtctagaaacataaaaacgatgtgtgtagattttttttataggtactttcataatattatagttttgcttcatctaagaattacattctaataaaaatagtggtcaaaagttacacacccaaaccaaataaatcaatagtgtcatatattcaaatatggacgcagtaatattttaaaaagaataaatttttgaaaaccccatattttatagccagagttgcaaaaagaaaaactaagtattataattggtatttacataacttcagatattatggatctaaagtttaacaagactccacgcctatacttgttgagtataaatttacttaaatttttaaaatagaatgtgtatgaacttttatgttattgagctcttgacagagattggtagttttactctttgttacattgaaaaatattgtttcaaatatactaaaattaacttagatttgaatatatgcaaaatttataaaatatttaaataattaaatatgtgattatgtgccatgagtcataatatataactaatataaatattcgtatttttcctttcgtcacatctattttcgtcccgttcatccacgtacgcaatccgattcggttagcaatagccatggaaaaaaattgaaaaaaaaaaatcggcggccgccgacgccaccaccgccgctggaggaagaagagaggcagaggagggagcaccgccgccggatccgcccgcggtggccgccaccgccgacggatccaccctcagacgacgccgacgctgtcgttgccgtcgacgccgccgttgagagggcgccgtcaccgtcgaggccgacggggagagggagagggagggagggggagggacggccgtctctgccgcaccccgccgtcgttgcgccgtgtcggcgagacgggaaggagagccactgccgccaccgccgctagcgtggggaaggtcgccaccgccgccacagctagcgtgggggaagtgcgccgtctctgccacaccccgccgtcgccgcgccgtgccagcgagaagggagggagaagggcagggaagcggcgccggtggtgggagaggcggccagctggggggaggggagaggcgggagatggggagagggagcggc

SEQ ID NO: 58473 - DNA, 968 bp, Oryza sativa
atccttcggtgattcggccacaacgcgaggcgcagtggctacatgcaatccggcgacgacggcgtggtggttcatcggccgatcggcgtcacgacctaggcacaactggcgtcggaggagatcgtcctcctcgttgttggtaccaatccttgatttctgactgctagatatatattctgattccagatattctcgggcctgtgtacctacacaacatgtttcctttcgagagatgcatgggcgttctgaagaagtatgttcgtaaccgtgctcgtccagaggcaagcattgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttagctctagttcacgccaggaacatcggtaagtccaatgcatggattacacggcatcacattgatactttccccacgtggctacgacaacatctcatgggcacgccggagatcaaccaacaacttgccttcctgacgaggggaccgtctgggtcgatagcgacattccagggatatgagatcaatgggtacacattctacacgagagcccaagacatgaagagcacgaaccaaaacagcgttgttcgtgtcgatgccatgagacacgatggaacaactgccacgtattacggtgccatcgaggatatatgggaacttgactatggtcctctcaaggttcctctgttctggtgccaatgtgttaggttgactggtggaggagtaatgattgatgacagtggtatgacaactgttgaccttaacaaggttggatactcggacgaaccttttgtcctt

SEQ ID NO: 58474 - DNA, 12696 bp, Oryza sativa
cctgtcgatagttaccatgcatgttatttggtgtcccacagttaataatatatgttctttggatatcctacagtaaagatggtaaactttaagtgtactatcgcaaattttaccttaagataaggcagattacaatgtttcggtgttaaaaattggaatcagaaaaaagtattacaatgtctgagcacaacatgcgacaacaaagcttctgaagcaaactattaattatggagttatatcatgtggataacgataggggattacaaatatagagatatgcatgtgttaatttcaccacacagtactactcgatcacctctgttgtccggtgcctctcatgattcatccatgtcttgtgtgccccatatttagttgaaatcgctgcccagccaaagattacgacgcagggccaatatgtaattagcgttcgaataaggagaacacgtgcaataactggcaatacctgatttcccttcctaacatacatcgctattgcaacacggggtgcatgcaatggctccgtgaataagcatagagatgcaatcatcatcattacacagattgcaattgcagtccatcgagccactggagccagtaccaaatacatacctagcataaaagcagcacccaaacttatcaccgaactgaaggccaggaataaagatatgttgaagtgccggcgacggaggggccaactaaccatagccattccggagtacatgaggtggatgatggctaaagttgagcaaatgaatgctattgtgttggccatggtgaatgcatcgaatatataccttccagcaagtgttggtgtaccgccattgtaatggtcgtcggctttatatcctccaggtatggctaaaattgcgccaaatgtgacagtaacaattagtactgatccgatgcctagagtttgtgttgaagttgtcagtttctctgattccttcgcttcgtctgcctgttttttctgaaagtgatctgcccgacggcaaccaccacttgcattgcaatgtgttaatgccagcaatatcaatttttctgggttctgcaaagaaaacatatggatctgtaattcaaaactacttaattattttgctttgtttgtactggaaagtggaaacacaaaaagagtgagaagtgtattacccatacatagtaaaacccttcatgaatcttactgtctgctatttctaaaggagtctgcccctgattatttagtatatttaagtttactttcctgttccttagtaaaatacaaaaaatgtacttatttccattccgcactgctatatgcattgcggtgttgccatcattgtcttgcatattgaaaatcctagccaatgatcgagtacggtgagcatactcaactatattccttctgcccctttcaacagcgacatgaaggaaagtcctccccttaaaatctacaagaccagcgatctcatcaggttgctcctcaattaaatatttgatagtccgaatggcacctgaggatgcagcaacgtgtatcggatacaatccttcagaatcttgctggtacaactgaactgggttggctagcagtactggaatgagcggagtgcgtgacatccacgttattacagtatattcactaagtgatgcagcgaagtctttacaaagtgatgcagcgaagtgaagtggcgtgcttcgatttttgtcaacttgttctgtgaggtccttgttccaattcagtaacatttcagtcatctctgcatatgtggtgttcaagtcaaactaggttgtggcatacaaactttgcagtagctaagaagaggaattgaacataaatatatttctacataatccacttctacagtacgaaaattagaccatttttggttaatttctccttaaggggattgaaggtaattcagagaggaatattccacacttattgaggtgtgaaattaatcttcctcaatccccttcaatcttttcctcttaggccttgttcggttgtcccgggaacggccgggattgggctacaatccccatggatcaacccggtgcggattaaatcccggcttgcaagaaagtgtgcgttcagttaagcccagtttggattatatcacaacccatcccggcctttccgcgtcaccccggtccgggaagaaatcatcgacccaagaggtgtggaaaaaaatcctcgagacgatgcgcagtgcatgggaggtgactcggtggcggcggcgatgcgaccgaggggcgatgggagaccgcaagattgggaagggatggcaatggcgactcagcgccttacccttgtccactccagtggctagttctcacttctcaccggtgcacatatatctctttcttcctctctcctctcctgggtggcagtgttataaggtttcttggagcaagggttcctaagtcatcgcttgcgctcctcattgccaccacgactatcctcgcagcaatatattgagaacgggccagtgccgcaacccaagcccgatagcatgcccgatgtgtgtcaaactaaatatggtggaggagaaccttggtctttctgctttgagatttgctccggtctaacaaaaaataccttgaggtaccgttatctcacgataccaaatcgttttcgatagttggatctagcaacgcccatcctgtctagctaaattcaacgatcggaaacaatttaataccatgagataccggtatctcgaggtattttttactggaccagagcatatctcttctgctatagatctccagtatcttaacaattgagtcaacggagtgctacaatgaagcgtgtgaatgctgttcaacttgattattttctgttttgtcaacttttgccatgcgtgtgatgcctcttgaatcacggccatagccgccgacagccgcgcgtcatcgccgtcccgtcgctattcccgctctccgcgcgcgtcatctcgcgtcgcgtcgcaccatcgccgtcgccatcgcatcgccgcgtcccgtcgaccgtgacctcgctgacgcctcgccaccacagcgtcgtcgtgtcgctatcccatccaccccggaatcccgctgaagaagctagccagctacacgtgaattcgcggaggctagccgccagctcgccgctgcatcccgccaaaccctcaccgcctataaaagggccccaagctcccccattcttccccacaccatcaccatcccaacccatctctctctcctctctctttctctcgatttcactctctgtgccgccgcctagagccgccgcgctccgtcttctagcgccgccgtcgccggaggagctccgccggaggccgccgccccttccccggccgccggtcgccgagccgggcctcgccgccgcgacgcgccctcaggccgagccgagcagagcgcgaggaagacgaagaaaccgagccgagccactgccaggccggccccgcgcctcgttccctccaagagccgctgacagccggggcccacaccttttcccctccaacagttgccgacaggtgggacccttcttttgctgtcaaccctagcggaatattcccttgccgtccaataaataaaatcccagaaaatattttatcttttgaaaatccgtagaaaatcaaccataattccgattgaccccattcaagtttctaaatttttctaaaattgagatctacacagtggcactgttatttctctgatttaagatagttttattgccttttcttatttagatttgttttcgcgtttagagcccgagtacgaggaagctccggacgccgctttcgagggaaaagaccccaaccctgtgcaaggcaagcctctttgatcacattgcccctatattttcaataatatgttgtttgcaaaaatgcattgcttagtatacacgattaacatgtttaggcctcggattgtttatacaactgacggaccaacctaggagtcgcacttatatttcataggttgatgtttccatacctttgatagctccacaaatatttgcgccggtattgttgtacgaataccgagatagtttcgcttagccatgcttatgttgtttgccaaatacatgtttaaaagtccggtacgttgtaccgaggtgttgtgaaataaaatgtgttgtgaaagtggtgatgatgcggagtcatgcctttgtggtttggctacgtattgtcgttaaggaacgattcctttgggaaatccatccaaacacattacagtgcgaccacacgggtatttatgggatgcctctggctaagtaaattgctatcacatgggagttggtgtgccaatggttgtggaatgccgaggatgaggagacgaagtttttacctttttgcccatcatgggtgttattttgcctctattgtggtgtacgaaatcagtaggagacatcctcggtatttcctggcgtgcgaactttcgttgccgacgggtaaacgatgtcagtttcgtgtcgtgtgggtaaaacgtgcaacctttgcagagattaatgaactgtccgaacagccgtgcccacggtcaagggcgagtgtaaggtgtttctcatagcgtagatttgtttgacaaatgtttgtgaagtggttatttgggaagggtaacgttaccagagtccgcctgtgtggcagacggctaacctatgtggttaggaacaggtctgtgtgacctggggtgtcgtccgacaccgaggtgttgttagggccatgatggcgttgttgtgctgagataactgtgtggactatgtgttgttgtgagaagaaactaatagaggaaacaaattaattgttgttcgttaatcgtgataagttgttgcaaagcaacttgtggaatgggtcgaggcgtgagcctcctcctgacaactaaacacttgactcactcactaggagttttgtgaaataaatcactttgccaaaaaggcagctttcgcaaataaaaccatagcctccttgtttaagccaaacatgtcattctttcctctggcttgctgagtacgttaagtactcacccttgccccttataataatctatagagtatgaagatgaagacgtcgacccgaccgccgaggagtatctccaggagcaagctgagtatgaagacttctagatgttttgtccctagccccaagcctcgcttgtggaataagttagttgcctaggttcatagcctagagcatagttgcttagtcgcttagtctctccgcgtgttcgcttttatgtttttctgtgctattgtgttgctcatccatgggcctgtccatgatagcaacttatgtaatgactgctacccagtgatgtaataatgcagtttactttgatttcacatttattctgtgtgtaccagctagtgtatcctgggactggtactatatcacaggtaatgcataacaccctgatgtaagttagctatgtttatggctaacgaatgtcggggcgttacaggcatgatgtctaggaggctttgttgttgcaggtccgggttgaggaggagtaccacatggtagcggatgcggtctaccacaaacgcaatcgctcgagatcctccgggagtgctgccgatactggaggccaaggaagaggtagctgccaccggatctggtgtgtgtgtgtgtgtgtgtgtgtgtgtgtgtgtgtgtgtttgtgtgtgtgacctgccgctggccttggctgctgcttgccaagacctaccccattgacgccacaccatagtctctacattaatatcgccgccacgctgtggaccaagcccaccaacctctactactcagggttcctgttcgcaaaaacacaagcgctagagcttatgtgccttcgccatccatataagcgtcaagcaccgtcttgaataagacagaagtgagcagtgtggggaaaggttgtggctgagttgtagggtctacaagaggcaaaatggactttttcacaccacccatgctggcaatcctacttgtcacaccacttaggtggaagtggcaaaatattaggaaaccttctctctccgatggaaaaaacataggaccaaatctaacagtggcatttagaaaggagccacttattaatagtggactagcactgataacagaattggtaactgaatgtgaaaaaatattgtaggagatccaagaccgatgacaataatgaggcatgatatttgttagagaggtatttcaaccgaaccctacatcctggggcattgtgttgctctccaaactagtataactataatataccacggtaccaatatccctccagcagctaagacaactagtcattccctcgcctaagttcttaggtggtggctagagagtttaggattagagttcgacattacttctatcctaaacacatcctccgaaccctacatcctgagacactgtgtgttgctccccaaactactacaactataatataccacagtaccaccaataaccctcgagcaactaaaacagctagtcattccctcgcctaagttattaggtggtgcgtagagagtttaggacaagagttcgacattacttctaatcctaaacacatcctccctctataaaaagtaattctggctacaaatctagacatagttagaatttcttttgttacataggagtcttataataacttcttctttccaactgacattgtatgtatatttgaagcaaacttaatcggcaatgtttgcagtcattgcctatttattatcatagggcaaacttcggaaagtaggtcgctaggctaggtacaagctccctcaatgctgattattaattgtaaggcatattttgttattatattttggaatattatataatacttcttcagttataaatatttgatgtttatgacaaaatttagtaaaacttctgaaattcttaccatcgatgattctcagaacaaggaatggtataccatcatggtattataaaattattagatttataaacatatcctaattaatatatatataacattgatgcttgggattttaaagaagtttgaccaaaacttgtcctaagcataaaaattaatgattagaaggatttaaaataagtatgaagtaccgtacaaaattaacatgaaatgaaaaggtatatatatcaattgcacacgtacctttgccttggagaaccgctgcatgcaatgcgttctgtccacttaggcccgaatatgaaagattctctggactcatttgatgcaataactttgcgatgtcactacgttgtagcacgatagctaggtacaacggtgaaattcctgcttcatccgtaggggaactagccaattctggatcgaattcaagaagcttggtgatcatttccttgtttccgatgcggattgcatcatgcaagggaagaaaggccgtcccctttctcagaacttccttcaatctagccgctacctgcagatttgacctcggattattagccagatcaattagaaaagaaaccatttgggaatggccagccctgacagcgcagtgcaaaggcgtgccgcctttgttgttctgcaccagcaggagatgcggggccttgctgcagatgatctccacactcctcaggtagctccagccatcaccagaggtggccaaaacatgcagtgccgtgtcgccttcaatggtgaccccctccaggtccaggcatgactgatgcccatcatcaccagaagcttgctgcgtcgccatggtaggaattgcagggttagcttggtccaggggcgacgagtctgcagagggtgcaggacgatgacaagcaccttcctctttagcagccttctgttgcgtcgcagcttccatgttcagaagaatgtgatcggttatcccatcacaatcacctcgcgatgcaaggagtagcaaccatggattcatgggaggctttgcggtgtcctcctttgttttggccaccgtcagtttggatttgactgccgatgccatgatgggcggtggaggagcaccgaggctagctagcggcagttggcatctgggggcttgcggtgggtgctggtgctggtgcagcggcactaccactactcgacaatattgtggttaatcaaggagggtcacttgcagttgcagctaataatttgctgggcactgttgtgatctgcctacgtataatccacgttaatttataggttcattgatcggggagtatattgtttgccttcggcaacacgcgacaaaccacgagcaacaacattgttcgacacaaaaatatatcatgtgtacatgtgattgtgctttttttttttttaccttgatgctggggacggtgcatctgtcgcgcgactaccagccataaaagctctcagtcgccgtctgctgtctgctggcagggagagatatccacggtgtgttggagtttctaattcaagatcttcttactttagccaataaacaatcatcttctcttaattataatcaattcactgacctacgtttgaagccatcaatgattcctctgatttttcacttttcctttctttcttcttctctgtttcttcttcattttgttttttcttcttcttcaagaaccccttttagggcccctttaaatcgtaggaatgaaaaagcagaggaataggaaaaacacaggattctgataggaatataattgtaaaacagaggattgcaaaacacatgaaaaacataggaatagctgtttgattggactacaggaaaaacgcaggaatcagatgagagagatagactcaaaggaaatattacaagaggttagacctcttgctaactttcctccaaaatgtgcataggattacacattccataggaattttaaaggattggataggattcaatcctttgtttcaaaggttttcataggatttttttccataggattgaaatcctccaaaattcctatatttttcctacaaatcaaaggggcccttagtgcctagatcgaacgggcgattgtattaggattttaagattagagagagtttgactgtgacctctgccattgtttatatgacgatactagtggggctcaggggtattatctccaactaaaattgagtccttattttaccgatcacaaaaaaaaaaatctcttatttggtttcttgttgggaaatgaaaacgatgggattttatccctttcctaactaactggcattagccgataaaatcaaccaacacggtgatcaatctgtcatcgtttattttcctttttggatttagtccttttgcgattgtgttgttgccagatgattatatcgcttacctaatgtgccgcatgttaattaatcatcatactttctaacttttcttaatgagtaaatttcacaaaactacatatgcttgtgatggttgattttattgactcactgtcgataaggattaggaaagagattaaccaccaatttccttcccaatcaagaaagaaaaaaaataagcgattagattttgttttgtctgatcggtgtaaaacagaattccaaactaattggagataaacccccgagccccaccagtgtcgatatatatgagaaataggaggagacgcagatgtgacgccgaatctctccctgaaccctaaaccaattgtctgatcggttagacactggaaggggttcgtgagacatctctagacgaagaagaagaaagaagagaaacagagaagaaggaaaagcaagaatcaagcataaatttcaatggcttcatctcaggtcagctagatcaattaatttccgcataatcagaaggtgatcatgtttaggctaagactcaaattaattaattagattaaattacaacagcttggaccaaattttcacaaaactacaaatttaaatatgtgtatcacaaaactatagatttagtgtcaaacatttcacggaactacagatttaatgcaccattcacaaaactacatatgtagtgataaagttatcaaagaattacatattttagagtttatccatagcacgattatttatgtaaagttacaaaatctatagttttgtgaaaaatagttgttaaatctatagttttgttacataatacttttaatatgtagtttcgtgataaatttggcagtaaaactgtagttttatgaaacacattcttaaatatgcagttttatgatagtttgatcaaaaaatctgtagttttgtaaaatttactctttcttaatcttgactttttaagttgttggagttatatgggccttgtccatgtaataatagaacaatcaaaggcttacctaatgtaatagttgcatgcatgtgaacttcagtgccattctgttgatctactaagaataaatatcagtgtataaggaataatacattcttctcgctacttcaagaataatactatcagtttataaggaacagtgcgctcttcttgctacttaaatcatgtggttacgagagaacttgagtaacacacgctctcacatgtggcttagtcctggtaagcggataagggctcctagcttgttacatcattttagctataatatcaaatttatatatataataaatgtgcgcttatattttcaacacgacttatcagattaataaagtagcttcaacgaccaaagaatgaaagaaagaacctacacattgcttggcatttggaaacacgttaacttttgccgcatgcaacatttgcagcttttttatttttaattctgtggtgactatgttcttttcctcttcggacaaatcgaatgtcggtatcatgcctgcaggaactgattcctttccagctgtacaatgtgtagtgaagattgagcttttgcttttgttcaaagattgctggaaattaatttcatcccttccggacactagcacgcaaacactacatcaataacgactactcacatttataacgattaaaccaaccttacaacccaatagttacagacatagagactcatatgtaacggcactaaaaaacgtggagctgttacaggtgtgaaaattcaacttaaaaaaagaaaaattaggctcataagctatcacagatctgaaaattcccaataataataataataataataaagaaaaatcaccctgtctccatcccccctcctagcatcctacctaggggtgaaaacgcggtatgcaaagttcccgaccgtaccgataccgtttccgcaaaactaatataataataatatttttactgatgttaccgttttcaaaatttagtttttttaatttctgtcagcgtagcattgaagttggcactaaatagatgaattcataaatatggaaatttcccgaccgtttcattcattttcgaaaaaaataataaaataatgtaccatttccgaccgtttccgaccgtttcatccctaatcctaccaccgatggccgttgcacgatggtgcgaacgggtgtgtggggggagggaaggaaggatggtgcggccatggctggggcgcgcgacgagggcgtctatgtaggatcgagatgtcgactagagggggtgaataggtgatttaaactagatgagacctaatcaaaactaacctaagttgttaggcttggtgagggacaatgtaaactaagcaactaagttaagttttgcaaacctcgggtgatatgggctcaagtatatcactatgaaagtaaataacacgctaagttagttttgcaatcctagagtgatatgggctcaaatatatctatatgaaagtaaattgcacaaatgtacatgcaaaaggtaaatgagacaagagacaaggagtttttcacccgaggttcagaacctcgccggtttcttaatccccgttgaggcgagcccaacttcatcactcaaaaccacgaagccactacaagccctcttcatcaatgtagcacccatattttatcgcgcacatgtcttgttgcccgccttcttccgggaagccaccgagctcgcgcctccctctctctcgcgttccatcgccaccgcgcgtgacgtcgcccacgtcacctcgctctgagaactctaccgcccaaatcccggccgtagccatcatcggtcacgcgtcacccatgttccaccgccgttcctgctctccgcgcgtcacctcatgtcgcgtcgccgtcgttttcaccgtcgaattgccaccagtgtgtgacgccactccatcacatcaccgtcctctcaccccggaatcccgccctagctgctagccgtctacccccgaaatgccgtgtctagactgccagctcgccaccgcatcacccgcctataaaaggggaacccgagccccttccttgccatcaccatctccatctctctctcctctttccctctctcgttcacctctttgtgccgccgcctagagccaccgcgccccgccttcatgtgccgccatcgccggcggagctccgccgaaggtagtcgccgccttccccggccgccggtcgtggagccgcacctcgccgccgcggcgtgccgcctgtgccccggctgggtcgagcatagcgagaggaggaagaagagaagccgagccgagccactgccaagccggtcccacctccctttcctctctcctgtcactgatagccgggccccgcacctccctctatccctcaagcagcagacaagcctgggcccgcgcatcattccttccatctatcattgacaggtgggccaaccccttgccgtccgcctttagcgatgaatattccacggaatattccttttccgtttaatattttgatttccaaatattctagaaaatccatttatcctttgaaaatccatag

SEQ ID NO: 58475 - DNA, 7019 bp, Oryza sativa
ttgaaaatccatagtaaatcaaccccgattgaccccgttcaagttcctaattttttttaaaaaaattgagatctacacagtggcatcattgtttctctgatttgagcttgtgtttattgctttttgttaattagtttcgcttttcacgtttagagcccgagtacgagaaagctctggacgccgtttttgagggagaagacccccaaccctgtgcaagccaagcctctttgatcacattgcccctatatttactaatatatgttgtttgaaaaatgcattgcttagttcacacgaataacatgttttggcctcggattgtttatacaactgacggactaacctagtagccgcacttatattttataggttgatgtttccatacctttgatagctccacaaatgtttacgacggtatcgttatacgattaccaaggtagttttgcttagccatgcttgtttaaaaatccggtacgttgtaccgaggagttctgaaataaaatgtgttgtgaaagtggtgatgatgcagagtcatgcctttgtggtgtgccaatggttgtggaatgccgagaatgaggagatgaagttttacacatttttgcccatcatgggtgtctttttgcctctattgtggcatggtgccagtaggagtaggagacatcctcggtatttcctgagtggatgacggctgtccttaactgatactcggctatggatcttagcctttaggtggcatgtgattttcatgggttagctttagaaatgccttatcacgaacttccattaccgacgggtaaatggtgtcagtttcgtgtcgtgtgggtaaagcgtgcaacctctgcagagattaatgaactgttcgaatagccgtgcccacagtcaagggcgagtgtaaggtgtttctcatagcgtatatttgtttgacaaaggtttatggaaaagtggttattgggaagggtaacgttttcagagtccgcctgtgtggcagacggctaacctttgtggttaggaacgggtctgtgagacctggggtatcgtccgacaccgaggtattgttaggaccgagttggtgttgatgtgctaagataactgtgtgaactttgtgttgttgtgaaagtgaaaagaaactaatagaggaaacaaattaactgttgcttgttaatgtgacaagttgttgcaaagcaacttgtggaatgggtcgaagcgtgatgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaaaaataaacagcagcggactagcggcctacggctccatcttcacaggcgctcaactggggtataagccaggactccacctaagacatcttctccaaagcttctcttactgaaggggggaaagattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaattcccaaagtctaaagttataaaaccacctaatgttgcctaattattcagcgaagcatctacctaaatttatactagtggaaccatgaatagagtacccactagttggggttcttattttcctagggtgaacaaggtaataataacaatagcaataataatgtcataacaaaggtaagtaggcatggctaaataaaacagtgataacgcgggaatttaagcaaagcgataatacgataatttaaatcaaaataattttataaactgggattcaatatgctcaagggtgatgtgacttgccttgctcagagagaacggccttccgaaccttcggcgacgaccgcgaaccacgcttcgggaacctccggaacgacgaaagctacgcgaagcacacaagcaaagctacaagcctatgaagaagcaataacaatacataaaaacaaagcacagggttctttaggttataacaaacattaagagacttgaacgggtcgattcggagttcgtatgaccaaaatatgatcatccgaggtttaatgctgttatatggagatttgcggattattataattaagctttgcaactataaaacaggtgtaagcgctagcctggaaaggacaggaaggctgcgccgttgacatgcggaccccacatgtcaacctaaaggactgcggtagaccgggtacacagaggcggtccacgggtcgacggaagcggatcccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggagggacgaacgccacgacgaccgggaacgacgagaggacgacgacgacgacgacgaccgggaccggcgagggggcgacgaggggcagccagcagcagctgcacggggacgaggacgacgtggaacacgccgctacgatgccgacgacggaggcggcgccgcgagacgacgagccgggcgaccgatgggacgtcgacgacgagaacgatcggagacgacgatgaaacaatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcactggcgatgaacagcagccggctggagggagtacagtggcaccaatgtcactggttgccggcgggggcaccgttccggcgagtttccggcgaggagacggtgaggccggtgaaggggacggtgttgcagagccgaggggggcgacggcacggccggacgatgctccggtgaggagggagaggcggctggaggtggccggcaaggaggaatgagaagggcgacggcgggagtgcgcctccggcggtcaccgcgcgaaacggagggtaggccggcgaagaggaggcggctgcgatgctagaggaggcgacggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatagaatgggggagggagccggccacggggaaggtcggaacggcggcgggaaagccggccggcggcaatggttggtggccggagaaaacgcgggcgttcccggcgattgggggcgccattcaaggggaaaaacgggggaaatcaaagaggaatcaatggggattaattccccccaatcaattttggaatccaaggcttaaatcgcgtggattcgagggaggaacgaagctaggttttcggggagagagagaggaggccggctgggaggaggaagaaggcgacggcgggctgacgcgtgggccccgcgcggggcgcgcggtcagcgcgcgcacgtgcgcgctcgggcgggagggcgccgctcgagttgggccgggcggccggcccagggggggggaagggggaggcggcttgggccgggcggctgggccgaggcaggccgggaggaaggaggggggggggaaagagcccgggagagagaggggggggaagggagctgggccgagaggggaggaggcccaagagaaagagggagagaaggagagggagagaaagagagggaggaaagggagactttgggctgggcttggcccaaaggaggaagaggattatttttaggtttttctttttaataaactttgataattgtttttgttgcttaataattatttccggtgctctgaaaattcatgtaaaatttgagggctctttttagaccaaggagaatttaacaaaaattccccgggccacatttgaatttttctggcacgtattttagtgtttgccaatttcttttcgaatttttaattaattctattattccttttagcgaatgatttttattctcgggatgaatttatcaggacgtgacaaatccaccccccttacaggaatctcgtccccgagattcgaggaggctagcaagaagataggttgggcggtcttctcttcttgtctgacttcttccgctccgtcttctataacaaacttgcctagcacaacttctccactctggactgcttggctcgatctcctgttgcagatggaatcttctcttcacctgacttgtccctggttgaacctttagctgacttcgactgggttgcggcacttgaagatggggcttcagttccagaacttcgcatagctcatatctttggggtcaacctcatacaagttaccacttcatgttatgcgtcgatatcagcttgtcattactaggataccatgcttgttatttacttctaacttaccactattcacttcatgttgtcctcagttagcattcagcgtattcctttacacctttgaccttgatgtgttctttcccgatttctcttatcaatcacctttcgacctacttctttgcctggtaataaacatctttttcgatatcttctatcagtcatcttttgacctttgtcgctaagtactcttcactccgagagttgtggatgcttctggtggcgatgaggtcctttggtttgctacctttcagtgaaaccttgaagtgtttcgccaaaagctatacggactgtcattgcctttgatccgaaaaagacacatctgaaactcttagtccaaacaaatgtctcttgggttaatcacttgatttgcttcgccatcaatcgctaggttatttgattcataatagattatgagcttacggaaatgagaccctaggtctccctaatcagcaacaaaatgtacacaactcacagcacttgcaatcctaacatggatccctcaataaacttatcaagctcattcattatctcatgtttctctgttattacatgattgacggggaacaactataaaacataagtatatgattactgatataagagtattatggttgcttctgactagcgctaggcttaacaggtactgcatttgctccagtgaccacttggcgattggcacgtctgcttccttaacaggtactaccgttgtaaataactttcttacgcttgggttcttcatcctgtacttgatttcttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgttgaggagcaagcttctgattgcagggagttgcgtggactgacgtgctggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttg

SEQ ID NO: 58476 - DNA, 1637 bp, Oryza sativa
atgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacacgattggcctattatgtcgccgttgttgggcgtctacgtcttcaccgccggcctgcctccgtctgccgccgactggtgtcctcgcctgcacggcaggcctattatgccgtcgttgttgggcgtctacgtcttcaccgccggcctgcctttgccgccgccgaccggtgtttccgcctgcaccgctggcctattatgccgccgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacggctggcctattatgccaccgttgttgggtgtctacatcttcaccgccggctgccttcgtctccgccgactggtgtcaccgcctgcatggctagcctattatgccgctgttgttgggcgtctacgtcttcaccgaccggccgcctcgtccgccgccgactggtgtctccgcttgcacggctggcctattatgccgctgttgttgggcgtctacgacttcaccgctggcttgccttcgccaccgccgaccggtgcttccgcctgcacggccggcctattatgccaccgttgttgggtgtctacatcttcaccgccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattatgccgctgttgttgggcgtctacgacttcaccgccggcttgccttcaccactgccgaccggtgcttccgcctgcacggccggcctattatgccaccgttgttgggtgtctacatcttcaccaccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattattccgttgttgttgggcgtctacgacttcaccgccggcttgccttcgccaccgccgactggtgcttccgcctgcacggccggcctattatgccacc

SEQ ID NO: 58477 - DNA, 21564 bp, Oryza sativa
  unsure (1)..(21564): unsure at all n locations
tatctatttagttttttttataaaactttggtaaatatataagaaatcctgtcaaaacttggtaatattgtcaaattgtaaaaattttgacaatgccaaaatttggtaatgtttgttttagttataatctgaacagccccttaatatggatccatactccatttgatttcaataagattgtggatggatggacggatcatggatgggttgctttttaatttatgtaaacatcaaaagatgctccccttttgaatggtactactgctagtatgatatagcgttgttgcaatgcatgatccatctatcagaccctagcatcaaggcatggtacttctttttctttttcttttcttttctttttgcactaggatgctcttcttctaccttttcatcatcatacctgatatgctgccctgccctggcctgttgtcaaaacccataccgatgtgtttttctcgcagcaataaaaatatattatgccttttattttatttatttttcacctttatgaacttgcatgcatatcttcatatccttcaaaacggtcctgttaaatattcatgttgatatgtctgaatcattgaccaaacacactcctgaaaagaaatcactagctaataagtatagctattactcctagaaaaccccatcctgttgtaaaaacagcaaaccatgggatatttgatggctttatgccatgtactattctgctgagtgatgtctaagcatttttggctcagattaggaattgtcggcacagctttatttgtacaagaattgacagcaattgatgctaatgtggtaggctcacgagaattcacagccagataaacgtacgagctagttttagccagtcattaggttgctgacaccgaaatgaaaattttgtggcacccactgtccatcatcagatttccaccactccagatatgcaacaacatattccaattttgccgaacaaagtttcaggacaaaaatctctttcggtgctttgctaaatagttaatacactgcttgctgatctcttgttgcatatatttactgttaagacaaattcggtgggcataactaggcatgcattagcttttgtttaatctgctatatatgccatgggaatcaatatcatatagctaggtgaaaacaaagcacccagtgctttccaaattagtatatgtgcgcttcaccctgattgtcgtttagtcaaacgtaatctcccacactcggattgatttggtgtccttttattgcttgtcttatgcactgattatcttaatcgctgttaaaaagatggttacacgtgttgttcatagattaatgccttctgttctgaaagatgcaacaatgtgttgcctttttgtcaagaaagataacacaaatgaggcacaagtagaaagattgttgcaagatcagttcttcagatttgcataggaaaaatgtttgtcatgtctgtaccattgtctgcatcacagcaaaatgacttttgtctcttcattcacttatctcagtatatttcttctgcatatatactagagtactagtttcagtaacaaagaactcatctgttaaaaaaaatcacttctttttgtgtgtgtgtgttcaagttgctctaatttatggcaactgaaacaagagactgatatcactggaacatcagcagcttaattcagaagttataacaaataaagttgtaatagtacattcatagcgaatgaagtgatggaatgaaacagaaatgctattaatcacaatcaaatcggaactaaaaatatgcaaacttatggtgatttggaagcatgggaatgcaaagaatggcaggtttgctctaatttctgacaactgaaacaagagttgacactgaaaacaagatcactgatcgttgtgatcacaaagtagtactccctccgtttcaaaatatttgacactgttgactttttagcatatgtttgaccgttcgtcttattcaaaaacttttgtgagatatgtaaaattatatgtccacataaaaatatatttaacaatgaatcaaatgataggaaaagaattaataattacttaaattttttaaataagacgaacggtcaaacatgtgtaaaaagtcaacgacgtcaaatatttcgaaacggagggagtagcaaatattgtagcacattgatagtaatcaaaagagaaacaaaaagaagaatgggaatttgatggtaagcatggaagaatggcacaggtttgggcggacaggggtgtacaggacgttcatgttcagcagcccgacgatcctggcggtgacgccggaggcgtgcaagcaggtgctcatggacgacgagggcttcgtcaccggctgtgccaagggcaccgtcaccctcatcgggcccaaatccttcgtcaacatgtcctacgacgaccaccgccgcatccgcaagctcaccgccggccccatcaacggcttcgacgccctcaccacctacctctccttcatcgaccagaccgtcgtcgcctccctccgccgctggtcctcgccggagtccggccaggtcgagttcctcaccgagctcaggcgcatgaccttcaagatcatcgtccagatcttcatgagcggcgccgacgacgccaccatggaggccctggagcggagctacaccgacctcaactacggcatgcgcgccatggccatcaacctccccggcttcgcctactaccgcgcgctcagggctcgccggaagctcgtgtccgtgctgcagggtgtgctcgacggccggagggccgccgccgccaagggcttcaaacgctccggggccatggacatgatggaccgcctcatcgaggccgaggacgaacgcggccgccgcctcgccgacgacgagatcgtcgacgtcctcatcatgtacctcaacgccggccacgagtcctccggccacatcaccatgtgggccaccgtcttcctccaggagaaccccgacatcttcgcaagagcaaaggtcactcctcactctgcttctttttttttcctggcactccaaatttggtttcaatcatctgaacttttgcattatttgaaattttgcatgatttgattttgagttcaggctgagcaagaggagatcatgagaagcattccagcaacgcagaacggattaaccctcagggacttcaagaagatgcacttcctctcacaggtataatataataatatatatagggaaactctattcatttcttaaagcgatatctccttgtttttttatgaaatttaaaaagtcattaacttttttaaaaaaattagtatgatatatcaacatatgatatgttacttcataaacatacatattcaaattcaacttatacaagtagaaacaaaaataacaaatttgatggatagaacgcgtaattcattgtcaaatttgttatttttgtttcgaattgtatatgtcgaattttaacttgcatgtttgtaaaaagatatatcatatattcatctaccttgacaaagttttttaaattttttgataacttttttgaacgccatgcacaaaacgagaggatgtccactcgagggacaaaaatccacttccatatatgcaaatgatttttaacacagtggaatatactactgctccagccgaattaccacagtaattactgcataactaatttgcacgctaatgatgatgaaatctgaaggttgtcgacgagacacttcgctgcgtcaacatctccttcgtgtccttccgtcaggccacaagagacatctttgtgaacggtgcgttttcacatagctgaaaatccatcccttaaagacatatcagaatcatcatcatctgaattctgattgatgttgttgtttctctagtgaaccacatcgactgattactactagtgcttgaaatgaaatgaaaatgaatgaatgaatgttatactaaccaagaagaacccagcaggttatcttatccccaaggggtggaaggttcagctgtggtacagaagtgtgcacatggatgaccaagtttatcctgaccccaaaatgttcaacccttcaagatgggaggtaaattaaattcaatccattcttctgcagtttttgtttcttcatcaaactagattaagctccatcgattctctgcctttttcagtgtgtttcaatggtcgatgtaattttttttgttctttcagggaccccctccgaaagccggaacattccttccatttggactgggagcaagactgtgccctggaaatgatcttgcaaagctggagatctctgtcttcctccatcattttctcctgggttacaagtaaacctcctctcaacatatttatgacaaaaaaaactactgttaactgaacatgattaattgtgaacagataaaagactaactgctgcacctctcttcttcttttcagtctttatttcttctactcttttcatttcattatcagtttacttgtagcttccaggatcaaaactgaaagttatgcctttcagaataccaactccaaaaaggataaaattgctttgttcaaagttcaaaactgaaagttgtctgctgtgtgcaggctgaagagggcaaatccaaagtgcagggtgagatatctgcctcatccccggcctgtggacaactgcttggcgacgatcaccaaagtttccgatgaacactaaaagttcagggattctttagctggaaccgaaaacagccaggctaggctacttgttcctctgggacaagtaaataaacatgattataaagtatatcacgtactctggaagaaaaaaaagagagagaagtgatgtgtattcgtcttgatatgctcgctttggtttcgcattgttcttgtttgtcctagcttaggacaaagattaaagtaaagcagttcgagttatactaacaagcttcctgaatatgggaaacacgcaagcattccccttcttttctatctatccacctcactgaatttggattgttctttatcagttaataaagatggcacgaaaagttgcagtttaagctggtttttgtcttctttttattcttttttcaaaaatattgcttctttttctgtgagggcaatttagtccccaagctacatacctatctgcagaagtttagtcatatttttttttatcccgaataatttcaaccacagctatttattgttcaaccctactaataatacttgccccaaatgatccggcaatgcagctggatgaacacaagcgtcgatgataaatatggttcatatggatttagccgtccttcagttaaacctgatgttgagggttttaaagaagccactgagcaacttgcaacagagaagatttttcgaggttctgatcgagggcagaattggtggactgcatttttcaagattgaatcaacgatacataataaatctttgtatgtctctcataaaattgaccaaagatagttttgctacaaatataaaactaatgtatttaaggttctcaatatcttttttatacaaatacttaaattaggttgttgagtcaaaaggaaaaaaaagtctaatataaggttgttgctatgaaggtttacttgaaatatttgttctaaatcattcaacgtataataacattttgggtgccgagaggggggtgggaagtgaccgcaataacaaatatagtgcttacccaaggtttagcccctcacaaaaagtgaaagttttgttttttcgaaacatacatagaggcacaagtaaccgataattaatgagttcacgtgcatcaacaatgctctacgcaaacatgtgttaagacttaacaggtggaagtaaccgacaataatgaattcaacatgtctcgacagtgcgttacgcggaacgtgtgttaagggtgtgtgtagtatatgcacgtgatgtacgtacgtcttctacatgatcgcaacaaaaaaaagaaggaaaaatagattctcctattccttctatacaaggaaatactttaggaaagcccccattttccgacaaacggttatgatgggtcaaactcagccttatcatatagcaaatttctcacaaaaaaaattgtacattcaataccctactactatttatctgctgttctagacacaaaacaaaagcttatttcaaatggcacaaatcaatatatttttttgttcaagatcacagcctaccagtaggtaaattcagtttcacaagaaaagggtaagagaaattggagaatgaccaaaatacccccttcccctccatctatttctgtgtttgtgctcctctactgtctccatctcccttctcttctgcttccgatctgcagcgccttccgcctcgccggcgagcaagccggcgccgtcgacggcctcctctccctcccggacccgccctctgccctcctcccctgcgcgacctcctcgctcgctcgcccgcccgcccgacctccgtctccggttcgcgtccaattttgaggtatccactcaattcttctccccttggattgagcccgcgtggcatggattggggatccattccggactagggtttggtttctttgcctagagctgacccatccagcgtcttcctgatctctttcgggcgtcgtgctgtgcttgtagcagttcatagcagctttgttaggtctgcccccttaccgtaggcgctttaggtactagtttatcgatgaaattgggttgataacagtgatgatgcaatcctgctgttgttgttgatgagagcaggagtgaaatggatggggttgtcgccgcttcggctgatgccaccagggacgagattaagattatgaatgtgtacatatgggacatggatgaaaccctcattctgctcaagtcgctgctggatggctcgtatgctggtgcctttgatggcctcaaggaccatgataagagtgttgatatagggaagaggtgggagaatctcattctggaactctgtgacgagcatttcttctatgaggaggtcagctccactccactactatctgctggctacttgccatgttactatatatttgtaggcacattcttgggtagatgtgattgatttcctttttagtaatagaaacaagttgaaattcccgcgcaaagttgcgcgggtctacttgaaatagaatcgtatctgttaaatgtttgtagccattaatctaggccgttataatttggtcccaccatgatggatggtggagatctttctcttttccgccggccaacgtggtgctttatatgcctttagagcaaacgtggtagctccttttagtgagctctcaataatataacggatagatagatacgacaactgtaccagaaatagatagaacgtatgataaagtgtttctacaaattggactgtccatgccagtatcttctttttgtcactgtacttgtcgtgtagttatctttttggaatccatttgtacgtgaaatcttgcttcatataattcatctagctgggctctgcacttaagtgtctgatgtttcatttaatgcatgggtaaaccactcttttttatgtcatatttgttaactgatcatttttgttctcacacaaaatgcagattgagaattacaatgaaccctttctcagtgctgtcaaagaatatgatgatgggaaagacttgacaacatatgattttgaagctgactgctttagttcgccttatgatgatctgaataaaaggaagcttgcttacaggcaccgtgctattggagagaagtatacaaaggtatcacaggaattaccttctcttacatccaccccatattgctttctctaggccttttttcaggggctaggatggtgagggatcctggccatccacctgattagaataactttcattcacttccatattggcccatccaaacaggccctaaggttcatgccctctgtcaggcatattttgaatgtaccttttaagaatgaaccttctaaatatggatgtggtgcagtgctcaggtcacttctctagcgaaactgtgatgcttcattccatttagtaagaatattgttactgttcaagatttgataccatggagtgtctgtgtctggtatggatcagcacacttttctggtgtttgatcaatcattgttagttgctataatgcttggactttatattaagaaatagaatagattctttatgacgtctaggaataaatcgtagcagggtgctaactgaagtatgttgcttttatcttcttcttttttttgcgggatgttccattgtgagctttacgctgagcactggtctgtacttgtaatagagttgccacacacagcaagaaagaggtttgttcttgggaagtatgtaggttaatttgtatcaaggcgacaggggtggggagttatgtggggattatagtggatattcagttctttgaaatgacttgtcctcctcagtgattctctgggacttcatgttttggttcaggctattttgttcagaggttttgatcttagcgaaactttatttaggaacaataataagaaatagggccttagaagtcataagtgctgtgctgggactttatatagagcatcatcattagatattcacttttcagctatctattttgtagagctcttctgttttcatttcgttgttattatttagaactttttcatgccagtactaatttctaatattttgtcaatttcatgtttgtaatgagtaattgaacttctttggtgtttcttctcagggtttggaaaaaattctggaccaccacatgatcaaagtctggaatgatctgtatagcgcgaccgacaaatacaccgatggttggctttcttcaggtattctaactcgtacttattttcctttaatatttagaaaaaaaggactagttatctgatttttgttggcagaaaaaaatactttggccttcagttctgttgatgaactaagtatgacaacaaagttgtaagggttttacaaccacaaagaatcttctagagccttatgttgcataattgatggtactccaaattgtcaatgccgaaagaacatgcttctgatatttctactttcaaccagtgggattaaatttgggctggcatttttgtttatggactatataattgttatcaccaaagctataagagtttacaactaagaggacctgcaacaacttaacaatgcatgtaccaaaataatgtcccttctgcttgatacaatgtttcaaaaagcgatatgtggttttgtgtggttttgtagcacttatgtggcataatcagatgcttatgtggtataatcgggtgcttatgcggcttaagctgtacaaggttggggcatccgttccttgtatgcggccttgtacgtggccttgtagacctttttttcaaaacactggcttgatgtatgcttttaatcactgtaggttgccacctcagaatacatgttcactgaaagaaaagtcaggagtttttaagtttttctctgtgtactatgcgttagaacttttgagaacaagattatattgtcttaactgttctttctttagccaaattcaacaatcagttttgttgcttcagtgctcaattgccttttctcttgttatgcagctcataagttgttggaagaagcaatgggtaaatcaacagctgagtccactgccaaacattcaagcatcaattgcatagttacatcagggtccctgattccaagtcttgccaaatgtttgctctatcgtctggatgatgtggttgcattcgagaatggtatgtctaaaagttcctttgagcattttgtttctgttgcgtgtttatggaaaatatgcaatgggataattggccgtgctgatagttcttgaatgattgatggcctttgtataccatgtccagaaaatcccgtagcagttggctactgttgtcatactaggaagtagatgaattctacacataaacaaatgtagattaatttacttaaaatctgcttctgctttgcagtttacagctcctgggaagtcgggaaactgcagtgcttcaaatggatcaaggagcgctatgatggcccaaacgtccgtttctgtgcaatcggagacggacacgaagaatgcaccgctgcgcagataatgaagtggccatttgtcaagatcgagttccaccctgatgcccctcataggttccctggcctgaaccttccaaccattcatcgcatcatggataccgtttatgattcatcgagcaacgatggttaaccaacatcctgttggtcctcctgtttacctcagtcctccgatgccggcatttgccaattgccgtggagaccttgttaaaggaaattgtaagcagagagatgcgatgggaaggcatattgctgaccctctgcctggagaattaggaggctggtgtgtgataaataaagcgtccgactagttccggcatgtgtttctagaaagattctgtgctgttcgtgttgccattttactctgaccaggcaaatcgttcgtctgttggttgttgtatgtatcccggccattgtggtcgccggcggtgtgcattggcatttcaggtgattttgtacatatgcttcttcttccttagagttggttgatgatgattctcgtctgaacaatgaataggaagtgtagcaagatccttgcgatgcatggggggtgctagcttatgattcttgttgggtacatttcatatgtagaaaatttcacaaattcaataggaacattgtgatatactagtgaagagccttttcactggttgagtaaatttttaacctactgatatatgtatatgaaacatactactagtttttatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtacccttccacaactgtataatctagattaaattttacaaaaactacatgtattttacattatttataacaaaactataaatttaaaagcttgtttttttcgctgggatggtgaagaatgccgcccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcgaggatgcaggcggtgaaggagaaggtgaaggacaaggtgagcgcggtgaaggcgaaggggaaggtgagcaaggccaaggccgacgagaagaaggaggtggcgacggcgaggtcccacgccgagagggagctggcgcacgagcgcgctaaggccagggtcgccgccgccaagatggagctgcaccaggacaaggccctccaccgcgaggaggccatccagcacaggctccataagcatggcgccggaaccaccgccggcgttcgtccgaccgccgcggcgccggcgccgcacctcccacctgctagctactactagtagctagtatgcacgcatgtctctctgtgctgctaattatcgtaacagtttccactaatcaatctacttacaataaataataagccagccagtgtgcatgtaatctgtactgtgtgccagacaagatatcagtgatatatctatcgaggttgttaattagtcggattgtgatctctttagagtactggaggaagttttataatggatattgttgttacgtctaattttagagtaaattttataaaactaccgatactttcatcaaattatcgatcacagcgattcaacgctaagtttcttaaatttctgactaaacgtattatatacgttactggtggaaaaatcatctttggtcggtcggccaaattacacaatagtccattttctaataaaaaccgggactaaaaagcatctttagtcccggttaaaaagttgagaggtattttttgatctttagtcctaaaaagcatctttagtcccggttaaaaagttgagaggtattttttgatctttagtcctggttggtaatatcaattggtcgggcgggactaaaaagcatctttagtcccggttaaaaagttgagaggtattttttgatctttagtcctggttggtaatatcaattggtcgggcggggtcgggcgggcgcggcggaggccggaaggacggggccgggaggccggtggcgccctaccctctacaatcttatgctggattttttttgaatttataattcattggatttgatctgtgatgtatgtgatattggatctgatctatgatgtatttgagttgtgatgtatttcttttaggatttgtgatgtattttttgtttgagattttgtgatgtgatgtattcgttatctgtgatgcatttcttagcaatttgtgatgctactttgatttgtggatgatttggggatatgattgggaatatttaggaagcagatcaatttgagaaaaaaaaagatcaaccgggactgctcccaccatctttagttccggttagtaacaccaaccgggactaaagatgaatttttagtcccggttatttcacccgggaataaagatgagactataagaggtttccaaccgggagtaaagcctctttctccaccagtgtgtgcaagttttatgattaaattatcactaaactttagttttttgagttctataactaaattgtcactaaatttatatttttgtgaaaactttgctattaaatctgtaatgccaccctaaatataaagttttgggatatagatttaatgttaaaactatagttttataatactacttcacattaaatatataaaatatatagttttgtgataataccatagttttagcctcctgaagcttaaggattgcactgcgagtgtatcgacgcaacgacggccagggcagatcagattgtagcctgggtactatgggaatgggaggctggctagagccataggagttttttataactaccaacactatatgtgtcattattcattgaatagagtggaaaagaattacaaggctaacacactgaaaagcagtagtcaggaaagaaaaaaaatcgatcaccacgcacggacaaacacctaaataaaacccaagagaaggctagtaccggaccggacgcatgtaagcgtgatcggccgcctctagactaacaaagatccgaactgcccaaaaacaaaccttatcagccgagcactatactcaattatatccagtattggagggggagagggtgagagaaaaatggaacaccccacacatgccccccccctaacatggccagcttgcattagctagggcgttgtcacgagaggacagacatataaaaagagcacacacaagctatttggaagaattttggcaaggtggcctcctagacgacgtttgtagggagaaaatcgatgatgagcatcgatgccgccgtccatcaaggtcctgaagacagggtttcacttggcaaccctactagagaaagaaggatggctcgacatagcctccaagaagaaaaatgatacccgaaacgtcgttacttgtcgcctgctccttgtcgatccatagctaaatgctccattgctccactaccagccaacctccgtcagtgcatgaacaccattttaccaacgccccatgccagccagcctccacgtggaacatggcacacatgccgtcaccagcctcccctacatgttgacagaaaacacgaggcctgggagatctgcttaactccagtgcaggtccaaaactcgccttcgggtatgctagcgtgccggttgatttgatcctacaatcaacaagaaataactacgtccactgtgttggcttccctgtcattactacgtcggcctcacacgccgtcactcgggccagcctccatgccattgcccgtactgacctctcgctccatcacccactcgtagcaccagcctcccatggtcccatctccaccaaccacgccggtctccgcaaacgccagctacgcctcctcgtgtcgcgctagcctaccgccgccagccgcaggcctccacgctaagccagccttccgccaggagcatgagaggacgccttctgctcccagccgacaccgccagcttccttctatccccgccgccacctccaccacctttctctcgacgtcggcgaccggacatagcccgcttacccggttggcttcgcaatcacctctctgcatggtcgtgcccacaatcgaagccacgccgtcttcacatagctgcaccccgctgcctcattgtcgctgtcagctcgggtgcgcgcaggggatgagtcggtcgcccgcgccgaaaaggctagatcctaacaaaaggaggctggatctcgcagtggacaccggattcaacgacaccaccttgtcatcgtcgcctcggtcgatgctgcctcatcagaccttgccgccagcagccagcccctcgaggcaccggctccggcctagcactgtcacggctatcggtgccttgatcattgtcatcccatatctagtactccgaccccgtgacctcagggaaaaagaaagccctgccgtcattgtccttgtggccacacggttttcgacgacccgctcggacggcggtgaggccaatgatttctattggattgatctaagtaatatatatgtcttacaataacttgtgtgcaaggtaggtgaattgggattcgtacgtacataccacgtacatccccgtttggtacacgtctttacagtagcgatcgaagtccaaaagggagaccgactatccgtccatgtccgcaaagatgttgtgtgtctatatacaagtgctctgccgcgtgcctgccgtataatattcgtggcgatcgacgaggtacgtacgacgatggcgaggaggaaaggcaaggacctaatcagccagctgcccgacgacatcctgctgcacatcctgtcgatggtccgctacaaggaagccgtgcgaaccgccgcggtgtcgcggcggtggaagcacctccacaccaagctccccgccttgtcgttcatcatgtcggtgctcggggcccaggggtcgtccttgtccacgcagagcaggcagcgcgtcgacagcatggcgcgcacgcttcgccggcgctgcgcggggccagaccgcgacaccgtgaagcggctctgtctggcctaccgcaaggacgtgcccatggagtgccggtacgccgacgagttcatcgcgctcgccgccgcctcctcgctggggctgttcctcaactgcccaaagaacctacgcaacgacgacgccgggccgtggtccctgcatctgccggctgccaccgcctgcttgtccatggaatcgtgctggtactcggtgaggccgccccacgaccatggccccggcgccagcgcgctcaagtcgctcaccttcaaggacagcttcatggtgctccacccaggctatctccagaacaccgccttcccgtcgctggagnagctgcacatctcaggctgcaccctctccggcagcatcgagatcacgtccgccaccatgccgcgcctcaagcacctccgcatccacgacgtcagcgtcgtgtcgctcggcacgccgcccgccatcgccgtccctcagccgacgagctgaccacgctgcgcgtgtcctgccacgacgccggcaagcccgacccgccgtccagccacgagatgctctgcgtgaagacgctcttccgcgccagcttcaccgagtactcgtacttccgcctgcgcgcgcccaagctgcgggtcttcgactggcgctgctgctacgccaagaaggtgcgcgtcgacgccgtcggccgccacctctccgacgtcgtcatcgagctgttcgccggcaggctgcctcgctgctacaacgaggccaagaggttcctgcaaatggaggattgcgacaagttgatgaacgacatcctgcaagggatcatgcctggccgctggaagtacgtccaaaggtacatatatactgatcgataattaatctcatattcatatatataatccttcttgcttgtgttttttttatatatcatatcttgcatgccacacgcacatattcacggaatctcttaatattaaattcttaataaatgcctcatagagaaagttcaaccataaatacgtgaattcaaaattatattatagtgtgtatatatcaatcgattttgctatatatttgtcgataaattttctcctaaaatttgacatatgtaattacagtacaattgtagtgtaattacactgtaactatagtgtaacttgtatgtaactttcaaaaatctcttcgtaatatgttatttcggtacaatagaggttgtggaaacaaatccttacacatgtatgtgctgtgattttatttttcttcctcaccaaaacaaatcttgtaatagatctaaagattcaaaattacatcaaacttatatacaagttacactgtagttacatgcaaacttatatacaagttacactgtagttacatgcaagttacagtgtaattacatataagttacagtgtaattacactacgattgtactataactacatctgtcaaatttttagtacaaaatttgtcgacaaatgtataggtggtccccatatcaataggctatctagcgataaccaatcacgcagtacgtggataggctacgtcggtacggggtggtggattggtggtatttttgtttttttcctggctataacctcctagggttttactcccttcatattttaatgtatgacaccgttgacttttcaatcaccgtttgaccattcgttttattcaaaatttctgtgcaaatataaaaatatttatgtcatgcttaaagaacatttgatgacgaataaacttataataaagtaaatgataattacataaattttttttgaataagacgaatggtcaaacgttagataaaaagtcaacaacgtcatacattaaaatatagaggtagtatatcttttttaatctttccatgctatatattcaattaaactttgcactttccaagggccgattcgtaaaataaaagctatctagcaaacttttcgcatgcaaattcctttttgacaatgtgtcttttttaaaaaaagtctatacatgtctaaagcttatataataaaagtttatatatgtcacttcggatttaaatatttttatacagaaagacatatgtaaatgagctaggctaaactcatctgcatgcgcagaccgctcacctattagagcatctccaaatatctatttagccagtttgccaactaaacggtgtcaattttgttttcctgtcggtctctaaatacttcttcttcctccctccaatcttctcctctccaccgttggttgtccacgagtaatacaacgttattctctccgcgtccccgctttctgtgcccaaactacaggtgcagccgactgttccaccgtggcccaagccgtcgtcgccgcccaaatcgccacaaccgccgcagcctaccatataggagggcgagaaacaaggtgagatggggggagcaggatgacagggaggaggaggaggtggggcaatggcaccctaggatggatatgctgacgacgatggcagcgtcagcagggccaggtggcgactgcactgctgcatcggatggggtggtgatggcggcgactgctcgaggtgatgggattcacggaggcattgctattcacttgtgggcatgatggcagcaacgatattgccgccatgcgctatgttattcgacaacgctggaggactccttcactggcaatgataacaggggatgcaagggaggtcggtggcggtgatggcaatgacatctccactcaattccggcaatggggatgggggatgatgctggagatggtggtggtgaagctgggatgaggtggcgcaggagtgcaggaggagactctagcttgccatcctcccacctcattgtcctgtgttcgagtcgacaaccagggtgatgatgggaccttcttcctcgagctggggaagacggtggcaactccgataggcttggatccggagtgatggaggaccttggcatcggtgcggcgaggtggtggcggtaaggtagctcttgtcgttggccctactcagggcagtgttacttgatgttggtgtttggccatccctcctgcatatttggccagtgagaggcttagccattcaaatggcggagagtctattgcagtctattttcttgtcatgtttgctattttttttatagagtgggatgaccaacctgttagagttgctgttagacctccgtgtattatatccgttcatacataaattttccactcattgattaaacgtttttgttggcctttttgcaggaatttcatagaacgtgatgaattgcgcctgcgctgcgagataaccgaagatgacatgtgatcagacgatcagtgatcttaatcagcgctctcttatatgcttgtagaatcgaggttaaatcagttgcatgcatgtaattagcaccatcttaattacaagagaaaatgacaccgttgtcccctaccgtacctccatgcaaaaagaaagtataaaaaaaagagtaatccatccttgtgccgtacggcatgaccaacaccgttaagcaagcgttaacttgggacatatttgaccctaagcacgaagcctgcgcaaatcaagatgggccggggattcaggacgggccggagcgacgtctcggttagaggaaaaagtacatcaatggtccctcaacttgtcatcgagttacaaaatcatcccctaaccgcaaaaccagatatataatatcctcaacttacaataccgtttactttagatctttggtggttttgacccggttttatctgatgtggcagctgagtcaacgtgagacccacgtgagacccatatgtcaggatgccacgtcatcactccccctatctccctttctctccctctcacatttctggtctgggcaggccagccgacagggcgaggcgggagaggatgaggcctggcggccagcgacgtgggagacggggcaacgaggcggtgacgggttgggcgcgacggcgacgggcggagcgatactccattgtcaccgccggcggtagcacgtcggcgcggctccgtcggccagacgctgcaagaactagcgggagtgcgcacgaggatgagccagacgatgaaggtggcggcgccggcgccgaggaggaggaaggggctggttccttttcatataaattcaaacaaaattaaaccaacactttagataattatataaatttatacgctttaaaaaaaagcctcaatgaatatgtacaggatataaactagatgaactggcgcgcctatttgctagttttgatatacgacgggctaattaaatttcagcgaggactattgccttgcttcgttacacacgaaagtacgaaaccgattgtggctttgttctctaccgttgattagacatacacatcacatgcaattgttttaaagccgtactatagacttaaaaaagttcacagtatctgtagaaaaaaaaagatttgcaccttcaagccagtgctgaaatgcaagtttctaagcagtttctgagctagtcatccttggacaacccctttccaacctaaatttgtgtggaattcaggttaattggtccaaaataaatgggaccaagagctagatattgaccaagatgcaataaacaatttaggtgtgaaaccatgaaatgctcaccttggtttctcgtgttcttgctctcgcccatttggacagtgcggattcttgcttctcgaagccaaagaaggacacggagctcctcctcagcagtacaaatctaggagctttcatctgcatatttcatattccagcacaaggcttatcaatggccgcggtgaggttttttggttgttttgggagagatgaccgtgacggtgacgaactcaccagctctgctcgaagaggactgtgcaagggtttagggtctaaattcttgtaatgcatggtaacagtaggtgcaaacatgccactttatctggcacccctggaaccatcactcgccgccaagacaagagggaaaggtggtggtgtcgttggagctcgtcgtcgacggcgaactgctacccaactcccgcgcgatgtcacgagttttttaccccattgacgaagagtgcggcgtgccagcatgtgggaggagagggcctctccggcagctgagagggatagaggagaacaccagttagttggatctgtaccacggcgagttggaagcggatggtggtggataaaaggcccgcagtcgagcccgtcctcgcacgccgcccggcgagccgttgtcgtcgtctcgaccggcgctatgctgagcagttgctgccgccagagaggaaaggaggagctccagccggggaaggagaggaaggtgtaagagagagggcgagcagcggtgccggagacggcgcgagccacatccgctgcccctgctcctcgccgccgaccttgctcggcaaatccggcaccccaccgagcggggtgagagggcgggagagagaaagcggaggcattggggagatgaagagtat

SEQ ID NO: 58478 - DNA, 21804 bp, Oryza sativa
tcgcgccgtcgacactcttcgccgtctgccgccgccgccccgcggtagcgccgccgtacgccattgctgccgggccggcttgagctgcccgtgcgcgccagtcgcgcgctccccgccgccgtccgatctaccctcgggtagatctcggggccatcggttcagctgcccgcgtggctgccacgtggctgccacgtgtgtgccacgtcgcgccacgtcagcgccacgtggtgcactgctccctccccggtccgtggacctggttcatcgtggaccgccacccgagtcactgccatgtggggcccgcatgttgacgccgcccctctctctccccgggattttatttattgcgcaataaatcaattaaggatttttctgtttatagtaaaaacacagtgaatcttctaaaattcatagaaaattcatctgagctccgtttaagcccattcaagtctcagtaaatcaagaaaaatgcatagaatccattaaaaatggttttgttctctgtttcagtagtcttttggcctgtttgtattgtttgctttgtatgtcgcttagattccggctctcccggtgctccggtgtactttgaaatagtcgccgaggttcctccagcagcagagcaatgcaagtcatacttatcacttgaacatgttgatcctatattgcaaatgctctattgttttcccttaaatactgcattgttttataatgttactatgggatgtatatctactgtacaaccatgctatttttgtactatgctcctttgttagcttgggatataacatgactagatattgcactagggattgcttagccatgtttagttcaactagcacacaatgggagaatcacattaatgcatagacttcaggttctagtgttggtgttggattaaagcctccgtcctggtgttagtcaattaaaatgcattaaatggtgggctatgggtgcatggttttgatggtcgcgtccatggcacttaaggaccggttcgcaggatgccctggaagaacttatcgtacttaccacaagccagcgtgggcaacggctgggcttgtagtgtagctttcctctagttgacgcatcgaggcaagggtgggcgtgatggagcggggcgggccctacgacggcctctgtcgcttccggattcacctaggcacgagaggggactgcccgttgcccgctggggacgggggtgaaacctgaggtgtggtgtgcttggctagagggggttatgtgaaaggtcctgtcacagcctctttccggtatgtcgtggtggcatgtcggcgcacggtaacgtgtcatggggctgtgtcttgtgggtacagttgtacacctctgatcagagtaaaactattcaaatagtcgtgcccgcggttatgggtggtcaaccagattcaccgtgattagtctcaccctagtctagtctaatggaattggttagttcaggtgaatggttgggcctgttgcaacgtggtgtagcgttggacagtggatgattaatattgattagttactaccactgttttactgctttgaactactgtttttaaatgctcgctttatgcaaatgaaccgctctacctatcctttggttatatcctgcatcatacccctattccggtatgacttgctgagtatagtgggtagtactcagtcttgctctattttcccccaaaccctagagtttgagtacatgtcagatggtggcttctccgaggagtaggcttcgtccgtgccgtcgaggatgcctatggagtggtgttcccgctgcagtccaagtcaaggcttagctccagttatcttttaatcttccactgcatttatgtaagacttttatgatgtttgtaagacgtggatctgtatgtcaactttgtcgtttgtgtaccccggccggtcctggacgggggttttaatgcgcattctgcttggaattctattcgggaatttctgggcgtgacaggcagggacgccgcgcgccggtcagctgtcggcaggagcgccgccgtaggtgcaatgaggtaggtcgctggatccggctggggccgagaccgtgagtagagatggcttgctgttgattttgcaatgtggtaggctgtatgtatcctgtatggtttgtttgagccttagttttttaatcttgttgtgtacatatcactacagcctataaccttattgagttattgttgtgcacaattgaaaatgttgcgggtgcgggtatgggggaatttctcacccgcgagcgggtgtgggttttttagtgggcagatttagtttcaatgggtgtgggtacggggagtggaaacccgtcgggtccatacccgttgccatctctagtcgggccactcgtggaccatcaggcagcggcgtcgctgaaggaggacgtcgccaaggaggcgtctgatgccgctgctgctgtggccacaacgagcggcgtcaacgttccaaaaaaggggaggaaattctcctccgtgctcgggaatcgtcggaagacacccaccccctcggtaagctctcctgtctgtccattgcgtagtcggaaagcttccatctcacatcatgctcgttatacttcaggcctcagatgcatctcccccgcctccgcgacggcaacggcttgtaacgcttggcgagaagtaagtggatgaatttgaggttttgtcgcttcatcgaactcttgcagtctgtcctgattgtagtctttcacagggcggcgcgggctaaggcggcgcaggacagatctggagggaactccagcgcgtctcccgtggtggcctcgacggatgtcgtggtcatgaccaggagccgtgaggcgacgcccaacggccctgtcggcgatcttgtgcctactcaaggctctcctgctgacatccttacctgggaggagctccaagtcgagatggggcgcatcctccaggccggagctcgcggcataagacatgagattgcggaggcaagggcggcggcggcatcgtcggcgaacgagcgcgccgacaagctggcgcgtgacttggcggaggttcgagaggacctccagaaaatgagggagctggtggccggcaacgagcggcaacggcaggggctcaagaaccgcatgtcagaactcgagaacaatctgtcggagatccgcggttcgctgcgggtcacttacaccggcctacactagctcgccagggagtgtggtgtcacgactaccatcccggcgaatcccgacgagttcttgctgacgacttcgctcgcggaactggcaacggcgatggaggtgatcccctccaagcatgcggccaggatcggggaggagacgtcaagcgggatctacaccgggacgtgcaacgtccttgcgtgtgtgaagttggcgcaccctgaacttgatctccagaagatcttgtatcagggggcggctagcaatgcgcgcaaggatgtgatggaagaaatcggcgacatgggggaatccattctcccactttttgaagagtagggccaccgctcctctgtaccccttaaccaatagcgttttgtaaaacttttgtcggttccgactacctttgtgtatgcaatcatcaccttagttttctttggcgttttgattccgggtactttgtttgttgtttgtagagatgtcgatgtcgaggatgtccagcagcgcgggcagcccaaattgccggtagtcgttccggcacttgagctcgagccgtatgtgccgcgggacggcatagaccaggatctgcccgaggagacggacgtggcgtcgactcctttaggttggttcttgtcgtttctatttcctttaccttgtctgtcttaattagcttgacttaggtgtttgcatgttaagcagacctcgacagtgcgcttgttgatcgcgaccgtcgcatccagtactggaggacgaagttcgaggtcgccgaacctgagaggactatattggaagtgaagagggaccgggctgtggaggcgctccgaggtcgcgaggtatggttcaactcgtacctcaggagttgctgcacaaccatggccattatctgcagagagctccgagtacctcacggggatcccgaggagttagcggctggctacatctcgtggttgaacggggcttgtgctcaccttgaaggcatcagggggcgtatcgacgaggccctgaagcaggagtgtcgtcgatcgagccgatacgccggagggcacgtgctggcgtgtatacgggatcatcgtccgcagttgcacctcgagttccttcacgaagggttttcccgttctcggaggaatcctgcggagatagacaacctagcaaagtcgatggctccgctagcggagaagatcatccagtcaatggattggcgttggccttcctggtagtgcttgcatatctgtgacaaacatcttaggaaaattgtaatatattttggaattctttgcgatctgtaagaaatgcttgtgaaatagaaaggaaatctatctaactaagctttcttactctggatgcggtgtgcacgagtgtcttctcacttcgcgacttcgatcagtcacttgagttatacactctcccgagcccccagccttgtcgtcggagaactcttctcggaagataaggctcttggaccttcgacttgccttagttgaacaagcactgatcctagcccctagccatgaagttggaaaaatccatttccgattacacggcttggttaatacgcacggcgagaactcttacacgaccagatcttacatggtctttcatctctgaaggatccgacaaggccttatcagctctgggcatccccagccgaagttcccttaggttcctcggaggccttgtcaagacggcgtaaagggacatgatgataggtttcaacgctaggtgtcgtatgggtaagggatcatcgggaaggggcactgtgattgaaatctgtgccttaaaacagactttgaagttgtaagatgtcttacaaatatggacactattgacttatacatagaatttacgcaattggtcaatgttccacgaatttgctaactcacgactatcgccgtctgcaatcttgaatgcgcccggccgcaagacttgtgtgatcgtgtacggtccttcccatttgggcgagagtttgtttcgccctgcttggctttgaactcgtcggaggacgtagtcgccgaacgaaagtatgcgtgctcggatgcgtttctcgtgatatcggcgtagggcctgttggtagctagctgctctgagggcaacccgttctcgatgttcttcgagtaggttcacgtcgtcgtttcgctgttcctcctgatcctcgtcggagtacttctgtactcgtgtactctgatgtcgtaacacggtagggagcatggcctccgagccgtacacgaggaagaagggtgtctccttgttggacgttgttggtgtggtgcgcacggcccatagtacagaggggagttcttcgacccacttcttatcatgtgacatgagccagtcgtagacaccagtcttaatcccttgtagtactataccgtttgctctctcgacctatccgttactctgagggtgagaaaccgaagcgaagcatatcttgactcccagtccgatgcagtagtcttggaaatcggcgctgatgaattgggagccgttatccattatgatgcggtgaggcaatccatatcggcaaaatatccccttaataaatttgatggcgttgtcggccttgatttcccccgtgggtgttgcctgtgttgcctcgatccatttggtgaatttgtcgatcgccacgaacaggaatttgtagccgtcctatcctcgtgggaatggaccgagtatgtcgagcccccagcacgagaacggccaagtgagagggatggtttgtagtgcttgcgctggtagctttgtgtgtttgctatgaaattgacaagcttcacaccgttgtaccatgtcgcaagcgtctttgagggtggttcgctagaaaaatccttgtcgaaaagcttttccgactagtgtacgaccggaggcatgtgaccctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtccaaaaaatcctccatctaagtgggcaaggtcctccttttatatcttaaggggataccacatgcaccatttccctcttttttgtggggacttcccccaccttttcatacgagccactcggtccgcgagctgaaaaagctccgcggtagtctggggctctttggaggcgatcttttcgagcatgcggttgtgccgcacaccccccctgaacgcgtaaatcaccgcgtgtgtagggatgcatggtatggtgttgcggacttgacagaaccgctgaatgtacgagcgaagtgactcatcatcccttcgctgtactgcgtgcaagtccgcttcctcacctgggcgcggatatgtgccttgaaatttcatggtgaactgttggcacaaatcctcccaagagtggacagatgcgggtggcaagttcattagccagccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcctgcgtccgtgttgaggtgacactctggacgaggaagcgccctccgttgcgtgggtagcacgtcggccattacgccgccgctcgatgctagtgcgggcgtccggccccccacgcagatcttcccgggtcgaaggagtcgacgaaggagtggtggccgaatggcgaacggcagctgccgctcgccgcgcccttcgtctcgacgacgcggagccggtggtagcagcaccagaggccttggtggcggaggaccgcccaccagcatctaggcgctgccttgcagtcatgaccaatttggccacatcgtccagccaacgttgggctggagactccgggtcatgggcgacaggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaggagtgcgagagctcagaagatcactcgcagagccccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtccaaaaaaatctccctcatctaagtgggcaaggtcctccttttatatcttaaggggataccacatgcaccatttccctcttttttgtggggacttcccccaccttttcataaatggacggagatttgtatcgttgccgtccgagtcaccttctgatgggacggcccacaactacctccactttcaccgggagcagatgcgacgtggaatcgtggccgcctgctgacgacatgaccggagtcagaccagtcacgtcggtcattcttgtccaccacatgtcagcttagcaatctacatgttcgcccttcttcacacaacatcttgcttgtaatggttaggatgaagcctggcatatatctgatcaggactaacgtgccatctctgggaggtaacacgctagctccagctggggacgagcgcctagaagccctcgtcctgacgggatggggtgaggcgtgcgtcagaccgcctgtcgccacctaacccgcgatctgaccggtctgtgactggtcacagaccgaataaatgagtgcactgcactgcgttacatgcggcgtgacacgctcacccaaaccgcaataaatgtggttaggtgagcccggctgtgcttacctaacccatacacgctgagcgaaaacccacgaggggtcggggcgcctcggccctcggggccgaggcgggtgcggcccgaccccctcggggggactaagaggagggcgaacacatcaccctcgggcccgacgtcccccgagggtgccaggccacgtgggcgtttgtgtctgcctcaaacctctagtcatgatactcctgatcccatgtcaccgacagacccgcagaccccttcgtgtatgtcgaggaggaggtgtttgtcgtcgtcggacgagacacatttaagaagtacctcgtttggcgccttcttgtatagatcgttgccgatcatatagtagatttttgcttgacgagttattttctcggcttctgcgtcgtcctcgggcaactcgtcactgcttatgaatttgatgagtggggtccgccagtcatccatggtctcgatgtcggcaacggcgcgctctgcctctgtagcccccgagcttatgtcgggggtgactgggctatcttcgtcgtttgcctctttcactgatggttttgtcaggatgtccagaaaggtgccgggttcgagtggctctcgtctggacgcacgccgtgctacatcgtctgattcgatgttgtccttgcgatatacgtgtcggacctcgatcccatcaaatcttttttccagcttcctgacttctgcgagatacttggacagctcagggctagagcatttgtaatctttgtgcacctggtttgcgactagttcggaatcccctttcacgatcagtcgcttgactccaagtgcagctgcagctctcatcccagcgagtagtccttcgtacttggctgtgttgttggtcaccctgaagttaaggtgaattgcatgcttgaaatgatctcccgaaggtgatgtcaagatgaaccctgcacctgctccttggctgttgagcgcgccatcgaacgccattgtccatgtttcgttgtcggtctggctgtctaacctgttttcaggcatagtccaatcggctacgaaatcggcgagaacctgggacttgatggttgttcgtggtacaaagtggacgtcaaactggcttagctcgactacccatttcgcaatgcggccgacaacgtctttgtttctcacgacttcaccaagggggaaggcggagacaactgtgaccctgtgggcttgtaagtagtggcgtagctttcttgacatcatgattactgcgtagagcagtttttggatctgtgggtaccttgtctttgcgtcgtgtagggcctcactgacataatagactggtctctgcaccttttccctttcgacaacaatgacagtactcacagagtagggcgtggcggcaatatagaggaacaactcttcattaggttggggagcaacaagtacagggggatttgacaagtagcgtttgagtgcgatgaacgcctcttcggcttcctgtgtccatacaaatttgtcttgcttttttagcagtgcgaagaagggttgtcctcgttctcccatcctagcgacgaacctacttagcgccgccatgcatccggttagcttctgtacttccttgagtcttgtgggcgacttcatgttctcgattgccttgatcttctcgggatttgcttctattcctctgccagaaacgaggaatccgagcagtttgcccgacggtaccccgaacgtgcacttctcagggttgagcatgaggcgatatcgtctgaggttgtcgaaagtttcccgtagatcgtcaatcaacaagtcgcctgtcttggttttgacaacgatgtcgtcgacgtaggcctcaacattgttacccagctgatcgctaagtgccccttggaccgtatgctggaaagtgttccctgcggttatgagtccaaacggcattttaacgtaacagaatacaccgaatggtgtgatgaatgatgtcttctcctcgtcctcttttgccatgctgatttggtggtagccggagtaagcatcaaggaagcttaacagctcgcaaccagctgttgagtccactagttggtctattcgagggagagagaagtgatccttggggcactacttgtttaggtcggtgaagtcgacgcacattcctcacttcccgttagacttccgcaccatgattgggttggctagccactctggatggagtacctctctgatgaaaccagccttaagaagtctatcgagctcttctcgtatggcctgtttccgatctggtgcaaatctccgcagtttttgctttactggcttggcatcgggtcgcaccatgagtttgtgctcaatcacctccctggggacccccggcatgtcggacggataccaagcgaatacgtccgcattgtcgcggaggaaggtgatgagcgcgagttcctatttctcattcagtgatgccccaatcttgaccgtcttgtcggggttggcactgcagagtgggacgattttgattgcgccgtctggtttcggcgtcttagtcgttttgatcactttcttgggtggctcggctgtggcgggtgggctgggagtgtgctcgaccatgtcaaggctccgcttgttgcattggaccgccagctttgcgttcccttggatagtgattgttcccttcgggccgggcatcttgagcacctgatacgcgtagtgagatgcggccatgaacttcgcgagtgccgttcttccgatgatggtgttgtatgctgtgtcgatctcagcaacatcaaatattatctgctccgttcggaagttgctcgcttggccgaaagtcaccggaagtgtgatcttgcccaatggcttggacgaagattgaggggtgattccatggaagtgttgatcggtaggtgtcaactcgcttcgtgggattcccattgcgtccaaagtgctagcgaagagaagattgatggagctgccgccatcgacgaggactcgcgctaccttgatattccgaatagtgggttcgaccacgatcggatatcgtcctggtataacagcagccttggggtagtcttcatctaagaactcgatcttctgttcagaccacttcattttgggtgcagccccctgccatgtcgaacaaacctcacgctccacttttttgtattctcgctttgaagagtacgctgtgggacctccgaagatgtgcgagacatgaagatcggaatctgggtacgcggagtctgagtcctgagtggttgcctcagttgccttctcgactacacgtactcgcttgcctttctccaatgccagctgcctttccaacgattttttgaagatgaggcactcctccagagaatgtctgtccgacttgtgtatggggcaccatattctctttgtatcactgccttgtgggtctgggtgtttgggcgggcgctcgtattcagatgcaaggacttctgcttgagctttcctattcccactcttgtcgcttttcttcttgcttgattcgggtgcgtccttggctggcttcttctctcctcccacctttggtttgtcgtttttgcgtctcagcgcgtcgtctgcatgggcacatcgatcgacaacctcgaacaaccttcgagtagtagtgattcgccttgttgccaaatcctgggtagtatagcaatctctgacaccggttttgaaagcgcggatcacagaggcatcagtgatattggggatcgtatttctgcactcattaaagcgccggacatagtccctcaaagattcaccctgattctgtgttaacgcgtgtaaatcgttttcgatcgcgtggcgcttgtaagttccctggaagttcgcgatgaattgttgccataaatctgcccatgaagagatcgagtaaggtgggaggtgcatcagccatgaacgcgcagaacctttcaacgttgttggcaaatagtgcgctaatgcgttgtcgtctgccccagcagcgtatagtaccgtggagtagacctggaggaatttttcagggtcagtacttccatcgtacttctctattgcttcgggtcggaatctctcgggccatcggacatcacgtagagaacggttgaaagctctacacccagcgctgggggcagtgggttgtcggcgatcatgtgtcctccatggacgtctatcggatgacgaagacaaagattatgatgatgatgatgatgacgatggctcactcggctctggcgtgcgattccgagggcgacgttcaggttctcaagaattctgtcgccgtccaccattgttgtcctggcgccggtcaccattatcatcaccttaatgctgacgcccccgaccgtcatcgtctggtgtccgctgcttgcggttatcgcgatcgcggcggttgtgacgatcacggtgatgttggtcctcgttcgagcggcctcctcgctcctcgttctcgtgacgtcgtgaagaaacacgatgtcgggaacgattctcgttgtctcgcgcgcgtcgtgcttctcggcggccattcagatggtcgcggagatcgccggtgccgcgaggtggaggggtagctcgtgcgggcgacgtccgctgctccggtggttcactgtcggcaccgccagctgtcggtcgttccggttgtgctctggtagcagctttctcgaacgcgttactgagattggctacagattcccatagtcgttccgtccatcgtgcgagatcatcattaagcacaggtcatagggagcttctctcagtattgcgttgacggtgccgagatgttgggctggcgtggccgtctgattctccgcctctgcgttagcctgtgcagacgtgctagtcccaccaatggcaaacatgtcacgtggtgtactggaagatgacgagccatagtcttcgagcaagtgtaggactgatggttcacggggattgatgtcgattactccaatgaatcgatctgaggttatcgtcgctccttgttccttgtttgtatcctcgagagaggttcctgactgctggaccttaggaggtgtcgtcttcatggcgcggaaaaagaccttgcagcttgagaagtcgtgattcttcgtcttgtgaataggacaatagacatcacgagttggagaagtacgctggattccacgctctttgcaagcacggatttcagcttgtacattgagaaaaacccagcaagcttgcaagttgtgcttcctggacttgtggatatgacaccaggacttggtgacctcggaagttgtcctcctcggctcgcagtccttgtcaaaaggacaaggctcggccgcactaggaatcttctcgagctcgtatgacgtcgatgttccgttctccgccacggtgggaggatccttcgacatgggaccgtccgggtttataaccacggcgttctcgtttccggttattgatggactagccgagattggcaccgtggtgtaaaccaggaagacgatttcgccgacttgagtccacaccagcattgttgaagcagggattccttggatggggccggtgtcgactctgttgtcgacgaagctcgatgtcatagtagtagaaccttgagcaccaagtgctcctacctggcgtgccactgtcgacggtgggtacccgtagaccggatatagagggtattgggtacgctggtacgaggatctacgtagtatgacatcaaggaaataagagacaaagattatactggttcaggccccttaacaggtaatagccctaatcaagttgatatgggattatatggaaataaccacatattacaaagggaataatagaactcggtggtaccgacgatatcgtagtcgagttgattcgactagatcacccggcgacttggctcctgtagtcttcagcttcgtaggctgtggtcgttgtgtaggttatgagattcgatcccttaggtccctcgggtgtcccttttatatcgcaggtcaggcggtctccaagtaggacttggagacatcggaccctacacgatataataacgacacagtcttatacgggtaggaatctttccattggcggacttcgtgatggatttccttagcgtgttcagagaacgtccgtatatgcaccgctataccgtatttccatatagcatacatcaaagggtagagggtataccttatccgtaaccctaacaattttgtccacatagctcctctaaatactccctccttccctaaatgtttgacgccgttgacttttttaaacatgtttgaccgttcgtcttattcaaaaacttttgtgaaatgtgtaaaactatatgtagacgtaaaagtatacttaataataaatcaaatgataggaaaagaattaataattacttcaattttttgaataagatgaacggtcaaatattttttaaaaaatcaacggcgtcaaatattttgggatggagggagtatttgttttgtcttgaaattatccttggaccctcttaatatgccatatggctatttctagtcaatatttctattaaaaaaatatcttttttgcccttaatttgtatacaactatatactagaaaagagaaagtcaacatgaataaacaacattacaacattacatatgtacttcccattgtttcaacatgtgcacatgaaacttaagcaattgctatcgtatacacttgctggtacataatttattttggttttacataatatactatgtattatctataaaaaattcaagcatgcaatttttctcttatatatgtgaatgataaggggtataagtgtcatttatgaagagagttgttggttcaaggataagtttgaaataaaataaaaacttgaaggactaatatggatagattgaaacatcaaggactaaactgagccttaggtgaaacttggaggatcactttagctattcaccctttaaaaaacttaaatcaacatggagaagaacaatggcacaacacaggaaatctgaagtagtaccattttccttcaaattcaaacatatttagaatttcggggaaatcatcgcgtttgaatttgggtggtggaacgatcgagcgaacatgtgggccgtgggctctaccatcagggcccatcaccaatggcgaaagcccagcccactcggctaaaccccaacacgcacacttcgcttccttctcccccattccccttcctcatctccgcctcgcctccaccggccgtgatctcgccgccggcgccgccccgccgcccctgaggcctactagtagcgacctacaagtaccctgttttgtaccatcctaggagcgaatcctccccctgcggcagcggtagcagatcgcgatggccgcctcggcgcctcctccggccgagccgccgccgccgccggcggcggcggcggcggcggcgacgaatccaccggcttcgaccgcgcccacggtctgtatcgatccctcgtgcgtattcgtctggcgcccgagttctgacgtggttgggtgtgggcgatgatgcaggaggacggggaggtggaggagggtgccacgccaccgagaacttctgcgttggggacggcgaactggggtaccgccaccctcgtcggcgtcttcgccgggctgctctacggcgggagcaaggaggccagcgcctctgtcgtaagttgctactctactctatccgcctcctgctttctatcattggctctgtatgataaattgcgtgaaattaaaaacaatttgaacaaatgaatggccaccagatggaagatatgtggttgcatcgactgataactattttattggtcttttgatcacagctcacagatcatttagacctgaaattgtagagctagagcagaattgagaaatttcctttttatcgaaacaagctaccaatctatataaccaagtgggtactaaccattaaggtctcctttagaactgggattctagaattttgattaagataattaaccatgtccctattttgaggtgaacatttatatccttttttcctgaactccttacaccaaataaaatgaaatgtcttcagttacaacattattgtgctgtattttacagagcaaagacgctgaagtgatgttgaagatggggagcaccacagacaagcgtgagcagtatagattgatgagagatgcaatggagaaaagattcatccgggttgccaaaggatcgctagttggtggtgttcgccttgggatgtttactgcaactttctttggcatacagaaccttcttattgagaaacgtggggtgcatgatgtatttaatatagctggagctggctcggctactgcagctgcatttggacttatatgtatgtatctcttcatgtccagtttatacttttgtttagatggtggaaattttggtcacctcaaataatttgaagtgagcttatgaaatatgtttgtgatactgtgaagcctgaattgcattcaaatattcaattactgattgtaatagaataagaatagccccagtcatgttttgaaagaaaaatgacatatttttgaagaaaacgaggttatcatgtacccgtaatatgtatgtaattcagtatagacaatcttgtgtcgtaagtactattattttggggaaagtcgtctgttgtagtcatctaccagaggttctgaaggttagtaggttatattacttgtcttcctctataaggtttgcttcctttataggccttctaccgctgtgagcttctaggtcctagccatatgatacctgaaaatctgattggtggaatagacttgctaagatatatagccctacttggatttttctgtcaccatgatgtgctcgattttttcccctgtaccttgaaggatgtagattaatgtaagaagctcttaaaataggttccttgaatatctaataaatcctgttatctttgactttggttttcaatctgtgtgctcagaaattattactacctgtcagggttaattgtgatctcattgccacatgatatgatgagataaatcattgttttatgatattgtttgtattttagttctgattctgctgtgcaaatagttggttaacttcattaactaaggtagccctcagcatccttagtttatcttaactgatgatcgttcatcttcagtgccaggttcaccaatgtggcgtgcaaggaatgtattggttggatcagctcttggtgctggagtctgctttccccttggtattactctactttctattcaccaatgaaaaatggtcattttagttcactcgaacatgcacatcacttgattgaatatggtcctgataagctgaataactgatatttagtgtgttccctggtagtactagattgaatcatgtgaactcaatctatgctttaacaactttgagagtacatttaattgcaggactcttggacatagttgcatttcatgttgggcaggatgcatttccaaattggtagttcttcagcttatattgcctactgatggattaccatcgcttagccctgttcatcttcagcgcaagggtgctcgatctttctataaacttatgaacagtctcaatgaggtttgattgggatttgggacttgggaatcatttgccaagccatttgcatataagaagtgcatttagcatttgcatataagagctactactagcacactgtcatcaattgccaagccaacaactttatgcttacacgatgaccgtgctgtgctgacacattctaggatgctggtagcttgattttttgttcaataagtcagccttaaggaattcttttacaggttggatacagttgaagctggcagagaaagccaatcttgagatggcaagttcgaaaccaacagatttggtggaggaacaaggtaatcaaagcggcgttggtgccgctatagaacgacttgggcgcagcctaaagaagtaaaaatttggaccatcgaaggaccttttttttttctcataatctgtgtgcgttcctgaagaccgcaggaggaacctgtttcatgggctgcactacttcaattttttcttctttcatgtgcctcacgctgtagtgctgtcaaactttgaagcagtaacagcaagggccacacggagcctccgttgtgggggaaaaaagagcatttttgataaaaatatcgtattcgttggatgtgatgatgcttgtgccattacagtttgtgctgaatttaccctcggtaattcttcagttcacgaatactattttgtacgatgtattccttctcatatgatagatcagccaattctcatgatagaaatatgatagagcataatttaaccacagaaatatgatcgatcagctaattttcatatagtcagaataaaaggagcaacaaaattatttaagtttaaaattccaatcaacaagtttacaacaccagttttatcaggaacatgattcttgtatttgctgttccagaaaccatcttataggttcctacttcgttgcggacttttgtcgtccatctggaatagcgaaaaggacaattggtttggaagaccggataaatggagcatcacacctgtaataccctttcctttcaagctgtatgatttctccttgtttgagattccgcatgtttgcgtctccaagagccggaaactcttggcaagtgcatggattaagattgtcaaggaaattatcatcttcttccagctgcaaaaatgccacagcaatatttaaaatactagcagatgatgctactcaatcatggaaggaaaacatcgatggattcatggaagcgaaaactcagagacatcatccaatatgtaaagaaattaataaagaaactaaatctcttctagatcgtgctccaagaacaagtatattgaccattccttcacaagcctagcttttctgatactgtgatacactagtattgggtttcatacactatctattgaagaagtctaaggtgaacatagtcaaacttaacagactaagggcctcctctgggattttgaaacataggaaagtctcaaaactatcgtttgattagcatacaggaaaaacgcaagaaacttagacacatgaagagaaaaacatgaggtgaaacctcatgcttattttccttcaaaattactctaggaaggtccatttcataggaatttcaaaggaattgataggaaacaatcctttgtttcaaaaggactagataggattattttccatatgataaaatcctctaaaattcctatggtttttcctttgattcaaagagggcctaattaggtattaatactacaaaattatagcaaaagcagtagagtaccaattgttcagtactataagaactctgtttctcatgtggtattgcatctgtacgatactagcctactacttaataaaggaacttcaatttaacgtgttacctttttctttttgattaggtagtcaaactctaccaacgagagagatacaagatcttcaatatctggcagccacgttagctttaactttgtcatcttaactgacccctcaagatggagttccccaagcagttcagttataattccattctgtgtcttgatttctttgatgatagcatttccccagtccatcagagtaacttcctcaccgatgctaataactgatgcatcagcactctccaaccaaattttgtttgtgaaggttgtagccttctttccagcaccttcgtatttcttgtgcctgggtaagactcggatgaatggttcctctggaccattagtaagagtgaaaagcacacgctggtctttcagaacggcagtatgccttccacacactggatcaattatcttcttgttgattgtccagagtttatcccactccataagatttagatttttagaggcacccttgagaaataaaaggtcaaagaacaaatgaattacgaagacaccattaaatatagctatgaaatcacaaacggtaactcattagaacattacctgctcaagtataaattgtaccaaagcttcaaccttcaagccacgacgtactatgccttgtacagtggggaagcgtggatcagtccagtcctccacctttttgttttgtacaaaccagagaagcttgcgtttgctaagaaccgtgtaaaccatattcaacctgctgaactcatagatttctaccctccttaaccccatttcttgaaggatacgatagtactgtgcattccgatcatggtattcacttgagcggagagcatgagtcactccttccaatgcgtcgacaaatggacaagcaaagtcataagttggatagaccttgtattttgagccaatacgatgatggggatcagtgttgcaacggtagtatacaggatctcgaagtgatttgttagggtcctgcatgtcaagtttaccccgtacacaacactgcatacccctttcagttccattgatcatctctttccacaatgacaaattatcctgaacagtattatttctacatttagattccacaccatccattctctcactcctcatttgctcctttggtgtatcatcaacataagccttcccttgcttaatcaaattttcagccatttccattaactgcggaaaataatctgatgtgtaagtaactatatcatattttattcccagtgtttctacatccttcaggacgttctcaacaaattcattgctttctttcgaagggtttgtgtcatcaaatcgaactatcaggcgccctttatatctctcagcaaagtacttgttcaaaagtccagcctttgcatgaccaatgtgaagatacccactaggctcgggggcaaagcgaacgcagacctccccaacttttgcacctgggagatctacttcagggattgagatattctgctttgaatcaggtaatttctctttcaggcttggtgcaggagactttcctatccccctttttccaacataagcagagacaacttcatctagtgtgtctgaatagtctgctatgctgttgaaccagcgaacaaggttttgatatttcttggacctccttagactttcccatcgttggcctgtccctaaataaaggggtgccactccaaagtaagtaatataaacatatagaatgataaaatatagattataaaagaaaccagacaattacctgcaagatttgaccatactacaatgtcagcaattgacaagccataactaaccaaaaaggttcgtgatgctaggtatccatctagaaatgagcaagcagcttcaaattcagatcctgaaagaatgactggggcgtagtcgagccattgatcaacctaaacatgcataataacaggaactatgaatactcagacaatcaataaattcactgagtagcaccagcgatagcaaatagtcaaccagaacatacatatgctgcctgaatagcatcctgaccatagaaactggt

SEQ ID NO: 58479 - DNA, 10365 bp, Oryza sativa
taggtgtctgttactaaaagatgcttctaatctcgtgattgttttgattttgttactagtctacctgtaaatttgtgtaggagtatttaatttgaagagaggatgacagttatagtctatgttaagcttttttttttcttttcgacaaacagtactaatcgacgaaatcaccacaggcgtctcgttatcgaggggtacgtcgtctaccactgaaagaataattagccgtaaatgcgagcactcatatcaaatctaggatttgaacccaggtgagctagttacagtttaagaaccaaactagttagcctacgctcacttcgcagtcttttgttaagccttggtgcatgaaaaaataaatgaagtgtaaaagatttgcacaacttttgcaccaagacaaggctgtgttctatcgttgaagatagaggtttagttttcgtggcacgtgaaacgagataggtcgtttagcttacggttaatcgagtattattaattattataaacatttatttgatttttgtaagaaatatttctatgtatattatctattattttattaaaggaatagaaaaaggagcctccacgttcgctctcatggtctaaaaattcccacattaatcggagaaaaagaaaaggcagagtccatataggaatacaatttagaaatagctgaaattcggaattaaaaaagaaggaatattagaagacgagactagagtccatatagaaatacaatttagaaatagatgaaattcggaattaaaaaataaggaatattagaagaggagactagagtccatatagaaatacaattaagaaatagatgaaattcggaattaaaaataaggaatattagaagtagagtatagagtccatatagaaatacaattaagaaaaaaaatagaaattcggaattaaaaaataaagaatattagaagtagagtatagagtccatatagaaataaaattaagaaaaaaaatagaaattcggaatttaaaaataaagaatattagaagtagagtttagagtctatataggaatttaaaactaactaaaatttgaaataaacataataaaattaaaagtagagtttagagtccgtataaatatacaatttataaataaataaaatttgaaaataagaaaaacatgggaagaaagtttaaagtcaatataggaatacaatttagaagtaactgaaattcgaaattaaaaattaaagaatattgaaagatgagtttagagtccacatatagaaatacaattagaaataataaaaattcagaaataaacataaataatattggaagaagagcatagagtctataaagaaatacaatttacagaaaattcggaattaaaaaaagaaatattaaaagacgagtctagagtccatataggaatatatgatattaaaaataattaataactaaatacatatataaaatgcaatatgaatatgacacattagtagtgttgtaaagttatttcaaaatttaaaattatgtttaaatataaaattttaatatatttgaataatataatgagaaaacatatatgctattatatgagagaaaatataatgatgttagctgcgcaatctgcgcgggctaccatgctagtttttgtaaatgacacaaatttgaagctgaatgttaaaacgggtcctaatgcacgaaacacatcaaaattccccgtttgatgtggaaattctcgtcaacattggatgtgtaaaaactgtttcttaatttctagacatgattcaccactgtttttttgagggtttattcggtttggaggaatttaaatccataggaataagaaaagtgaaggaataggaatgtttgcacacattaatccatatgaatttttcctatgagatttgagcgaatggaaaaattattatgtttcctctatacaacttgtaggaaaagaaattttcctttggttttcatgtacttcaatcctataaccagaatgacactcatagcaattagtccttaggactccaaatcctttgtttttcctccaaaacgaacatgcacttagaaacataggacaaatgcgagcaagctcatctctataacgcacacacagacaccttatgtctatgagtataaacaaaaggctaggttggcatatcttgaaattgatgaaagtcaccatagacatctcgttatcgataagtacgtcgtctatcattgaaagtcagcctcgttatcactatcattgaaagaatacaacatgtattggtattgacgaagtcaatcgatgggtacgttatctatcactaaaaacaattagccgtaaatttgagcccatgtcaagtcttaacttgaactcgagtaagcacacgttcctttacaaataatttaaccagttgaattatactcaattcgcgagctttgtgatttgattttgagcaattctacggtccttgaggaggtaccatgaggtaccaaaaatttaatgtaaaatttggtacctcatagtacctaggtactaagaggtaccaaatttacaatagaaaaaattgtacctcatggtacctccttaaagaccgtaaaattgttttttgattttccttctatttaatgtacaatgtttccctttggaaggagggttatgatttctatattatgttctcggtacaaaaggagtcctagagaaccttcagcgagtctcaactctcaaaagagagatcaatggagtaatccagcagctgttcgtggctaagctttgggatgttttaagtttgcaagtttaactttcaataccctttttgagactaaatgtttaactggccaactatttgtttcaaaacattttcaaaatgcatagacaactttttttttcttgacaagtttagtggtagttcctactcattttcatgagagagacagatccaaaaccgtagttaattctcacatttaactctataaaccatgcgatttgtggcacgtgtgtttgccgcgttggagtgagctgtagaagcagcagcagtgcctgtgaccagggcccactacgcagctcccccaaaaggtagctagctagccttgccaaagctaagctggccccacatgtcatcctctaccagaccacagttttgtcaacaccttaccaccggcaagcttgccattattaatcaatttccgtttgattttgcttgattgcttggttagaaggggatggctttgtttccttgtgtgctgtcccgtgtaaattcaactgtcacgggcaatgggagagttcttggccttttaggttgttagccgatgagagcgacatattatggttgttgagactagaaaatgtgaccactctagtctgaagtgacaatcacactagctttgttttcatctcgagtgtctacttgtattcagatgtgaagttgctgaaatgctattcataatttcaccaaaaaaaacttgaccacggtttgtttcattacatttccattgaagaagttttccttacggacggttttgcccggtaagtgggcggtcactgaggaaaaacgaattttactatttttttttaacatggtcgatatattgggcctttccattatcgcactgacagtaagcctggttaccgtggtaactgataaacaccggtcctaacatgtaaaagaaatttcttttaatagagcataaagatttttatttcaagggaataaaagttagttatttaggtaagtagcaggtcatctctgaaacgtctattgtcattttgtctcatgcctatacattatctccaatcctggtcactgcacaccgaaaaaaaaaacattgtagcatggcttaacaaggagaaaaagacatctatctgattctattctcttccttttccatcaagggggatgctagagattttgatgtgtggaagatgacagtagaatagggtgttgcatctttctcaagcagcagtgaagattctcttggcatggcctgcacaaatggggagtagaatagagtgataatccacatctgtctctccctttccagatccctgcagcccagttgctccaatgtactgctgtcccatttgcagaagttgagagagcaccaaagggcattatgcaagggggtagtggttggcatcacactacttcacacctgtgaaatcaatcattgttagttagtaatatatataatagtacatcagatattcagatgtgcactgataatattttactccctctgtctcacacagacttcatttctagcgtttaaaacttgtctcacaaaaaacttcatttctagatgttacaaccaatcaggctaagacatacacatttaaatacagtcaagaatattaatgagatgtatcatagtagtaatttctccatactaatttgtctgagaattgctagaaatgaagtttatatgtgatagagggagttgtacttttttttttggtgtgtgtctgggtgtaactgtgtgcatcagtgcatgagactttcaagtacttggtggattactttatcagattgtttagtttagtaatcttagtgacagccataattaaagatgcagagacaagctattgtaatgggagactggatagaacctaaccctttgacttgggacatcttctttaaaggcaggcctgcagaaacagcagagtgtgttttcttgtaaaaaaatcggtgcgcatgaagaaagaaaatggaaacggagaatttgccgttagctcaacagagtgtctagattcagaggccggcagatgacccagagttgaattgacgcattagattaatgaacaatcacatctttcttatcctatgattagtttaagttaacttggagattgatccagagttgaattgacgtatgaatatggagattttacgaaatgaaaatgtatcaataggcatcagaagttctcaaaattatgcccttcttttaacgaagcatatgccagttttcaaagttctgaaaaactggcatatgatacataacagtttggaagatggaaaatgacgctgtgttctgcagaacttcctctgaatttcatgaattccaaaggtaagaatcctgcagtttctgcaattttcagttagatctctggccaatgggcctggttgatcggcctgattgtgagtttgttatgctacttgatctcatgcttgctccctctactagttcagtccatgaggtgccaggcctaaattgggcacttccttactgctacatgttaggagtatttgggctttttctttctttctttttttgaaaccgagacagcaaatacggctgaagggaagtgtatttgggttttatcatccccaaagtataatgggctgatgaactactgaacgtatcagaaattcagtagactgcatggactcgattgagcgattcagaagtctgaattccaaaaagttcatcagtccatgcgactacttatatatggagagagtatatccagcaaaaagcccaaaatgtcgtcaaaggacaatggaattgcgaattctgctagctcacctttaataagtctttaactgaactgaatgattgctgcctgttcacatgagctgctgctgaactgcagcacagctagttaattggctgatgaggtaataaggtttcagctctcaggtcgtcagccttccatctcatccaagattcagcaaactttgctactctgaatgcatttacacatatcatctacagcaaactttgctaatgtaacgattgtgccatgaaaaccgagtgaactgacagttgatctgaatgttcagacgagcataaaaaaaattttgccatgagattgttatttagattccaaaaaaatttggccaaaaaggtcacatcaaatgtttggacacatgcatagaacattaaatgtagacgaaaaaaatcaattgcacagtttgcatgtaaaattgcgagatgaatcttttgagcctaattatatcatgatttaacaatatgatgctacagtaaacatttgctaatgacggattaattaggcttaataaattcatctcgcagtttatagacggaatctgtaatttgttttgttattagtctacgtttaatactttaaatatatgttcgtatactttaaaatttttacacgtaaacaataaaacacggcctacgttctgcgtttcgttcttgcagagcttgtcgttgttctcactacggctaataacccgtgcaacaatgaagaagcgaccaaaaataatttacgagtaaaacttctatatctatattatcagcgatttaaaagcaaattctgaaaaataaattacaataaagaaccccttaaaatcaactctaaaaataagttttgaaattcaaattttggtaaaccaacaagaaaatgaaattcctacaaaattcccgcactccaaacgctcttccatcatccgtaacctcaagggtgtgtttggataatggaaaatggaggttgggattgggattgggaaatgaatgaagggttaggattaaatgaaagaggaagaatgaatggttaggatttaaagatgtcttttgatgggtggaaaatgatttccccatcccattagccaaacgctgcccaaagttatcaaccagagaatggaaaaaacccaaaacatctcacgtagtaatgcaccatagtccatactgcatagtatgctgcagaatttcatatgagggcgttcactgaaggcagccagcctgtgccacggttgctctgtcggctagccgtcagccctggtccagcatcctcctcctcctgctgctgcctcctgcacgcttgctggggctatctatctaccgtcaaaatcatgccctgctccagtcaaattgctgcgtcggcagcatgccagcatccatgtgatgctgtgcacaaggatggataaaaaggtgccaccatggcgcactcaagagtacagagaaaagcgacgcggtaaatatgaaaagatgaacaacactgaatctgcttgcaggttacaatttcaggtcttggatcgaattggacccccacagatttcttcagggcctgcatgtgctgcaattatatctctgtgccagggacaaatgagtgcagatgtagtgataaatgtgtgtggtttgcaaaagtgttaatgggtgattatgatgttgcgaggtcttgcctttgtttggagtgtttaactgaacctgcaggttcgttcttgtttgactgcctgtcgttctccactgaacaaagctgatgctgtcttttttttttaacagtttttcagacgatcaaacagagttacactaccaaaaagaattggagtaaccagagttgatcctggtgaacaaatgcaaatgcacgaacgaatcgaatcaagaagcaatctctacccaccctaaaagaacccaaaatgaggtaaaaagaaaaatgaaaagaaagcgacaatggcaggcacaatcaagcggcacactgacaaattcatatcaacagagaaaacaggttacgatcctgaaccctgatcctaaacaatcccacacgacggagtcacctccttgcagaagaaaaacgtcgccactctacggcgagatcatgactgctccggcgaggagcagcattgctgctgccgccacccggctcccaaagacggcggccgccgccgccgacgtccccatcttgtggtgaggggtctgctgcctgaaacaaaccaaccaacacatgagaaatttgatactacctcatattatatgtcattttaattttttttctttaatcaaactattttatatttggtaaaatttacagaaaaatttaacaacatctacaacatcaaattagcttcattagatgtaacattaaatatattttgataatgcatgtgttttgtgttataaatgctgttatattttttataaacttaataaaacttgaagaaaatgattaactagttataatataaaacggatggagcagtatatacacaagaaagagccgggaaacaaaaaaaagagataagaaatctcgtgcattggattatactgacaaaagtttgatcttttttctttgaaaagaaggaaatttgggtttgggaaaattccatacttctggtacttgtgaagctggccgcagaagagggcgttgtcggggatggccatctcggtcttgttgccggtgtcctcagggttgacgaccctgacgtagacctcctggcccaggtaccatgagtccaggttctccgacctcacgttccagacgcccacgttgtccagggacaccagcaccgccgcccacgctcccgggtacacctgccaaatcatatgccacacccgcaatcgcaatgcaccacatgaagatacagtccagtccaatccaatcaaatctaaactccattgtggttaatctccagtactatgaacactgaccagtgtgcagagatagtgcgattgctatttgcaatcagatggtgatcaacttgataagttattagaaaacgtgattatttttacactctgttttcagctatttcattggattgttacagtgaattatttacttcacatatctaagaaaaatacgatttcgaaaaaaaattgcctattgtattgcttaaactacttgttgtaatagtatttattaagttcattcataaaatatatttaatttttctctacaatcaagtagataatcggctcttcaggtcaatgaaccgtaggataaaccatgttctatgcttttagaatggaatgaagtcctagttttcaaaaacaaaattagtagataattcgctataataacctgttgaataatctattctagtgtcaattttaaggtattattgacaacttttacgatgatctctaccaattttgctcacctgcacagtgctgcgggcgacgccgtcacccttgttgtaagtacccctactatcctccgtccattcgccgtagtccatcctgcatcgaaattcaagctcacccaccttaacaaagatctccaagaacagccatggcggatgtacatagctttcaagctaatttgtgccattgctagctactacttccttcgtccagaaaaataaacatagaattggacgcgatatatcctaatataacgaatctggtcaagagtcagtctaaattcatttcatatgtcacattatttaattctaggttcgttttttatttcatatgtcacattatttaattctaggtttgttttttatgggacgaaaggggtatgtatttacccgacgacgaagaaggcatagccgtccatgtggtagctctgcatcctggtgtcgttgttctggaagatgagctccatgaagccgcggtaggtgccgttgatgatggagcggcccatccggggggcgccgcgcagcggccgctccgggaagtcgagcgagtagacgcccctgacgccgtacgcgtcggcgagccgcagcggcgtctctggcggtgtgaaggacagcccgttcagcgtcgcgcggcgccgcccgttgatcgtcaccggcgccgtgctccgcagcaggtacgcctgcgtcacgttgatcgacgagtacctgaacgatccctgtgggttcggcctcgccgctccggcactcaggttccacctgcccaatgcaaaaaaccaaaacccaaaagcttaatgcgaataatacatcattccacgtatttaaaaaaataatttataggtaaaatttttataatgtattttagcgacgtaaatgtcaatgctgagaaataaacgataatactttaaatgaagttctaaaatttaaattttggcatcggttgatgttggataaagaaaacgatggaggctagtaatttttcttcttttttaagtatctagattgtcatatattgaatttttcagtttttcatccctttgaggacaatccaactattattttccttttcttatgtaaaaggttgaacaacatattcaaacataaaaaaataaaattaaatgaaataaatttacaattcataaaatttacagaatttatgttaagaaaatattcaaacttagataataataaagcaacaaaatcgtactaaaaagaagtataattgtacattgtatactactactcctacaattttagacttagaatttttaatttcctgaaatctagtaatgccatttttttctttctagttgaaccagacagtaagtttaactcgaaacttataagctaatgagcgaagtcgggcaattcactcgtacctgacggagcgagcttggttcatggagaaggacttgtcgaactggtcctggggagggtcggggaaccgacccttttcggtctctaccggctctatacatttccaccggatgctatttgtctcgggttcattctcatttggggtcttttccctcttcgaggctaatccgcttgcgatgctatctgatatagatgctcaattacg

SEQ ID NO: 58480 - DNA, 12690 bp, Oryza sativa
  unsure (1)..(12690): unsure at all n locations
atgcgaccaatatagttccaacaacagctaatagtacagaggtggagcttcatggaggccaacctgggtgttgccccctcagctttggcagcaaacacatatatacttaacaagtatctagtaagaaaatttattttctgctcaattgattagcaagtgaagagggcagatgctttcttggaagtttggtgttcaaatcctgagaagtccattctttttcttcagtttaattgcttactaaatcattttcctcctatggatgacaaacatttttatcttaataaaatagctctcttaaaacctgttaatttacaataactttgatatgttgtcttttataacttgagtgatccttttccacctgtttaacagctatacttaggtataacatatattttttcttaacaaaaacatgcttggaaattattttacaatatgaatagcccttctacaaattctacttctgccattaccaacatttccactctataatagctggccccatctagaatctctctcaagctccgccactgcagtagtacctttgcaaatcgggcctataagaacgcgatcctcggccaacgaatcgtcactgcatcggcatctggttcagcaaaactgcgcataacaaagaaatgctaagtttcaaaccaactgttgatagcaagtcgagaaggggttctatgtgcaagagtagtacaaaagccactgtttctctcttctgcttcttcttcttcttttgcaaaataggcgttggagatgagcgcgcattacttctacccgagtatagattcaatagacttgctcgaagtgtgtgacttaagcataaaagcaataaaacgacccccgtatggcttactacggcattaggtattctcgaaaatgcgatatggcgaaagcgaagactagagaggaattttaccccacacagttacctcgcgcggaccagctggaggcgtgcgcaggcgccgctcacatacgtacggcggctgatggcggcgcctacgccgctgcccccatcggggaagggcggccggcggagctagctgctagccaacctggagggggggggcgctcccacggcgaggaaggaaaggggcggcggggttgtccgtggcagcggtggaatcggcgacggtgggaccgcgggatgcgcggcggcgagggtgagggcggcggcggcgcgggtgtggacgctgtggcggaggggtagtagcgtttcggggaaatcggggagggccgttggatatagacatatagtatagagcatatgagcgttagaactgtaatacctaaggcagcgtttggctaatgggaaataatttttcacctaccaaaagatatctttaaattctaaccgttcattcaccctcttccatttaatcataacctttcattcatttctcaattctaatcccaccctctttcccattatccaaacacaccctaatagcgtaagagcatcaccaacaaaagtgtataatccacctctaaatttttatttttgagttttctaaaccgaaaataggaagtgaaaaaactaatattttcaagagaaaacctaaatttatttttcaaaaactaaaagtgaaccattctattaaacttaaaaaaatcattgttttgctccgtaccgtgcgtgagaaggctcgcgcagcccttcaggccaaccgcgacgagggagagaggggctggcgcctacccactgtctcgcgagcggcacgaagaggcggtcgtacaccatctttgctcttctttacgttgccgccgcctccactgttaaagccgggggctctctctatcataagatatgggtagagtttaggcgaggtgacaccaccagcgatggagccctggcgggatcaatgacagggaaactcttccattgccgcataactcacctcctctgccccgcctgccccgcttcctctatgcccttctccccgtatccccttccttgtagatcgtcatcgtgatggacaaccgcgtccacgagcatgtggttgagaccacggtgcattggacggcgtgcgtgtcgagccaccgaggtcccgccactcatcggattggattcgtgcgtgccgggccgccgaggtcccgccatgcgttggtgtggtaagaagacgaaagaaagaagaaacaaaacgggaaaaaagagattgatggaaaatgtgacggcagtggcacgatttcaattttgtataatttcattagcatggttacgaatagacgaattgtaatggcatatatttgaaatggacatatttgcaattggagtaaattgcacccatggtacaccaacttggcaagtgggtgcgatatagtgcaagaagttgagaattgaacgtccgagtgcaacaacttgataagtgggtgcgttctaatacaagaacttgataatttactccctccgttccatattgtaagactttctagcattgtccacattcatatagatgttaatgaatctagacataatatgggcaatactagaaagtcttacaacataaaacggaggaagtagtattttggtgcattaacttggctaagcatatgctaggtgatttttttttcacgatgtcaatataacattacataatcctacggatattaccttatagtattgaatgtaatctttaagaattatattgcacatataatttacatccaattaccttttaagaattttttgttttcttcaccttctcaaatatcaactaaatataataatttatacattcagtttaattgattttcagttactagttattatgataccaatataaatatgcacccaataataaagttgccacataacttcttaatttattgtatcaaaatcgtacctaccttacaaagttgttgtatttatgtgatcacttataaagttcttatactaaattgcacctacctaccaaattgttgcactagattgctcatttatcaagttcttacaccatattgcacccacttatcaagttgatacactagcggtgcaatttactcttgcagttgcatggatcaaattaacccatttttctctgtttttctttttaaagcagctatagataatccctctatcccaaaatataacgcacaacactactaacacataaattaaaaaaaaagaaattaatcgtctcttcagtaaggtcacctcgatgtatgcaaataatatgaaagtaatatgattggagagttatatataacgagacatggataaaaaatgattataccttatattaggtatattttcagagggatggatgaagtatctatctgttcaaccttgaatacttctagccttcgctaggttccgtctgatcaattgatctcctccactaaaaaagatgggaaaaaaaacgatctataatggagacagcagacaggacatgaagcagaaatcagcagccccaaactcccttgctttggcatgtttctctacatagtagttaaaatgcagaaaaaaatcggatccctaacccgaatatctgcagagatccgacggtataacatgttgaatattcatgcaagtacatttggcatgttaagcaaccaaagagtggtgacttgagaagtatcaacataggatttcacattcacaagctgtatggcatagacccacggttcccttgagaagttacacgaccagtatcgtattatcacactaagagcaacaggaacaaaaggatagtgtagtgtcttcttttcatcgatgttaggaacaagttccagcctatgtcccgatagaaacggaagggtgcatgttcactgttttcttattgaacacaaactacataactacagcttaatgtggcaaggttcactggctgctcgattcatcatgctcttgttgcatctggttcagtacaaatgccccttcaaggttcttgtggacctcggctttgaacttctcctccttgtttcccctcttaagtttcatcagaatgtcaaactttgcgaagtcttcaacaacctgattgataaccatatcagaaataagggtgtgtttgaggagaaggggattgaggagattaagaagatacgtaaaacgaggtgagctattagctcatgattaattgagtattaactattttaaatttcaaaactggattaatatgattttttaaagcaactttcctatagaaaatttttgcaaaaaacgcaccgtttagtagcttgggaaacgtgcgcgcggaaaacgaaacaaacaaactcactctctcaccctctcgaacgctgcctaagtgaactataagctcagcattactaaattagatacaaaaaagaaaagataatctttggatggatgaattcacaatagctgacctctgcctttgcacgaacgatctcgagaagttcatatggaaacagggagtttgacctctgctggattgatttcacagcatggtctgcagcatctttgactacaggatcatgtactggaacatcacgccacccaggctcatgtccacctgaaatttcattgagttcaatatcaggtttagaagttataacaatatctcatatacagcacaagtgtgtgatcaactttcaacatccatgaattggcacatgaagaaactatcacattctaattagccactttgtatcatatgtgttgacattgacatctgccacgtttcactgaaaggaaaacatattcaaataggtagaaggatgcatagtgtgccttggggtgctcaaccctctttaaactggtagaaggaaaaccaggcaccaggcttgcatggcatcatgtcagcatttgatatatgcatggatagtgtgtaattatgcccatttgttcacagtttagcatgattatggtaattacactcttacaaatacaatataattagaccatgtctttactacctgtagatgctgggcacacctcttccctccctcaaaaatattatggaatgcaaattcttatgaacaaatatgccagaaggggaggaacttcttttgctttaacccctgtggcacaggtgtaacattctgctgtctgaaactagcttatgaagaactgacataaacatatagacgtacagcaaaacttctaacactcaaacaaataattagtgtgagaatccttgagcactctttctagctggtgtggtgatctgattggaattcaaaatgcactatataaatataagcatgtaatgctactgctatccatgctacaaatgagattatgcccagtccgctgcagctcacatgaatgcaaaacaaacattatcacaggtaccctataatagaattctacaagcaataaaacaggagaatgcactaactagacactgtatgttgtgaatattattttctcatgaaattttacatctacataagttcttctaaatataccagtaccacccaatgatacattaggtgataatgcaatattgaaacataatagtgggattatgatgcagacatacagggtgtgtgtggtgataggcaagcaaatgtaatcaaatcgtcatgcactcatgctcatgcagtgaggtgttgcatcaatctgatgggattcatgtaatagtttgttcagacagacaaggtggtaaagcatgaacatacacatgccgccatgattgggcggctgttcaagcagcatagcagagtgaatatagagatcaggcaggagcatgtcatgccaaaatagaaatcgagcaggggtatgtcaccagaatatagatcgagcatggcatgccaaagttttagaaggacatattagcagggatcagcttacgcaggatgttcaaatatataactacgcaacccagcagcataaaattgatctaccaagttatacccaccaaacataagaagaactttttcaaaaaaatataagaagaagaaaactaaggtttggactaattaccttttaagttcaacagggcacatataacaaactcaactagacatgaatgtgtaactaacaaacaaaataagaaactaaacaaaaacataaaggttgagcttcacacgttacaacttgtgctctctgtatgtagaatcaaatgcttggtaacaacaactcagatcactattaactaaatggagtcaacagcaaaccattaaccatgccacagctatctaaattcagtaaaagaggtttttaacagaggatgacaagaatacagtcacctgccgctgtgagttgtcaaattccaagctatcacagaatccaaccgtcacttattcccagtagaaatgtatttcaagctatacatgtagaaatgttgtataattgtcaacatttatatgattgtggaaatgttggcaattccttgtgcaagaaattgagaacccaaccgtcactcattcccagtcgatgatctcgactctacactgtcgtttttttttccaacgaaactattccatagatgactaggcatttctacatacacctcgtcatcaccacccatgcccaatcccctcccttcgcagaatcacaagctagcgtgcgagcaagcacgcaatatctcaaaacaagcaaagattagaggcaggcgacaggcgagatcagtgggagcgaaaacctttcttggcgccgaggtcggcgttggtgaaggtggttgcatccccagtgttgcggaactcctggagctccttgaaatcgagccacggcttgacccagaccttggcctcgtacaccttcttcctccccgcctcgagggcctcgagcgtgaggtggtgcagcgtgccggccaccacctgctccttcgcctccaccacccgcacgaactccagcagcgcgttctgcaagcaccacacccagagaaccctcacaagttcagtacccacaaaatcgccactggggaggaagcgagagagagggaggggggaggggggggggagggggcttcaccgcncgcttgggtgctcgtcgacggcgaacgcggcgagcgcgtgggtctggacgctgttggcggcggagggggcgtcgtgcgcgccgccgaggacgtggccggccatggcgagggacgcggagccgacgaggaacagggcggcggcggcggcggcgacggcgaggaggaggaagagggggagcggagcggcggcggaggaggaggcgggccgcgtcgtcgcagcaacgcgcatcccaaactttcccttcgttacggtttcgctcttggggcttgcggttgcggcttctttgcttcgtgcggggggtttctctctttgcgacgaacggggatgacggtttggctgttgaggcgagtcgatctagaaagagagagttgagagcggtggcggaacacgtggcggggaaggtgcaggctacgcctacgcggcgtcgattcggacggtggggcgtggggcccaccaccatacttgggccggaactggatctccgaccgacgtgcggcccacatgtattgggccattcggtatcgcggcctcactgtggcccatatatgaatgcggcctagggagtacctatacatctttcgaaagatttttataatcgtatcacacagatttttaatctttggattaaaatccgatagatataataaaaagcaaaagacaattaagaaacaccataatggacactaaattaccatatcctcaagaaaaagaccaaatccaatacaaaatttaaaatttacgtgcgaagattcaaaaattacagtgtaacttacaaaagttacagtgtaagtttcataaattacactgtaacttacaagaaaatgcaatgtaaaattgagagagaaaatcgagtgatagataagaaaaaaaatctttcgagtgagatatagcaaaatcgcttttaaataagtagattcgcgggtcgacgtactatgtgcggccgataaatgttgggctggaatggaaatgaggcctacatgtgaccgagaaatgttgggccgtaacggtatagcgtccaacgtgcggcccatattgttggcacgggacaggatcgccgcctacctctgggccattagtattgggccgaaacaagatcgtgcactaacataaggcctataagcattggggttgcaatgggctcgggatgaacggcccagattagcttgttttgttttttttttaattttgacacattttagctggttttggttgctagtttgctaccgcttgtcgaagccgacaattagcgggacgagcttgtgagttgtgcctactcaaatcaaccgctgatcgcaaagatacattaactatagtattaactatgtgtatgcacattctttctcaaaaaaatgaagatcaaacatgtgtgggttctcctcaaaaggaagaagaggacaaaaacaacaggagccatggctaaatgattgagtcaccgtcgtcatcaaccatcgatctccctccaaaagttcacgtggcgccgatcagttattcgataatcatgcatcaccgacaagcactgacagtgcatctgggctcatccaactattcaactccagatctctgcgccttaatcaaccaatgatgtgttagcttagctgcattgcagagccgcaggggcataaagcaccgggctgcaagcagcctcgtgctaattccaagatgtttaggttcgatccatcatctaccttgatctccatgtcgtcgccaagacagcacgacgtactgtgtagtacatacacctcgatcgatctctgattaatctggatcgcctcctgcctaatataatccgatattcctaaatgcatgatgatgcatcattagctttacgtcgacccaatcagaggacaatccatgtatatatgctctgtcaaccataagtactacctaccttcgccctactaaacaccaccaagcaacgtcatgccccacacctgaatcatctcatctctgtagaacattaatccatctctgtttagttagcttgtcctcgatcgaaacaggggggcaaaatccgtattacgaatgttaacagagcttagccagaatggaaatgccaacccgatgtactcttttcagaagccccttgcacgtctaaacaatcagtgtcattaatacttaaccttatcgccgatttcccggccatgttcaccttgttctctcccttgttttactcactaatcctacgtgccgctaatgactataattaacctgtcgtctccatcggattccttccttgctccacgtaggacgacgggcacctgtcacgcaaactgcaaagctagcttggcaggcagcgtgcagagatccatggagcccaaccatattctgctccctaatctctcactctcacactgtcacacacagacacacagtctcgctcactacatggctacaggccgtatagtaccacgtactactactgcacatgtgttctcctcgtctcatgtcatgtgccgcatgatccttcttctggctctctgcaatggcctccaatcaagaaacagttcagtcacgtactaatcccttagtcccaaaatacgatcatctttactctttccgtctaaaaaaatctaacctgaaaaagaatgtgaccctcttagtacaatgaatcaggacgaatggttgtcctaagttgggtttttttggacggagtgagtagttcgtaaaaaaacaccgttgatgagtgtattggtaaggatattaaagaaataaaattcatcgatttgttgaccgggataggttgagaaaagaaaagtgaatttattttggaacaaatgatataacccaaaaatgaatttgttttgagatggagtactttctcccgtttcctaaatataagtatctctagaatttaagtttttacacacatcatagttatttttagataacgattcaaatgtacaggagtctaaagcatttccagccaatcagatgtttaagaggaggattctaaccaatttgaaatctagctaagatggttgaatggaaatttccgttaatcaatctagagattctcataattaggaacaaagaggtacacagtttagcaccactagttaatcatggaggcgacagcaagtaaggcagccagtgccggatgcatggctccatgtccatgagggtgtgtagttaattatattagtacctaatccggggtctaattagtcgtcctagctacaattagtccctggaatcttgaccagttgtgtgtacctctgctctgtcctatgcattagcacgacggggacaccgtcaccatatgcgtgctgcaagcctgcagtatacggtccaagttgtgttcaaaccaagcaatctctgaactttttcaggaacaagctagctactactcctactagttgctaatgtgtacatgcagtgtgagctaagatggatggatggatagatccagcttggttagctgactaattattaatggcaactgctgtctggtggagcatgcactggatataatgatatctatatgatacgtatcacacaatgtagctaggaccagagtaatttagataaactaaagtgcttcggccattagtcctagccgacgagctggattagctagcttgacgtgtgccttgacctttatttgattccctcggagaggagttccattcttgtctcttgccctctcttcctaaattctaaagacttagaatagagtagaacgttgtgttggtcgtaagggtcgagttttggatgatcacacctatgttactttgttgacttagcaacggtcggtcacgcttagcggcggtcggtccagtgctaactttctcctgaatatgtgttggcgctgtcggtgtgtaggtagtgatatattttttcagttttcatggttacggccttccagggttataagcttatagtttgtaaaaaaaataattgatcccctcgtgctctagcttgatcgcgcggctacgcgaactacgtactgacgtacatatacagggtatatcaagctaattacgaggagtaggtgagaccacctaggtaacttgcatgtatagcttaaaaacgaaatgggctctctgtaaaaaaaaaatcaacaccgactgtaaacctactaaatatacatgtgtccaagtttataattaggattaaactttttatggaacaggatgtaatcccttgccatgccaaatttatattcttacggtaaaacttttctcataatctccgtctaaattcacatcaagactataagactaagtagctatataatctagaaaatgagctaatagactattttatattctcaaccactagatacttattagttgttgtcttagaatattgagctcccttaaacatgatcgcaatagaaagtgcgattggaaatattatggtgtcttaggttttttttacttctagaaaatcaagaatttttgtttaaatttctccaaaatcttgtgctaaaattatacgaacttgtatatctcaattagtactttactactaatttattttcctgaaatccgaaatcaataattaacaagttgtacttaactgcttagactcttcttttaattaatctaaccattataactaaaaaaagccatatatttacaatatgattaaaattataatatttataatagtttatacaacatagggattggtgactagtactccttctgagtccaactttaattgtccgtcttgtttgattttttttatgattagcatttatgttattagatgataattgataaaacatgaataatattttatacatgtcttatatttttttattttttttaaaaaaataaataatacggatgatcaaagataggcatagaaatttataaccccgcttacaaagggaccgagggagtaattagttcatgcaatacagggattgatgactagtaataatttattatcaaccgcgccagaacacatgtgaaatggcgattaattagtctagtaatgtagtatatatatatatatactccctccgtcccaaaataacttaacctatatattaacctatatagtgagatgtgacacatataagaacaataaatctggacaacacatcctagaacaacgattgtccatatttgttgtcctaggctaagtcctaggttgagttattttgggacggagggactagaccaatacaagtgactagctctctttgatgatatatacttcctccatcacataaaaaatcaacttaatagtattaagggcttgttcactttgctaccatttttaaccttatcttttttttggtaaagttaaaaaaaaaggaaaaagtatgaattacacccccgaactatcgtggttgtccgaattaccccctgaaccacaaaaccggacattcttcacccccaactatgcaaactggacgaattaccccccttggttcaatccacggtggttttggtctacgtggcgtacgcgtagcagtccagtcagcattgtatttataaaaaaaattgtgggacccacgtgtcatactcttcctccctctcttctctctctgtatgcctcacttttcctctctctctctctctctcacgggtgggtcggcggcggcgggcgaccacgggcggcgggcgggggcggaggcggcagcgagcggcgggtgggcgcaaggctggcgacggccggggatggaggaggaggcggcgggcggcggtcgaggagccgaggccggcgacgggcagtggcggagaaggcaacgggcggcgggtgggcgcgaggctggcgacgggcggggtcagaagcgatagtgggcggcagccaaggagccgaggtcgctcaagcgccggcgggcggcga

SEQ ID NO: 58481 - DNA, 10154 bp, Oryza sativa
  unsure (1)..(10154): unsure at all n locations
ggttaggtgagcgccactgtgctcacctaacccatacgcggagcaaaaaacccacgaggggtcggggtgcctcggccctcggggccgaggggggtgcggcccgaccccctcggggggactaagaggagggcgaacgcatcaccctcgggcccgacgtccctcggggccacgtgtgcgattgtgtctgcctcaaacctctagtcatgatactcctgatcccatgtcaccgacagaccccatgtccgatagtcgatttatttgtgttgcaataacatctatttctttgttgattttattgggggtggattagagttctccctatgctgattttatttggatggatttgagtccgatttgactaattgaagttccccctcttccagtggcgtgttcgagttggcagtttggaatttggagatgaccaagatacgagctcgatcaggaggtgattcggtggaatacatgcaacgaaccaagatggacgataggatatgcgcgctacagcaatgaattaggcaaacgtcggacaaaaacgtattgtgacgatcgtagaattatgaatttttaaaaaattttaagtaggttagattagagtagatttacatcttttaaagagcctttatcctggtaagagtaggactcgcatttaatgcagctacattttttcatccattttagctggattccatgtcgacacggtctatgcccaacttatgactgattctgggcctaaaacaggtgtataataccgccccgtaattttttccatttgggctgaaaatgtgcgtttggatgggctgtgatcggattacaatccgtcggaaaaggcccattactaccagggaaaaaaactgcccaggagtctcgccttgccctctcgccgtccgtgccgccgccgccgccgcctgcatctccccttcctaatctgtgacgacggccggagacaccgtacgttctggctggctgcagaggagagatcagaggagagggatatggtccaaggcgacaacagcaacaacatcaattgccactggggacatatcctctcgtctctcgaccaatgcaaggcatggaagcagttatggccagttgaatttggattggagtttttgttgatgatttttacatctgcggtgtttgattctagtttgcttcgttgccaatgttcattgctctactatttcatgaattgattttggatcctagcttagcactcttcaatatttccatatgctaggtaacatcatcacccaacaaacggtttgtctaccaagggaaatttatttcactggtaattatgggtaacacaaaattacactcgtatttcaatcacagacagttgatttgtattttgtattctactccctccatttcataatgtaagtcattctagcatttctcacattcatatttgtctagattcattaacatcaatatgaatgtgagaaatactagaatgacttacattatgaaacggaggaagtatctatgttgtttgtaacctgtattgcaagcttaaatgctcagactatgtctctttggggctacgtacatcctacgggatgtagaggctgtatatgacatgtgagtcctcatgtgtccataacatgtagatccagtggtaaataatttagcaccactcgtaatagtagcatatagttaattattccggggtttaatccattattaaaaaaattaaataggaatattaaatatgaaactcttattcttttttatctatggaaggggcaaaaatattcagaacccctttcttaacttaaggtttccaatcttcactttctcgtttttcgcacgcacgctttccaaaatactaaatagtgtgcttttaagaaatatggccctgtttaggtcccaccctaaaatttttcaccatgtcatatcgaacgtttgaacacctacatgaagtattaaatataggctaaaaaataactaattgcacagattgcgactaatttgcgagacgaatcttttaagcctacttgctccatgatttgataatatggtgctacagtaaatatttgataataacggattaattgggcttaataaattcgtctcatggtttactgacggattctgtaattatttttttattagtgctcgaacaccccatgcggcaccatatataatacccgatgtgacacgttaaaactttacacccctgaatctaaacaccccctatatatatagaaaagtagacgtgaaatatcatattaatttatttttcaaagtttttaaataacacataattaattatgtgtgaatttgttgctccgtttgttgaggggagggttaccctccaaaagaacacaaccgaagtatctgttgttatcgattgaaggtgctgttttcataaccaacatgtccaacaatgcgaaatttttggacgattttgttgagttgagatatcgcaaacttgacaccataaatcatctcagaatagtgaactctgaagtagtagcatttcacgctcccacaagatcggaaatcggaactatgagtttcccagcatctagcttttagtttattttttgaattctacaactttagaatcttgataaagaaactagagtttgggagagtttataattctatgaaaaggtgcagcagctagaagctctccaaataggccctataatgtttactacctctattttagattataagactttctagcattatccacatttatatagatgttaatgaatctaagcacacatatatatctagatttattaacatatatatgaatgtggacaatgctaaaaagtcttataatataaaacggaggaagtaacttacacttctgctctgttaccacggtacgaaccgtaaaaacacttttatggtaactttacgacgatgctctcagtattatcaacattatcattcattaaagatgattttaacagttgatttatatgagttattatactatatcactagaaaactagtattctgttgtgagtagttataaggtggtaggctggtgaccgttataaaatacccctttcgtttcactatatagcgacctaggatcagattaggacgaatcagtatctgtaccctgcagtaccgtcctattttggatatgtttagttcacgccaaaattagaagtttggttgaagttgaaagtttgtgtataggaaagttctgatatgatgaaaaaattggaagtttgaaaaaaaaatttaaaactaaactcagcctttagtagaatttgatagtggcagctaccacttccacttgtgcgtgccgtttcggacattttgcactgcagctttcaataccaagcccgaacgttgaacggaaacagcggatgtagtactagcaaataaattcgggcagatgagcaccaataaatgggtcatcactcatcaatcttgtggtaatctgtttggccttcattgcactctcaatgctctacagaaaagaactgaaggcgtttggacataacaatacacatcatcaacatctcgcgtacatcctccgtcccaattaaaactaactttatagctacaaatttatagctaaaagttaacttattttaaatagaggagtaagtgttttcacttgaaaaaactcaagcttgtcaagttatcattcttatgtttggcctgttgctttgtggtcaaaatattgggtcgaatcatctattactactagcattaatgtggctccttaaatggtcccttagagagcgattgttgcaggcgagagaatttatatctgtccgtaacttaccgagagtctcctccaaaaaatcaaatctatagtactatctttgttttaaattataagtcgttttaattttgatcaaaataaactgcttcaaatttgtaaaaaaattgtaacattttcaatccaagacaaatatattatgaaaatatgttaaaataaaactaatttgttgctgtaaaaattaatatatttatctataaaattagtcaaatatttggagtaatttgactttcatcaaagtcaaaacgactataatctgaaactgagggagtaatgaaatagtgattgatctatctcaggacttcgctcttagggcatgaggtcgtttttagaatgaagtaatttcacaggaattgaaatccatgtaaaatttctgagttttgaagtaggatttttctctctccattttagctggattccagtcaacagccgtttaggggtatttgttgttatagtagtgattgaagtttggaagcatgtaagaattcttctcagttataattcttttatgacatggaaaaataccctaaaaacagccgtttggaaaaaaaatcttacatatttttaagttttcacacaatcattaatctctctcatgatatgagtttttcttctttttcctattcgttagctggacacccacctataataaagttataatcgatcgttaattattaatccaaacccacatcgttttattcaagtgcacacagtatctatgccaacaccgctcggcgagggctctttaagtcccggtttacaatcttttttaatttagttctggtttgcaaactggaacgtccaattagggactaaagatgtggttaaaataaatatggtaacgctagccagtccactagagtttttttttctttttttttcattgtttttttcattcattagttcactaaagtcatatattgatttcaagcaccaacgtcgtcatccctaaatccccacaaatcatgcacaacgaatcattcacaattcataggcccatccacaaaatcatccacaatccacaaaccatttataaaatcatccacaaaatcgtcaccaaatctaaaaaaatctacaacaatatttacgaatcattcacaaaatctaaaaaataaatccacagccacagtcgccgccggctgcccaaccgtgcgccgcctcccagcctcctctctcgtcggatctggcgaaggggaggccaccaccagccgccgcggccgcttccgccaggctgtcgcttgccctccccttccgtaggatctggcggaggggaggccgccgcccggcgtcgccgtcgtcggaggaggggggagggggagggggagggggaggagaggggaaggagagggtgagaaaatgagaggggaggaggagataaggacgaggcgcacggttcaaggcagcaattcacgatttttttttaattttggtgggactaaagataaaaagaacctatggacttttgaaccgttcctacttgaacagggactaatatgatttttgcatgtcccagtaaagatcacttctccactagtgcacgtatcatggccgcaccaacgggaggcggcgatcaagcctagaacagataatgaattaaaccggcctctacctccaaaacgaatgtacacacagctatcatactccaattaacacaagatgaaattcagagttcaaacttcaaataccaaaaaaaaaaggcacatcatcgatcgatcaaacatcgcgtactggataattattaattcaaactcacgcccttttcttcaagcgcacgtacacaccacgcgtatatatgccacgtacgcatcatggccggcggcggcgggagatcgagcctagcagctgggaatggggatgccgcaggcggcgatggtcttgcgtgcgttggtgttgttgacgtaggacgcgtacgtcgggtctttcgcgtactggcagaggcacccctccttctgctgtgcgcgtaggttggagcagcacgactctgatggcgccgtcccgtagaagatcgggctcacgcacgccgatagctgctcagggtcacactgcgccgccaccaccgctaccgccgtcgctgctgccgtcagcagaagcatctccatcacagctgcccacttcaccattgctcgagctagctctagcgtaagaactgcttggttactagccgaatgtgatcgaatgttatcgatgtggtggtgtaggaaaaggatgcacatcagggtatttatagacgagatgtcagaaagcaggccatgcatttcgtgtatactcctttcgtaccaaaaaacaaattcaggctttgtcgtagtagtagtagtactagtgccagagctgttcttcttctctagcaaaacggaggaagaatggatgaagaagaaagagacatggatctatcctcagtttcgtgcattttggatactcgtatacatatgcatttgggtttctttgactagtaacaatggatcgatatatatgtacgcgtgcagaaaattggtgtctgccaaattaattggatcacaacaagaacaggatcgcaccaaggaaatcatccaagcagacagtataagtttgcaggcaggcatccatggggcatcttatttgttttttgtggacactcgaaaccaattcaaaactttttacatcaacatgcatgtatcaagcttaatttgttgtttgtgtttggacgccagtaagagaaaccatctttagtcggtcaatccaaatccacaatagttacaattccattaaaaaccgggactaaaaagcagtttataaatataaagggactgtgtgatctttagtcccggttagtaacaccaaccgggagtaaaattaagatgatctttagtcccggttcacctcgtgtcagaggctgtcaggtcccagatatttttagtcccggttggtaacattaaccgggactaaaatcctaactttagtcctagtagttgttcccaatcaggaccaaaaatcaatataccgtgtataatctcttgctctcttatcctcaaaattttctatctcctattcatcctctctctcactcttgtcctctatccttctctttctattcctcatcctctcacagttgctaccgacgaggagcgagcggtggccagcgaggctggcggcggggtatggttggcggcggccggatgggggcggcggcccgcggcgggaagcaggaggaggcggcggcgcgacaggagctcgctgcggccggatttnnctttttttttttttncccctttttttttnttnttntttnttncttaaaaaaaaggggaattatgatttattggatctgtgttatttgatctatgatgtatttgtgatgtaatttttttttagaatttgtgatgtttcttttcgacaagttgtgatgtgaatattatgatttgtgttattgttactttgatctgagatgtagggagcatctctatttggaattgtgatgattttggtgagattggtgtgaaatcaatatggaaaaaaaaagagaagaatgggaccagagacgtggcgctaccctcaccaaccgggactaaaagattcccctctttactcccggttggtgttactaatcaggattaaagatcgatatttagtcatgggtatttgaaccagaactaaacatagcgatttttaatcccgaattcatagaaaaaccgaactacagagggttctaaaccgagagtaaagagcatttcttcaccattgtttttttaactggttatcgggggaagagctttcccacctgaatttcattaaagggagaacaatacatatgattagtttgttacattggggtgcagcaaggaggaaagaatttctttccagattctactgcaatcctgtcggcgcattttaacctttccgtcctgaggtttgcatcttctagacattttgaaattagccgggcggtggaggccggaggggttctgctttctgaagacgacgtctgccgatgattcaacagcccccagaagcggaggtactagaagatttcgaagtgtttggtcggaatccggcttggtctgggcagattgtgaagctcctgcatagaggtgatgttcaggttgatttgcaaggaattccagaatgcagctacgaaggggcatctgtttttaaatacgagtagttgttgttgattatcactgtgctacatatatcaactttatattcccgagaatccattttctctctcgctcccagcgacgtcgtcatatccatgtacacaggttgcttgagcttgaggagcatccctcgtacccgcgctgcacgacacctactccctccgttcgaagaaaaaaaaaagacaaactctatattttcgtgtccaacgtttgaccgttcgtcttatttaaaaaaattataaaaaaaattaaaaagacaagtcacacataaagtattaattatgttttatcatctaacaataataaaaatactaattataaaaaaaaattcacataagacggacagttaaacgttggacacggaaatcaggactactcgacagggtcgctgaacgcaaaaagctctgagtgtggccgcgtgtggacatcgcgacatctagtggccacactagatgtctttttaaacacgtcaatggctaacggtaacggagacggctaacggttctacaaatcgatgttaacagtgaattgtggcttcgaactagagctggagctgcccttaacatccaattatctcgattacgactctgttcttggagcttgacgtagtcttaaaatgttggaaaaaaactcaagcttgtaaaggtgtcattcttaattatgtttgtcctgctccttgatggtcaaaatattggttcgactcatttattagcattcctctacctgaggactctgttcttagagcgaaggaattttcccgaaaaaattaaatcgacggaattttacggagaattaaacttaatcatatgaaattcctgtaaaatttatgtgttctggattggcatttaataccagtttagtggtattgttttgctgttatactaggtaaaaccccgcgcgttgctgcggaaaacgcgcgggaattttagtatgtaacaataagtaaaaatagctaaacaatataaacttgcataagcactaaaatcaattgatgtgatatggctgatagagaagataaaaaataacattaactaagtgaggatgaacttacgtaagtaaataagatattataaagaataatgaagatatatattgaaatattatgttaattatgtgggatgataatttaatatacttttattttaaaagctctaaaatataaaaaaattaaattatagataatatagcatgtttgcatgatattaaatgtattgattgttagtggatgatgatgtatcaacttgttagtggatgataatgtggcatatttgcatgttaagttttagaagtcagtaggttataactttattataatataataagataggattagggaccgaaggtatcaccctttctataggaaacactcaccttcagaaggtcctccctcgtgttcttcccccaaaccatatgcaaggttcaagggctgagaagactcaattgagatttgggaaaacaaaaaaaaagtgttggtaggaaaaaatttcttacgtgcatgcttttgagttttcacttaatgtcttttacgttccgaggttttctctcctttttaagaccaccagtaaaattatcgtgggaaaaaggttgacaaccagtaaagtcattaggaaaaaaaaaggtccattttacttgtactttgtgaagaaaattgagtatatcattttcttttcaagtacaagttggacgcacgcacgtatcatctattcatcttggttttgatcatatcagaacgctcgtattatcccagggttcaaatttgtttatgagaaatttcaatcgagagattggggtagtacaaactagacaacacaggctgtgtttagttcccttcaaacttccaaaaattccgtcacatgtttagacatatgcatagagcattaaatgtggatgaaaaaaccaattacacagtttgcatataaattgcgaggcgaatcttttgagcctaattacgctatgatttgacaatatggtgctacagtaaacatttgctaatgacggattaattaagcttaatagattcatcccgtaatttacaggtgaaatctgtaatttgttttgttattagtctatatttaatacttcaaatatgtgtccgtatacttaaaaaagaatttgaaaaggaactaaacacggctatagatgagctcaagatatataaactgatgaccaaattcggaattcaaactttgaataccaaaaaaacacaccatcgacaccgatcaaattaactcacgtcctttattcaagcgcacgtacac

SEQ ID NO: 58482 - DNA, 31840 bp, Oryza sativa
gggggagggttagggttttcataaggccgtgggccaaccggcaagggacggaaataagtctattttacatccctcgggccgaagaaaaagagaagttcatttttagtacttcattttttcagaagtattacaattatagttattgaatgtgtttatttcgaagcaaacctaaaaggaagtatttttattcttcttccaattaaataattgttaaatgttatttgtattattaaaattagcaattaagctctgaaaattccaataaaatttcaaagagcgtaattaatcatagagaatttaataaaattaaatttaaccatgttattttatttctcacacttgcttgacttataaatttatttaattatacacatacctaattaaaaatatcaaatatttcagcgaatttgtattttaattaattgcatatttttctaatatgtacgcttcccgttgcaacgcacggacacttttgctaaaccaaacaacacttttggtcaatatacatactccgtaatcaaccagtgcaacgcacgggcacttttgctagtaatatatgaaataacgagattgtcatcgattcggttcagcacaaactgagttgggctttggcccacccctacaggcctacggagagtagacagtagaccctatgaacggcccagtactacggtacccactgactgcaaagatctcagagaagattgctaattaattattgcacgaactcggaaaatattctgatgttctaataaccctgcatcggaattgcttgaggactatcgacagttttcttgagtgaaaactgttaaattttttagccgtcgatttcgttttaagatttgtactgagatattttactattagatataaaccctcttttcacaagctagtcccatcattgcatgtttacggtagatttgttcaagttatatctaagttacattccaattacatgctagttacattgtagttacactatatttacattgtaactatagtgtaactacactataactatattgttatctctatataaattacatataaagttgcatatattattttaggcaacatatcctatgcacacaggccctcacgggtacacacgtgcacaccaactaaaaaatgtcaccaaaaactctagaaaaaatcatacacatactttcaattgtattacacctagggttaaaatcttaatgtcaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaatttttctagaattttttgtgataatttttagttggtgtacacggtgtgtacacgcgagtgcctgtgtgcataggatacactcccattattttaatacatatatatataagttattattattatagtatagttatagtgaaattatatactatagttaaatttgaaagttttcccctcaaaaaacactcgacacttttttaagctttgggaccagatgaatctgctgatctaagccacagtaaatctgacgaaacaacaagctatcaaccaggtgcattatttttcaccaatgcattattgtccgcttatagataatggatgggctcacggcatgtttcctaaattcctaaatttacgattttgtacaaaacttctgcatcagtatctcttaggaatctgtctaaacaaactttcaacttttcaatatttagttatttcatctccgctctcgaataattatcataacctttagtttcacccataatccatcatccaccagaattttggagcataccccttatgatggaactggtcacaccatattttcttatctcacttttctttcttcacaacaaaagccaagcatcaggaattatacaacacaacacactctagatgagaagctaattcatgttacagttacacacaccaatggaagaggaagaggaagaggaagaagaaagaaatattattgtggggggagatctacaatgctgtgtattgtgactgaccacacccttgctaacctgggtacctgtgtcctctgcagagcacctagatattgtcctcatttcatacaactcatccagctcaacagccatcaccagctgttctctgtgtatttcttcagggcacgtaccgtcatcaccagctgctgcctctcgccttcgacttccgcgaatttcaggcttatctctgagtacggcccgtgcagttctttcagctcttcctctagtgcagtgttccgcgcctttaccgactgatcatgagctgcattctacattgattgataattgccaccagcaaagtctgtcagcaatggaccatgtggtactgaattatagaaaggtaaagctttgctacagctcccggtggctccgtcgtatgcttgatgtgcgttatagaagctgttttaaaaaatcaaattaatttatttttaaatatataatagttaaaatttaattaattatgtgttatcgagcttactcattttgcatgcgcacaaaattttcctcatttttttgaagcatcgaacggggcctaagaagaagaagatatgcattgagagggcgtcctctaggaggcgatgctcctcaagctcgagcaaccggcatcagtggatatgacaatgttgctggcaccaagagagaaaatggagctggaaatatatatacgcttgatataagttgcgcagtgatagtcgataacgactatttaaaaacaggcggagtgactgtgacgttcaaacgaaacaacatttaaattaagttaagcttgacaaatgttgatgtgtaaaaagtgttgagtgtccacgagaaaacaaaaaagatgactaaatgaactagctcccacggatgcctgcgtgcaatcttgtatctgcttggacgattttcttgggttcgatcctgttcttgtgttgtgatccaattaatttggcagagaccaatttgctgcacgtgtacgtctcgatccactgttactagtcaaaaagacccatatatatatgtaaaaatacgagtatccaaaatgcacgaatctgaggatccatgtctctttcttcttcattcattcttcctccgttcagctagaacagttgtagcattagtaccgttatggtaaagtctaaactatacatatattaatttattttggtatcaagagagtacacgaaacggtctgctttctgcaacacttctcatctataaaaacccgaggcgtgcatccttcccctataccacattcgatcacattcggctagtaaccaagcggttcttaagctagctagctcgagcaatggccaagtggacggctgcgatggagatgcttctgctggtggcggtggcggcggcagctgtggcggtggtggtggcgcaggcgccgccgccgccacagtgcgaccccgggctgctgtcgccatgcgcggccccgatcttcttcgggacggcgccgtcggcgtcgtgctgctctagcctgaaagcacaacaggggtgcttctgccagtacgcgaaagacccgacgtacgcgtcctacatcaacagcaccaatgcacgcaagatgatcgccgcctgcggcatccccttgcccaactgcggctaggctccatcgccgccgtttgccggtgctggccatgatgtgtggcagcatatataaatatatgctgccctatgtccttgtaaaaaataaaggacgatgtctagaagcatatatatatggtgtactgcgtacttgaataaaataaaggatgtgtgtttgaatacataaattaccgatcgattaatgcacccgtgtttgatcgatcgatgaggtgtcttctgggatttaagtttgagtttctaatatccaatctcgtgggagcgtgaaatactactttaagagttaataagtattctaagatgatttgtgttttcaagtttgtctatcgatctctcaactcaaatttctcatacacataatcgtccaaaaatttgaacacttggatcgtatggactatagatagagcaaccgtctgatcaaaaccacgatgagctatatgcacttctcttcacgtctgtaaactgtagtgcgtgctggaaacgcatgcgccaaatatagcagttctggattgtgtgaatatgtgtatgtgcatccaatttgcatggagaaaaaaaatccactcttcctcagtcttcaaagagtgttccgtacttctcgaaaaggaaaaatatactctcttttttttcatcgaaatttatccaactgtcaacctttttcaccaccataactttactggtggtcttatgtccacctaaagaacaggtaatgtattcacatcttgagcattcaaaatttattccaagattgagctttccacataattctgtatctcagcaagttacaactatcttttatttaatttctctgcatacttgttcatctcaaccagtaacaaccatctaatccatgtcccttcctctctcaccgatggtgaggactggcggcggtggcagacttggtggacagcagcgttgggcggggatcgatgggggctagttcgatgtccctttccctgtcaccttcggacttcaatccttagtgagtccctatgatgtatgttatctgctagccctgctcgctcacatgtccacccccttcattggtccgactaccatcgtcgcatgcctctctattgttaccgagaccttaaaaatcaaaccgtatcatcacccttttaataatttttagaagtttcgccagtcgttagcacccttctgcttgtttgttttatgtcactcctcttcgttgacatcacaatctttaaaagtcaaaggtttgatttttatagtttttaggtgccttgcctatggccaccttcctattgttttgccacgtgcacctctacttccctaccacccaccccttctctttgttgtcatcatcaccttcatcagggttccgctcatccaccccttctcttccttatcatcattttcgtcagggttccgctcgctagaccgcttcccctccaatttgttttcattggcaacttaaacaatcgaaccttattattgtcgcctcatccctactcatttgccacccctctgcctgctgctactcttcttagttatcgttggcactttgcaaattcgagttttatcattgcaagggctccattgtcgttgtcttactcctttgtcacaccttggctcaccctcccatggcaaacaccgtctccctactattttctcgccctttcgctcacctatctgtggcccgccctttgttatcgctgacacataacaaaattcaaggtgttccctctgtatcgaacagtaaggtgctgtgttggagcctcaagcccatgtgtgatgaactcgaccacattttttttccacgttaccttggctagttttagtactactgacgaggtaggtattagaccgtagtcggcctactatagaatactctcgtacaaaaaattatgtaaaataaattgttctaggtaaacataataaattaaattattgatttggaaaaggtacgattgatggtatataaaatatcacttacatgtctacatacatatcggatgtatctatgagattatagaagattaatttacaaaaccaatctactaattacccggcccatgcgtacgtactctttggagataatgaagtttctaggtacacttgtgagtacacatagcaaaggggaacttaggtggcaatcatactctatttataccgtatacgttcgaaaagcctaatgggcgatcaatcaccccgagtgattaccccctcctccatgtggttttttttttagaaccgcattactttcctattttagtaaatttatgcacctaaagtatgaacatataaagtttacacatctaaagtttatacacctaaagtttagagacccaaagtttatatatctaattcaaaattaaatttgaattcaaatatttttatatttagtattttctaaacatctaaagtttatacacctaaagtttataaacccaaagtttataagtctaaaagtttatatacccgattcaaatttgaatttgaattcaaatatttttatatatagtatttctatacataagtttttctaattttgtgtttttttattttttttaaaaaaaaattatggtgtagagacctaaagtttagagacccaaagtttataagtcaaaattttttatacacgattcaaatttaaatttgaattcaaatattttttgtatatagtattttctatacatctaaaatttatacacctaaagtttatagacccaaagtttataagtcaaaagtttatatatccgatttaaatttgaatttgaattcaaatattttttatatatagtatttctatacataaatttttctaaactttgtgttttttattttttaaaaaaaatatggtgtagtaggaaaagaagaaggggagaaagaagggagagaggagcgtgttaggggggatgggggtgaacgcccacaacaatcacccacccattagcgacacccgtgtatgtttgactgatcatttggctataatgcatgcgagtgttgggttggcttcctgaccactgtttggccttgactatccatgatgcatgcacggcggctggttccgtggtccttattcatgccgtatactcctgtgtcccgtcgatcaatatgaagccaattaggagtggggattatcggtttgttaagcggtctacatgttaaaagagacctaaggttgtaattgtcgcggtattgccgtagctccctgtcaatttgcaccacctctgttgtttagtttcaataggaagtttacgatcttagtgcagttttctcctctgtcgatcttgttggatctttgccttaagccattccctttggcgatgtacgggagcttgcctccttgatctgttgctttaatatatgtttaagtttttttaaaaaagataagacaaggagagcggctatcccctgcagttggcagtacaatgatcgaggtcttgtgatcgataatattgaactgatattctccgcactggtagcgtcttgaagctttttcggtcctaatagattgaattgtcagacagtgatggttccgatataaaggggaacatacttcggtcggatatctcccaaagctaaagtcatcggggtatccctcgtcggaagatctttagtggcaattaatgtcttgatgaagattacaaataggctttgtggttgatatgttgttctcggcgggagtatgttggaggaaatatcgacgacgtagcagcaaagaccggaaaagtgatggatttgacttggagaaaagtaaacgttggttgggtcatatctcctaggccagggcaatcatagaagtcgtcatcagaaaatctgcctcgaactcatctcgtcaaaatcttgaagcaccaaatcccctaaacgaatatgatgacgtgtttcaaggttatcttataatgatataatataataaatagttagataccatgaaatttcttcatttaaagacgacatcaagctctaagaacagagtcctgatcgtggtacgtagatgaatgttaagtgcagctttcactatagttcgatgctgcagtttatacaaggtgtacaaaactttggctcgatatagctacaatgtttaacatcaatttgtagaacccaccccaagccttccattctggtgatgtggatccagaaatagccatgatagacagcaaatcatgtcagccagttgcgcgatccaagcagagatcagatccttgtccttggtgctatcacgttcagtgactctgtggattaggtgcaggacaacatggataaggttgtgcaacgcaggtacgagaagatgactaagtctgagtgtcgggaacttatcccttgcgtactgaaaacgaaataaatttattagcacatgattaattaattattaattattttttaaaaaatagattaatataaatgtctctaacggcaagatatacggacgtatgcatgcaagtggagggatacatatgtctgcatatgtctgtgacggcaagatatacggaggtacgcatgcaagcctcagtgacgaattgtggctgcagattgttagcaatacttttagcagacgtacgcatacaagcccataaatcagtcacgaattgaggcggcatattttagcaatactgttatggcatgtacaatgctagtactcctatttaataaccgttctcttcgttgacaaataaataaatttaacgatgtgaaaatccgcatgttcgaaatggcacgacacaattgggcagtggtacaatactatgtacaggagaagtaatagtaataaaatcttagtcaaattgaggggatggatcctaatccctcgagagaattgagatatcctcccgtgtatcttttttttctttcaaatccaatataaataattatcaaaaattatttaaaaaatccaatataaataattgtgaaaattatgaaaaaaaatgattgtttagattatagtgatatttgttagtccaccaaaaataagctcaaattcgacctacatgttaaggaaaaattaaatttaggtgtaaacagtatattgttattcaaacactgaatttatccgtttatatctttgacatgtaagttgagtttggacctaagatttcacggaatgatgtataaatgttgtatgagtgtttccaaaatttttagaattttttataactgatcaaaaggtttttaaacaaacaagggaacatctctttcccctcgagagatcaaaatatatagtttcccgtagaatcaatatagatatgccaccacctcaatttatcaatatcagaatttttttttatttatagcagaatttttaaatcaatgtttaaaatcacctgctgataatactaccaattaagaccatcacaaagttactcaccattgcattgtttttgtgatagcagagcaatataagttaaacatcaccttgattaattcatactccgtttttataaattttgttttgataaagtgatcaaaatatgcctacgtaggataatcccccatggaaaagtaacacaattgactcaattcaatcaaacttttgaaactttaaccatcaacggctcctaaattttttgagtctagaaacataaaaatgatgtgtgtagattttttttataggttctttcataatattatagttttgctacatattagaattatattctaagaaaaatagtggtccaaagttacacacctaaaccaaatatatcaacagtgtcatatatttaaatatggaagcagtaatattttaaaaagaatacattttagaaaaccccatattttatagccagagttgcaaaaagaaaaactaagtattataattggtttttacataacttcagatattatggatctaaagtttaacaagactctgcgcctatacttgttgagtataaatttacttaaaatttttaaaattgaatgtgtatgaacttttaattattgagctctagacagagattgatagttttaccctttgttactaaaattaactgagatttgaataaatgcaatttttataaaatatttaaataattaaatatgcaattatgtgccacgagtcataataatgtatgaaataacaggattgtcatcaattcggttcagcacaaactgagttgggctttgggccacccctacgggcctacggagagtagacagtagaccctatgaacggcccattactacggtacccactgactgcaaagatctcagagaagattgctaattaattcttgcacgaactgggaaaatattctgatgttctaataaccgtgcataagcttagggaccagatgaatctgctgatctaagccacagtaaatctgacgaaacaacaagctatcaatcaggtaaattatttttcgccaatgcattattttccgcttatagataatggatgggctcacagcatgtttcctaaattcctaaatttacggttttgtacaaaacttctgcatcagtatctcttagaaatctatctaaacaaactttcaacttttcaatatttagttatttcatctcagctctcgaatatttatcataacctttagtttcacccataatccatcatccaccagaattttggagcataccccttaagatggaagtagaactggtcacaccatattttcttatctcacttttctttcttcacaacaaaagccaagcatcaggaattatacaacacaacactctagatgagaagctaattcatgttacagttacacacaccaatggaagaggaagaggaagaagaagaagaaagaaatattattgtggggggagatctacaatgctgtgtattgtgactgaccacaccctgctaacctgggtacctgtggcctctgcagagcacctagatattgtcctcatttcatacagctcatccagctgcctgcctatacaaaaccctccggggtatcatctaaatcttttgtactacaacgtgtgtgaggagcatagatcaagatcacctcagggagttcttcagggcgcgcaccgtcatcaccagctgctgcctctcgccttcgacttccgcgaatttcaggcttatctccgagtaccgcccgtgcagttctttgagctcttcctccagtgcagtgttcctctccttcaggatttccagctcctttaccgactgatcatgagctgcatccctacattgattgataattgccaccggcaaagtctgtcagcaatggaccatgtggtactgaattatagaaaggtaaagttttgctatgagtgtagattatacctcctgtcatgcccattgcagtcaccatttgcattgtgtctgttggtgcttggcagcacgttacagctcccggtggtgccgtcgtcatgcttgatgcgcttagaagtagcatggtggttgtcctgaaaaaacacaacattgtgtgtaactttctaggtaccaaagcgtatgattacaatctaagcataggtatgtaaaggacaggcagctcaacaaatatataatatcacatcctagttagcggggacctctattcataaagatatcccctacctatcagaagggatctgtacaactgaatggtgaataaaaacaaatttatctccccatgtgcaaaaggatgtaaatcatgaaaaaaattcttatagaagatagtcctacttatctgtggtcacaactcgcaactacatgagtttttaagagtagcccagcatgctgacttcaatacgaaagggaagttacacctacttgttcaattgtgtggtcttaaggaatacttgtatcattttcttctaacaagtttctgttagttgtgtttggagcaattcaattgtccctaacaacttaaacctgatttggttatagatatgatggagaaaagcatggaaggaatttcaatgaagaaacttaaaaaggagagttagagaactatttgtgctacagaaatatctgattatgcaatatttacctcatctgatttgacaccattttgtttcacatcctccctgctttcaagggctctccgaagcttcagcacttgggaagcaaggttgtgtttctcagagtcgttagtggacatcaaaattttcaggttgtcatactcgaatttcaacgatctaatctctgattgcagcttctcgatcatctcctccttttcattctttgaactttttaaagtgtttatctcctctaaatatgtctgcacttggtccttgattgaagcaagttctttgttgagcaaagctatctcagcatctctatcctgcaagaacatatccttttgacaatttgcagctaattccttgtccttctgctcattctcttcgaagagattgtctcgttcatttgacagattctcaatcttagctttgagttgatctatttcttctgagagaacacttaactttgcttcgttgcatctcttctgattctggaactcatcactcttgcttttaagctccattaccagcctgtctgtctcctttgacttgaaatccactaaggtcagtaactgttgaaccttcactcggtgttgttcttggattgatccaagatcttcttgtgccttctgtagtaattcttccaactggcccttctgtaactgtagctctgcagcctcttttctagcttgcataagcaactgttcatttgcgctgaaagcagaggaaacttgtgaagacaacatcttgaattcctcctggagtcgttcagcagtagtggcattgttccatcttgctttcctcagggactcctcggcctttatggccctttgctcttgttcaacctttgcacgcattacctcttgtatgtcagcctctaatcttttggattgttcctggagttcattctccaggctctcaacattggcttcaagatcgcttattatagacaaatgtgctgaacactcgtactgcatccttagctgctccctcaactgtgtttgctccagcctagaagagatgtcatggttctcttgcttcaggatctcatagtcaagtgcaagttgctccatttgcatctcgaggtcttcacggtccttcttatacaactcgatttcattgctcagctcaacaattttattttgaagttcagaggtagcgatgccatcggttgtctttgccaatgcatccagcatcagctcatcttctttctcttgaactgaacttgtttcagatatgtctattttgtgtccagcattatgcacatttgacaatgctagctcatattcagcctcctggggatcctccagtgtttcttcatgcaaaagtgatatctccttgttcttctgctccagcatctcatcaagatccttcacagccagaagtagctcagagttggattcctgcattttctgcaattgtaaatgcagatctccatttagattcttctcatggcccagttcttgctttagctcttcaatctgcgaccacgggtcttccccgcttgatagtcttttaccagatccgtttgcatcatggatagtctttttcatccctctgagtgcttcacattctcttctgagagcatccctctcatccctcaagctacccacttccttggaaagatcttgccctcgtcgactctccttcacaatttgctttctcagtgtttgcaactccatatcggagacatccaatttccgcgtcaaagtggctatctcacttcttagcttctccacatcatcctctgcctccctcaaccccgcctcaccggagttgctggttgacccgtcggtgctagcatcaggagctgagcttcccgaccagtcaccggagctggtcaatgtgttcctcaggggtgagagggtattggtgccctcctgaagaaatgtgctgtgcatacttgcattgtttttgggggtaaatctccctgagctcccatctgaacccgacaccgaaatggcatcaaagctgttggaattgtgaaggtgatcgacaggcccacgcatgtttcttctcgctgaaaacctcatcccaggaggtttgtttatcaccaatccgtcctgtaaaagagatcaccacaaaaacaggcgaaagtcagatcctacatccattgttcagtgccaaaatctcacccttctcaagcaaaaagtgaaacgatatgattaaagttcagcaagagaaattctgatctcaaacagttcagcacaaaaaattctgatctcaaacaaaaaatatcacacagcaacaaaaaaaaaattaaaacagtacgattcaagttcagcaagagaaattctgatctcgaacagttcagcatgaaaaattctgatctcaaacaaaaaagaaaaatcacacatcaacaaaaacttcccaaatgatcaatcacaaaaatgtaagctccctttcccctctttttcttttgcaatcttctttgcatgccaaaagccttcttttttatccatcaccaaaacgaaacaaagcaatgcaatgatgatgcacgaaaaaggaaaagctctcaagaacacctccaatccttacttgcatagggctcatcgcatccgccgccgccgccgccgccctcgccttctccgcctcctcgtcctcgcaccggctcagctggctctgcagcgtcttcctcggcggcgtcctcgccaccaccggcgacacgtcgccgccgttctcactgccacacagcaagaacaatcactcacctcaaatgcctaaatctggttgagctcagagcacaatgcagcagcagcaatggcgaaatctgctgcggcagccgcagaagaagaaggagaagaagagatggtcgagattaaacaaccaccagcaacacacccacctggcgtcgtcaccgcacccaccgccgccgccgccaccaccacccaccacccgctggatggtcacctgtcacagggtacaagcaccaccaacatgagccccccaagaaccaccgcgagcgcgtcgccgtcaaagctcacaggaaaaacaatcgccgatcctttttaagggagagagagagagattgaggtgagattgggacgaggtgctcacgtgcagctgcgcgccggggctgccgctgagcggcagcgtgacgatccacggcttgaacgcgtcggcgtactcggacaggttcagcgtcgcctccccgagcagcgccgccttggtcgagccctgcattgtgcggcgggtgagacaaatcgtcgagcacatgacgggcaagcgagaagcgggggggtgagtaatggcggtgtcggtggcggtgggcggtggcggcgaggagagggaacgcaccgtgtcgtagacgaggaactggtagatcttgtccttgccggaggaagggagcttggtggcctcgtagaccggggcgggccactggcacgcgccgtcggcgacctgcgcgctctccgtcctcgccgtcggccggcccgcgtcccgcggcgtcaccaccaccatcatcgcctcccatcccacctccggcacctgaaatcaacccacccaaccaacccaaatcatcatcacaaaaccaacaaatcaacaacaacaaaaattcttcgctcgtcgcggcgagcaaattaattatccgtgcctgcgtggcgtggaactgcagcttgaacaccgccttcgccttccccccgcccccgccgccgccgcgccaccgcgccgacttgaacatcccgaccaatcagtctcaaccaagaagaaggcacagctcgctcgcctgtgcggcgctaagcttcttcttcaccggcggccgcattgcaatgcctccgcctccgcgcgacgccgtggcattgctagctgctacagcgagaggaggaaagacgaagagcaagacagcgagcaagtgagcgagtgggtggcacactgacacagccagcaacggcaagcaaggcaaggcaaagcaaaacaacggcaacagcaaagcaagccacacagatctagtgagagaaagagagagatagagagagagagagatcaactgaattttctctctctactactactacttgagctctgcttttggtccctttctctctttctctctctgtgatttgtgggggggtttagggggaagaagagaagaacaagaaagagaaggttctgagggctataaaaatggcggtcaattgttcggggcgatggactagtagtagcagtaggggtttattagagctaacagagagtgtgattggcgatggcgatggcgatggagtctggtggaactgtgcaagagacgagcacactactatacacaaaaaaaaacaatctttttttcagatattacacaaagaaactttttttttttagaaatataagactagtcccaacccaaaacactaagatatagtttttataaagtcacactatcaagaaactagtaatagacaccactctttcaatgcaaacaccacttttttttacttaaattaaatttaatgatacttatcatacatgatgttttgaatgttgtgtggaaaccatgtctcaagcaagatctggtttccttcccttttctcatttattcacttacgacatcatcttttattttagatgacagcttatttaatgctatagacatctcattaacttaaaaatggcctaatcgtgcaaaaaaaaaaagatcgatcttttcttcttctttttttcccgaaatcgagtctagtctcaagtctcaactgcagttgcagtagtataggagtacagccgttgcgttgcgtgagcgtcacagctgcagcggctgcggtcgtctgcagctgcggggacctgccgacggcaacggttgctctgcgtgaaggggatcgatgttgggtgttgggttcttggatccatcgatttgtcagtggcttattgtacttgcttgagacctaagcctcccctcctctcctctttggagttactgcctccatcttgtactagcatcatccatttgtctagtaaaaagtttgtttctgaagtaaattatactgctcccaatacgcatttaattgaagtattctatctgttcaataaaaaaacaaatctagtatgagatataacatatactaatattacgaatcttaacaaaccttgtatccaaaatttatagttgtcacatcccgtactactagaaaatctatcttatttcagcacactactaatttatcctattactactagaagtggtgtttttttttgttgacggagtgagtagcatgaaatatcttctcgcaaattactaatgtgtgctaagagcaggtacaatagtagactataagccagctataaagaaagagagagaagagcagtgagctacatatctgtagccagctgcagcacggacttcaagacgtaatgtgtgtatggcaggtgggaccaggtattaatagtatagtaagcaactattgtatgaattggctattacgttgggtatagatgatttggagctagcagtgggttatactattaaacttgttctaagtgtggtcgatgttgatgtcaaatcgcaatggtgtgatcttgctgtcattgggtgagattaggggaggggagtttggtggttgcatttcataggatatcgatgaaaccttcacgaatctgttgaaaatgtgttggagagttttgtagtttgttgcgagcattggaaaggattcattgagggtattaatgtggaagtgtaatgggtagtctatgtttgaggtcaaaatgtagtgaagcatatgatgtcattgaagtttagagcggtggcaatgatgacattacttcttgtctttttcaatagagtacaaaaaacacgttgaaatattatttaatttaagagtgttatttaaagttgtgtttttatctaattaataaaatggtggattaatgcaacacacttccccgaatttatggtgagatttttattaaaattttatgcatacaaatttctttaaataatcatttaaaatatattttcaactttgtgatacttaattaatttatatgtatcttcctcgaaaaaatttcatccatcttcaatgaatggaaaaaaaaggacgatcaagataaactaatcagtaaatgatgatgtaacaaatatcaaattaattactatgcagaagaacttatcaaacgcatacacgtccgattgcaagcaacacctcgtacacaaagccacggtcgatggatgtacatttcatcgcagcgtaaccacctacaaaatgaaatcccaacaaacacaattaattagtttcgtatagacaatccccaatcccagcaacaccattagagcaagtttaatagtatagccaactactaactccaattcatctatagccaatctagtagctcatttatacaatagttacatactacactattaatacatgatcccacatatcatatatacactgcgtcttagagtctgtgctacagctggctacaaatctgtagtccgctgctcttccctctctttatttatctccttatagctaacttatagccttctattgtacctgctcttacaccaccaatgacccatccaaccgtgcatgctccccaaattctggaggcaatggagcatggtggaaccatgcagccagccatggcaagcaggcaaaagcacaacgatgatgcttacaactcgacaagaacaattcaaacgaggacgagaaatggtgcacgtacgatgggtcagatcatgggtaggaaggatttcaggtgagcctagctgtgcttgtccatgccggccttcgctggttgtgtcattgtgtgacctcacctcacctgaattcttttctgattcaggcaaattctacctttggttttcattaaaacgttgtgttttatgtgaagttttcctataaaaaagttactctaaaatatcaaataaatctgcttttttataatttgtaataattaaaactcaattaactatataatgataactttcttactccctctgtagtaaaaatacaagggatttttggtggatgtaacgcatcctagtactacgaatccgaacagatagtattaggatgtgttaaattcacctaaaatctcttacggagtatattttagaacggatggagtattttattcgccctgctactacttagggcatcttttgccgggggccggttgtgtggctgacaggtgggtctcacgcggcagccccggcatggtgcctggggggccttggcgcatgtggaggttgctctgcactgatctactcctatccatccatccgtcgccttttacaacgcgatcggcgtgcattgcttttttgtgttttttcgtcgtgcttttgctggcaaccaacctcagcaagttatttcatccatccatccatccatcccgaatgtgatctgctttgatgaacacagcaacagcacgtatacccaaaaaagggaaaggtattcttacacatgtacacacatggtgcgtatgtacatctaaagaaggagcatatatccaaacagctagtatctactactatctagtacattgctcaaacagagtagtggtactagtgtactatatataccggtggttttttcctacttgtatatacatcgtacacatggttacttgaataatcatatgatatcaaccataaattagtgtattattgatataattagctctccgttctttgttggtggttaattgtactaattgatatatgaatgaaatggacaaatagcagaaagttattcttgcaactctagttacaaaataacaaaggacattttattcttccttcaaaacggtgaaagctggcacagtttttcgagaaggatatttttttagccgggctctatatctaaccggatatatgcagccattttaatcatgaacttaacctatcgaataggaaacttagccctcaaataactcaatctgaaattcactcctatgaagatttgaactcaggaccttgggtgctactcatgtcactgcaaccactaggctacatgccatttcacgcacagtttttcttataaacacgatcactatagttaggctcacctaagttcagaacatttaatttatactgttaaacgtagaaatgcctataccatgtagtaaaataacctatgattgacttataaagatataacataaagaagaataatgtactagatatttttaaatgttttgtgctagctaacagaaactaaaaggttgagagtagttgcagcacaatttgtagctgattattatagaaaaagagtggttctccctccaatgtaatgcttatgtgctagtatatatattactagttttctatttagtcggtgatgcagtcgtgcatcatgcaaactcatctccaaccatctattatgtattttcttttgttccactttttataagagccatcagtttattttgacttttgagctagcttctccagaaaaatccaataatcttttttccctgatctaaatatggggcccctgcattttttctgatataaacaacatcctagttactgaaactgtcggtgcgtagctgatgtgctttcttcatgtacacttagcttaatcaggccactaattaattgactgaacacctttgactactatacaacacagtctctctctcacacacacactgtacttgcttcatccacaaacaagagatatattctataggtgtgcacagtcgtatatagaatcatataaaaatcatacgtgtagagatttgtctctcgaggaattattttaaatgacagtagcacaatgcaaattagtaggtctaaacagtacatgaatttggttaatgccagctgtttggagatgtatatataacctaattaaattttggctaatcatttacttattgtgagagggagcagtactgaaaaccagctcaaatatattgattgattggggctaggcaaaccaaccatatggggacctaactaatccaatcttaggttagcgtaagaagattataaaaaaaaataattgtgaaagggaaagaccaataggtatgactcgactgggaatcctgtagcatctacagagttaatagttttttaattaaaaaaatgtgtgcaactctcactcataagtggccccagcacattcttgatatgtttaagctagttatggcaacaaaatagctgcacttgccatcaccgttgattaatgtactgtccattggaaaaacactgattacatactactttaatacttcctctatctaaaatatatagcaaaccaaatttaaaattaacataatatagtactacgaatctaatcatattatataaaatccagtactaaattgctatattttagaatagatggtacattatattcattctgtcaaagaaaacttctgacataatatagatttgtagtgtaatactttaaagcattagacatgaatatcttcttaaaatttggattagatgtataaaaaccatatacgtagatttgttaaaaaaaatataccagtattttaaaatattatagaccgtgtcaatgtccaaaacaatatttttttaacatattgaacaatagttctaggatgtttggctaaaaacttattcggacttttttttttacagagcaagcacaacttctagcctctgcagtaacaaacaatgtgtgcatagcactggacgaaaacgacggtttaaaactttaaataatcactgtgctgcagcatcaatcaagtttgggttgaactaaacagttattacagctaaggtggtacacaggattaattagctgtttggcacggtattgtggttgaaaagctacggcatctgctggtcctaaaaccccacattaacccagtaatctcacgatcacgtgcaaccatagataaccaccactagtactagctatacacacaggctgcagctgatcgatcagatcacccaaatgaaaaaaaattcagaaataaattaattcagggaatatgtagctgctgctggtagtgtgtgctgcaaatggataattgatatggatatgtatgcgatgcaatggatggtccctgctgattagcaagagaaaaggttttgattaattagcagctggaaacgctttctaaaagcagagggtccagcttcaatgggtggatggatgggttggatggaggcttggatcctctgctcatgatgcctcggccgacagtggtttctctgtcggtttagatgttaacctctaggctttgttgctacaaagtattgacataatcatacctgtatttcgtttaagtgtacatagttcttctagttaatttatatatgtaaaatttttacatatttttatttaattagttactgaaaaaagattgatgtaccagtgttgacgttacgatattgatgttacagcattataaggtagacatttatattttagtacgaatctaataatatttatcataaaaacaattggatcatatgaatgacaattaaataagcactagctacttcgaaacataagatgtagacacaattagatcctacgaggttttagtttatattactcctacaagtttacattgctggaatagcacacaaaagaggtactggcagtgaccatagcatttatatatgcagcaataacaaattgtccctgacaaaatactttaatctatcctattaaaaaacaatcctagggatgcaggattgaatttacagagagagtatactagctgaacattttttttggtttacttgacgaagaatcaaggcatcccgacacactgatcgaggattgaactaccactgatttttgcctttttgcctccaattctaccagtactacgtacggaaacctaaagcctataattactttcgaaaatttcgtactcctactatactgaattttagattaaccgtacagtgtactacatactcgtagtttagtcagtacggttcgcgtagataactatcgatcgaaaagcaaattaatgcatctggacaaactcatcaacgatagtcacttacacgcggggccagataaattaaaattatacagctcagcttcatcacttgcttgatactacttcagctgaagccaaatttgttattaaaaaaaagctgaagacaaatttaagttttaaaacttaattttatatagttggttttaaggttctattatcatactaagaacacaaacatacaaaacattatctatcttcgtttttttttcggttatcacccgtagagtgaactataggtgctaagtgaataataataggatatatatacacgatattaacagaggcaattaatggttgtatttcaatacttactttcccgtctcaaagtatagccattttttaggtcggcacagttattaagaaagtactccctccattccataatataaggcacaaccattttttttagatgttccataatataaggcatacatgcatgcatgccattaactatgacaattctccattaaattactattttttaaaatccttcactctcatattctctaactctattggatgcatgtattacatttattaggatgatccaaactacaaggtgataataactatttcttggtctttgggttaagggtggttgtgccttatattttggaatggatggagtatgtgagaatgattggaggaaatatgtgattagttgaaaagagaaagtagatgaagaagaatggttgtgattggttgagaggacgaggtaggtgaagaaatagcttcatttgagataaggcactgtgctagaaatagctacgatattttatgacggaggtagtaccaagctttaatttggtggcgacaatcctacagtaaggttttgcactaccaacttattagagcagagttaaaaaaatgtagtatttagtttttctatataggattcggtagaaggtttgatatgatatattaccaaaatttcgtcactatcaaattttgacatgtaacaaaacccaatcaagatacactgtatgacatctagggagcatcatacacagtaccttgtcttctgcacaactattgtaccagattatactttagttcattggatccatagctttgctgttattgggtgtggcacccttgttaataaagatcattgtactgctccacttttgtctttagagcctttgctacctttgcttcgtccatgttttctccttagagcaagtataatagttggctttaagccgactaaatgctgaggtggaggagagagatgagaagcgggctgtaaacttacagccggcttgtacacaagaaccaagaaactatgtgagagacaagtgggccctatatataggtgggttaagagaaagctacaaagaatcttatagccaacaagtcggctgtattattaaccttgctcttataaaaatcttctggtttttgtgaatgtactactctagctaacaaagtctcaataatagtcagaacaatgcaagtacaatagattaagtaatcttaaatctttttctcagtgcacatgactcatgttttcacaacaaaaaagaacaaaaaaagaagcaaagtcagagaagtgggtttagatttttggaatcattgtatggtgtgccgtacttcagagcagaggtagttcttgccagcccaacggtcacttttccaacagacagaatgtgggccctgccatattttttatattttcttttttcatttctatatacttttagatgttctagtatttcatgattgtattgagaaaaggatgtctcaactacaagaaaattaatttcctcccatttgacaatctctgatgcatatatgccgttgcagggtaggtgtaggtatggatttggaaatgtgcttgtacaatagcatcaggacagggaaatggatgttggagacagattgttagggtttgtttttgtctatatgatggtggagtttgctgatccatccattatatctttttttaggccactctgtagggcatcttatgttatgcctgcatgatcagtgccacatactgcaaaagatttgtactttaattttctggtgtcattagcagataattaaaacttggtctgttgaagtggaggatgatgaaattcgaataatccatagttaatgtgcattgacaaaattttcagaagttattcataccaagggctcgtttggatcacttaaattttacaggattctcagaagatttagatcatgtttggcacaactccgttcctagatccgcgctagattttgacttttgtagttttacaatgatttaaaattctatattttatctaaaatcaggaagaagaaggtttatctaaatgttattaatgtaatcagtaatcccagatcttagatttctagaattagaagaaaaaacgtagcttaaaaagtttctatgagttcctctgaagtttctcaatcaaaggagacctaaaaccgtgtaatccttgatcttcttctacacacaatagtataatactccactacaaatcctacttgtgcagatatcacactttggacagaggactgaactgaattagacagtagttaaatttggcgacgcattgaaacgatactgtccgagttgttcagcaaatttatggctccagctagctctacatgccaattaagctcacctctagccattaatctcagtactcagcttctctgaaaacagagtgatcagctgtacattgcagtgcaaagaaaggaccctgcttgtttcatggccatgtggccgctgtgcttagctgcagcgactgcaggtacaagcaacctgaattccttgttggcccaagcacagctaaatctactgctcttcactgctactcgtacactcagagggtgtttagatccagaggtgtaaagttttgatgtgtcacatcgggtattatatagggtatcatatgaaatgttcgggcactaataaaaaactaattacagaatccgtcagtaaaccacgagacaaatttattaagcctaattaatccgttattagcaaaggtttactgtagcaccacattatcaaatcatggagcaattagacttaaaagattcgtctcgcaaattagtcacaatctgtgcaattaattattttttcaacttatatttaatacttcatatatatattcaaacgttcgatctgatagggtgaaaaattttgaggtgagatctaaatcagggccttaacacatgcatcttgtgcagggtagggattttttttagataaaggttgtgcagggtagggtttatgtgtactgttggttcagattgaatgctggtaagagagtcataattgattttcagagataacggttaggattatactgttagatatttcatccgtcccaaaataaatttatttttcatctatctcacacatatcaatacaaaaccataaatactaaaataccttcaatgtatcaaatcacaatgcggttatttctctttttatctactcctaatgtatttatcacctacttttacaaattctaatgctatgatagtttaaaataaacgtattttgaaacaaacagaaaaaaaaatgatattattatgagatggagggactagtcgattttgttggttaatgctagggctaggcaatgatccatgatgcgtacattgcattgatcatcctaccagttggaacagcaaggctatggacaatgattcacacttggctgtttgcataaaacggtcggaagaaaaaaggcagcaagacaagctctcctccatgtcccagttgcagtacaaggttttggtgtttgtcagtagtcaagggtcagacgcagggttcacgtctttgggtgtgtttagtttgggaaaagaaatttttttgtgtgtcacatcggatgtttgatcggatgttggaaggggttttcggaataccacaaaatttctaggactcgacgcgagactaaagtacattctaagagaaaaaaattaaatggttttcataagttcaaatttgaaacaataaatctaaccaaaacttgatcaaaatttgacgaaaatcgttaatgccgctgtttggagttgtttagccgccgcagtagtttttgttttcttagccgcattttttttgtttttttttcttttcctggcataggcttgtctggccgattaagttgtgtaacaaaaactctttttctttctaatatattgatgtgcaatctattttgcgtgttcacgaagaagaaaggtaaactctaatcagaccaaacaataagcacaactagataaattaactttaaaaggtgaaagaaaaaagaaaggctaagagcaactctaaaaatttatccatcttactctccaagataaaatttcataaacttgggaaaaaaacatccttcaacatacttatcatttaacttgccaagtcaaatggctggccaaatttctcacttggctagccaaatctagcgcgttgaaaccatttgtcaaacatggatcccaacacttgccaaaggggaggaaggaatgtgaggctaatgtatggttccctatcatagactcacgacagagaatgtagatggagagattgtcggagcacaaatgaaatattgagacgattttttttatcaacttataccaaatactcctacaaagatggaggcctgatttaagtaggctgttggagatgctctaaatcaaacaatacaagtcagcaatcaaacgcagttcaccattacacaccgcaatcaactactccatccgtcccaaaatataagagatttatgttagatgtggcacatcctagtacgatgaatctgaattggctcttagtccatatttgtagtactaagatgtggatgagcctgtttagattcgtggtcctgttcgagaacccaacagatgggagattaagttttggatttttatggcacgctttttaaactgttaaacggtacgtttcgtgcaaaaaaatttctatatgaaagttgttctaaaatatcaaattaatccattttttaagtttataataattaaaactcaattaatcacaagttattaccaccttattttacgtaaaacacttaatctttatctttattttcatcttcagttgattcaaacacagcttaaaaccactgaataacctagctctagctggtgctgctctcctgggccgattgccatacacacgccgcaaatgcgcagcacgtactactactacctgctcacaccgcgttgaccatgagctctgcgtgctcgagccctccatgcctctccatgtggcgcaatcgatgcgatacgaagccgcctgaaaaaaaaaaaaaaaaaagtggaacacggcgttttctctccatgatttctcgttgcctcttgcctatttcgccgatagatcgcacagacggatcatctcgatcgagtccgagtcgagtccaccccgtgatcatttacgcggcctcacgccctgcatttgccgccgctagtgcgatcgattccgacgcaaacgcagctggatggatgatgcatagggattcaagtggatcgaaccgtaaattcatttatagataaaattagtaggtaatttatagattaactaataagttatccactaatttagtctataagttagtttaaggtagtcctacttgtatcccagaaagccggacctccgatacggtaactcgtgggttatccacttatttgatcttttaagcgggttcatgggtcggttcacttatattgttaatgatgtgtcgggcacgggcgtgtcggcattatcaaaaaacgcagtcaactcaactcaattcaattccgtgtgtagttaagtgtgctcactgctcaccctgtcctaagttggattagtgtacaattagtgtatgcaactcttgagcctgaccttactctggagtctggaggaggactggagtaggatgcagagacactgtcccagcggttctgtcagggtcaggaccatccggatcatccagctttatctcatctccctgctggtaggattcgagcaaattaaatattcgatttctgaataactaacattttctgctacactttttgtataactaactcttttagttgatttttttcttataactgttgttctacataggctgaatttgttctacatgaagaaaaatatcaggattagtgtggttctatcagcttgatgtaaaagcttgctttatcttaagaaaaataagtatcaaaatggcttactgaatgcctgaatcttactgagggtttgtactttgtagtactagaacaacagatagatggtgatcctgaaagcatctttttgatttcatgaatagtggcagtgaaaattaaggcgattaacgcgtacattttgtttctctgtcaagactattattcatagattagttgtcctatcgctgcataatgatctctttcaggtaaagcaggtgcatgatacttttactaccccacacagttctttcacaaaagctgacagtgaaacacattaattggtcccctttcttttttatgcctcagaaggtgacatgttattgttgctttcatcgctgatcatctcacatagagatctagcattggttggttggtctgatatatactttgatagggtggtttctctcccttttccttcacatgcactttttttttctgaattttccctcttgttggaaagtgccatggatgtactttgtgataatatgatgcggcacctataacttaccagtaagatgttaaaatcaaggttagccaaagctaatctggtagcaagtgtgaagcatgaaccaccggccttggcctgcattgcaacagaaagaataaaatgaattggcagagcattttctttaaaaaatgtatatattctactttacacagaactgttaggctgttagctagcttgccttcaaggtaggaaaacactcatgctgtcatgcatcagaagcttgctgttggagccttgcatggttccaagcagaaagaaaaggagaggttggggatttctttgctgatatgctcatatgcagatgtacttgcgtgacctgaacttgtttattatcaatggttttcacttttcagctcatcctgtcagagaaacaatgcagaatgagatgggccagtaataactgtaataacttgccattggtgaaaacatctgttctactatattttcaatgcttccagttggaaaggtgcgtaggtagttgaactactgaagaagtctgatgagcagatttttttttcacaggctcaataggttagcatgtaaggccaagaaggttaaccaaaagaagatctgcagactgaagctaagtactgaataaagcaatgcttcataagctcaaattgatatagctttcaatgcaagtgaaactgtgtatgaatagaagtatagatagaaccactcacaagtcacaaccaagtcacaaactcacaatgtatagtgtacagttttcctctgaaagtgtacagtagtagtttgtggtgttaataaaggcagaggtgaggttgtgtatgagtctgagcttagaagacatgacaagagagaaagaaaagagcaggatttcttggatgccttggcacgtacagtgcttccaacaatgccaagatttttcttctcccatgttaagcattttgatccattaggacatggcttaaaatggcatgtgagatctcctcggactgaacgcaatatcaacctgatgaatcacctacccccgtttcagatagattattgatcgaatcattgctacagataagaataggttaaatattttgagaaataaacttaatagataatccctccgtattttaatgtatgacgccgttgacttttagatcaacatttgaccattcatcttatttaaattttttgtgtaaatataaaaatatttatgtcatgcttaaagaacatttgatgataaatcaaatcacaatacaataaataataattacataattttttttaataatacgaatggtcaaacgttggtcaaaaagtcaacagtgttatatattaaaatacggaggaagtagcttataataacaagtgataatgtgcagtggtagaaggtttctttgagaaaacatattttagagacacgtagcaaataatccgcagcaataatctggtaaccgactagctagcagaacaaacagcatacaattcacatgacatacctgaacattttttctttgtatgtgtatacagacatatctgaaactctgaactaccattcatgattcatccaatccacatcatccggtttgccttgttctgatctttgacataacaagcaaacgagtctctgaatcgaaatagaaccaaagactgaacaagacaatacatacagttgtgcacgctcgttgctatcgttgatccaagagatggcacgcggctggatccgacgacgggtggatcggacagaacgaccctgccgctgccgcattcatggccggttgccccggttaggtgccccgtcgccgtcgctggcgtctgccggccgtcaggcttcgtcggatgccgcgagcgggagggaagcgcgcgcgcgcgcgtgcagcggaaatcagagatccgggggaggacgaagaaacgaaggtttcctcgaactcgaagggttcgatcggagacgccgatggggtggtggtcttcttcatccggcgaactggcgggtcgccgtcgtcaccgccgccgttgtcgccggagggatcgaggaggagacagtaaggatggggccacctgtcagtgacgccgaactaccggagccttctttttttttttccttttttgcacgtctcgtttaccggaataccatttcggcccagtggcgtgtagaatttttttagcccatataagatcaccacggccaaggacagcgtcgcaagtggcccggtaacatcggatgggccagactgccatagtaatgtcggcccgctggtcagtgacaccgaacgggcatttaactttttatcacttttaagatgtgacaattaagaatttatcacccacactctatgatatgtaggtcctcgtgtgtctataacatatgggtctagtaacaaatcattaattgtcactttgtaaaagtggcaaatagttaaatatatcttgggagggggagggaagagggggaggagggagacgctgacaggtggtcccacgtggggctcatgttggcggctgttaagagccaaatttgtaccgccaatatctacataaaactcaaataatgaaacatctaacatagtgatatgattcatttctagcatattccacgagcgtccagaagttgggaggaattacagactaatgtgaaggagaattgaccttaagaaataccaacaccacactcatcacgtcagccaaaaccaaccactataatgctgatagactaaagttgacatggtattgtgag

SEQ ID NO: 58483 - DNA, 23033 bp, Oryza sativa
tggcccaaaggaggaagaggattatttttaggtttttctttttaataaactttgataattgtttttgttgcttaataattatttccggtgctctgaaaattcaagtaaaatttgagggctctttttagaccaaggagaatttaacaaaaattccccgggccacatttgaatttttctggcacgtattttagtgtttgccaatttcttttcgaatttttaattaattctattattccttttagcgaatgatttttattctcgggatgaatttatcaggacgtgacacgtgagcctcctcccgacaactaaaacttgactcacaaggagtttttgtgaaataaatcactttgccaaaagggcagctttcgcaaataaaaccttagcctccttgtttaaaccgaacatatcattctttcccctggcttgctgagtacgttaaatactcacccttgccccttataataagctatagagttcgaagacgaagacgtcgacccgaccgttgaggagtatctctacgagcaagccgagtatgaagacttctagatgtttcgtgcctagccccaagcctcgcctgtggaataagttagttgcctaggttctttgcctagtgcatagttgcttagtcgcttagtctgtccgcgttgttcgcttatgtaccatcgctttatgtttttctatgatgttgtgttttcatctatggacctatccatgatggcaactttgtaaggactactacccagtgatgtaataaagtagttacttagattccacatttattttgtgtgtaccagctagtgtatcctgggactggtaccatctcacaagtaatgcataacaccctggtgtgagttagctgtgtttatggctaacgaatgtcaaggcgttacaatcaagcagtgggcaaggtgggagtaggccctcgaagtgaaatacccaagcctcgatcactagggtagttcttccttcaatccaaaggtggtgaattctaaaccactcacaaccggcgctgggccttctccacaatctccttggagaggtcaccaggcaacacctccacaagccgtctaggagacggcaacctccaagagtaacaagcgatgacccggctcgcagatgatcaagcgccacactatctttgcaatcaagcaaatgcacttgactcttgactaatcaaccctcaatcacacctaatagatgaacacaagcactagagagtgtgagagagtgtgagagagtgtgcaaagggtgtatgcaagagaagcaagtgccaagagagtccccttgctgctggtgggggagtgtttatacccccaccaacaaaacctagccattagaggagaaatccctcaactatgtgcactgccgatcagatcgccattgtctggcaggtcagaccgaactactttgtaacggctagaaaactagccattacagtgcaattattgatcccactcagcccaaccggtcagaccgccatacggtggccggtcagactggccacggctcggtcagaccggccatggctcggtcagaccgccactagctctgtctgaccgactgtggctctggcggctcgggttttccaccccagagcacaccacctaggcccacagccaccttccaaggggtcggtcagaccggcattgagccatcggtcagaccaacatctacccgccagtcagaccagccccagacagagagaaatgaatatagattgagaaccaagtctaaatacaaatgacctaatgtggcattttaatcatctctttgtttaggtcattacccctcttgatagtacggcaaagctataaatacaactagcaaattttgatcgcctaactcctcgatcaattaaaataaaaacctctagttttaccatcttcgttccttttgctttgcgccatcgaatttagtccagggtaatcatccatgaacacatatcacgtggtcctaactcaaaatatataactcaagagaacagttagtccacaattagctcttgtcattaattatcaaaattaacaaccggggcctagatgcttcagtcagcgacgaggagtcatgatctttagtacgtgttgaaggaaactgttgtaaagatatatatatatatatatatatatatatatatatatatatatatatatatatatatatatatgtgggattgtgggactcgaactcaagatctctcacctcagccctcacgcgcgttaccatcccacctactacacacatctgacttcgataaagatactttctttttaaactaaccctagagacatctttagtctgggttgatgttaccaaccggtataaaacgtgttgccaaccggtactaaaaatatctttaatccgggttgatgttaccaaccaatactaaagatgcatttttagtaccagttggtgttaccaactggaacttaaggtatgtttagggacttgggcttttcgaactggtactaaagcatatttagtaccggttcatcaggtatatttgtgttttgggactaggataaaagatttctctagtagtgtacggatgtaagaatatgtgctagtgggatttagctttcacgggtgcagagaaatcaatttctaggaacctagcaacggctttcatggtcatttgttgaaccacctttagccaagtatctacaaaaattacgtattgtgcacacgcacaaaagagccatgcatcccatgaaaatactaaacaaagcaaaggctctccatgtcacttctccttttaatcctaacgatcgacccaattcttcaagtactagacaaagcaacggaggatggcaccttatcatgtctaagtggccggcaagctaggatgcgaacatccctctacgcagatgatatcgcaatcttcgtcgcaccaacctaacgggatgttttcatccttagctcaaaccctagaggtctttggtgaatccacgggcttgcactacttagaaaaagcattttacccgatgtggggtctttttttcgcaggcagatatgacccttggagccaaatgaccgcctacaaaaatataaatcggggtgaaattcgctgtcagaccacttaagcggcgcctgcgaaaataattttcgcaggcggaccatttaagcggtccgcatgcaaaaatcgtacctaccccaaaaaaaaaacttaactccttatcttctcctctcaccccctccccatcactcatttccctctcaactctctctctctccctccctcaacacttctcctctccccaccgtccgggcccatcatccccctcccctccctccctccccgccggagggggagcgacggcggtggcgcggacgcagcggcggcggcacggacacggaggcggtggcgtggacggcgactgtggtggtgcggagcctgtggtcggggcgcatttttttgttcgtccagaggattttcgcaggcgggccattgggtgatgattttcgcaggcgtttatctacaggcggtccttcccccgcctagaaaaactacttttggccgcctgcaaaaatgctttttctagtagtgttgagagctaattcacctgcggaagagtcaagtggcaccaattcactgcttttagattaacctaaacaacatcatgacgaacttccttgccacacaaggtgatttcctgatcacctatctaggcctacccctctcgttgacgaaacttgggaaagcgcatcatcaaccgctgataggcaaggcagcatacacgcttcctccttagcagggaaaactcctcaaccatgcgggaagaacaactggtcaaaacggttctcatggcccaggcgatctaccacttaacttcaatcaagttacctaaggccatgttccaagcattggacaagataaaacgaaaactcctttgggccggtagtgtaaacctctccggtgccccccggggggatgcaaaattaactggaatacagaccgaaagacctaagtggtctcggcgcactggaccttcaacgttttgctcgagcactaagctctgcgctggctttggtttgaattggtggcgctagacaaacctttggtgcagcatgccggtgccttgcaaattgcaatgagaaatactacaaggctatgtttaatgcggcaatggaaatcagggtcagcacgacaacaagacgatcttcttgaacgacaaatggttgaatggccaaatcccgtggtccattgcaccgaatatctacgcgtctcaagaaggaagaacatatcagttaactaggctatttcaaacaacaattgggtaggtgacctcctgtctatgcactatgccacggcccagcattttcaacaatttgtcaagctccggatgcaaatccaaacaatcgacctgctgccaaacaccgaagactgcatcaagtggaggttcactgagcacggccaatactcgtccaaatcagcctacatgatacagttcaaaggagcaataaaaatagttttttaagaacatcatatgggacacatgggcaccatcgaagtgcaaattcttcgcctagctaatcatacaaaatattgtttggatggctgacagattacaagcgcgccaatggcccaaccaatggttctgcccactatgctgagctacaccagaatatgtagttcaccttctgatccattgcagattgacaagaagaatttgggactcagtcgcagcaactcagtacaagattggtggaacctcctcctcaccttactgaacgcgccaatgtagcccataaaatccctaatcatccacatctcttgggagctttggaaggaaaaaaaaactccaaagtgttcatggagcttgcaaacacaccaatgagcatcctggcaaaaatcaaggaagaggccacactgggtagcggtaggggtgaaaagcttatctgagttctgtcctctaggagagtagaactcagagttggtccgggataaccgaaactcccaccccttgaggtaaataatgaggtgaaaaattaatgtaggttattccttgatgaaaaaaggcaacagtgcagacaacaaagtcattcctgatgacactgggcgacttcctccacctcgctgcatcaccactctagctcgtccttcccaaatggtgacatgcaagtgatggcgccgcatagtcaccaacgccaacttcctatgttgctttgatcaccccgtccgtggaaggttggcaagtactaccatcactgcctccgatagtcatgtcctaacaactaccatagccgcaccttttgtccgttttacctcaccgctagaaatgattggcctcgatgcaaactacttcttccttgatttcatataacaccccgatgttcggaccgttaaaaactattttaataaaaaaatctattttcaaacattttggttgtttaaatgttattaaggacataagcaccaaaagattttagttgaatccttccttgcgaccattaaaattccccgtccaaaaatccctatcaaaatttcaatcataggatttgaatttctcaattcgaaattactccaaagttcttccaaaatttgggccagcagtataatgacgctagggcaaccggccgctccctcacttctcttgctaccacctctctctgttgtcctctttcgctacccaccacatataaatccgtggtcatcccctcttcttctccaacctcagcccacagcgccgtgcttcaaccctgagctcgccgccaccgcaagggcagactaccactatgggacgcgcttaggctaggccgggcagcccacgggccttcctggccgggcagcccacgggccttttctcctttttcattcctccgatgtccattttacccacctccgacctgaccgtacctgtcatcctctaaatcaaatccaaattattttttcgaaagtcttaattttctataatcccaaaaatgtttttgatttctaagctccatatctttccatctgtagctccgattaatccaattcaagtctcaatttttcttgaaattgagatctatctatcgacgagctatactcgacaatggtatttatagagtatggggtcgtttgtacctagatatacacaagattataataaggagaccaatggaagaacaatgatttatattgatttgggttctcaggatgagtaacaactctactcaagtttatatgtgtatcttgaaaaaaaacaccgtaccatacggattacaaaggggagcaagttagataatctaacctgccgatttggatatgccgagtacgtctcgatgagttggtatcgacaactaaggctctgactcttccagattatctctcaatgtggctttgactatggcttgtgattcgatgtttctcctccccacaacgggccttgtatttgtacggatgtcttctccaagtagaatatgggctgaacaaaaccttgtattctttgggttgaactccaatgtcttttattcccacgaaaacagtttctttcctgactcaccttattaccatacttgaatatacatttccgtatatcacgagaatccatatatgagaggtatgtcttacctgtaacactaactctatctaatactattagttattaataatactacatccgtatcatattataagttgttttgacttctttaagattgactaaatttataaaaaaaattagtaatatctataatacctaaatagttttataaaactaacatttaatatattttaataatatgtttgttttgttttaaaaatggacatatatttttctataaacttgattaaattttaaaagtttgagaaaaaaattaaagtgacttataatataaaacggagggagtagtattttatttttaagttattttggttctctctttttcgtgcgtactcaaacattgacgtacggagattagttccgacgcgaatattcgaagattttgaagatgaagaccgaggcatgtcactctttgattacattgcttccagattatagaatgtttttgcaaaatggtatggctaatgtgaacgataaacctgaccggtcgcttgacgggccaagaacacttttcgacctaaggcatcaatattccgccagcaatattattgcgcttgaaacatcatgcaacgcaaagtgaatgcatgcaactgtcgaaacagttttggaccagccagaatcaatccacatctcatcagcatcgtctcctcccactaatctgatcagcatccgtagcctgcaaagcccgcggccatggcaactcgcaggggtaagccaccccggcatacttgttcctctcatgccaccgctccaccgccatcgtctccagctcgacggagaagagccaagtgtcctccaccggcggcgtcagcagcacatacgccgcgctcgccgcgacaacgatggcttctccgttctgctcctggaagtacccctcgtcgtaccctggcaggccccgtgccgccgccggcaaccaaacccgcttctcgagcacccactcgccgtcgccgtcgagctgcgcgaacaccttgaggtcgttgtttatcacacggaccacgcgcatggcgacgccgtcgccgccggcgatgatccggaacgtccgcttgtcgtagctctcgcggacgttctccgggaacgtcacgagggagaatcccgcggtggtctcgtcgaggacgagcatgtcgccgccttcgtcgccctcgatttcccagtagacgcggccatttgcacgccccacgaagctcgtggcgtcgagccttacatgctctagtgtgacgtcgccaccggcggctgtgctgtgcggtaggcgccagccgccgccgccgctgccggaggtgaacgtgcaggccaatgtctcgctgagagggagaatatagttcagcaggtaacgatcgtagagtgcgcagatgaccttgaagttggacatgccgatgcggccgccgtcgccgtcgccgtcgaggaggaagacgccgaggcactggtaaccgctgaggtcgggaggacagaggataccctggtggcaccgcgtcaggggctcgcagacgacgatgtcggggaaggtgaagcagtggcgccgcgccggtgagccgtcgccggtgcgttgcttcatcttggtgaggaggagaaggccgccgcgggagtcggcgagctcccaggagtagccgctctcgcagtccgggaggaaatcgagggaggagaaccggcggcgatcggtgtcggcgagctcgtcggaggggacgaagacgaagctcctgccaccatcagggaatgcccccggcgccgcctgcctgtcgtacgcgtcgtcgacggtgtggtagtgcccggcgacgtggtgggtcgcgccgtggagtgagcggaaggcgtcgaggaagccggcggcggtgacaacgcggcgccaccgcttgcacgcgtacgccgcgcggacgaggcaggcggaggagccgaggcagaggaggatgtcctggaggaggtggtcggggacgtcgtccacggtcgtcgtcgtcgtcccgccgtcgacgaccttgggtgggtcgaccggcggcttcctccgcgccttgttaagcttgccccctcgccgaccgcggcggcgcgtctccgtcggcgtcgcgtctccgtcggcgtcgccatgggcagtggcaccaggtgtgtgaagacgtgacgtgactgtgtgttagggtcacgcgcgagagagattagtactaagcccacggccacgatctcggtcagcttgtttgactgacgacgcgttttttccttattaagagcgtgtgtagtgtaagcgtggggcgcgcggcaagtacgtcgcgtaaaaagctgactccatatgcgcgtggatagctgcttcgtccgctagaatatctggaaaatgggctgcacatgtattgcatggttgaacgtgcgggtgacgaggaaagcgtacgtgggtcattgtcgaatatgcttcgcatgccactaattaagctcgaatttgattaactgaatcttttcttcttgaaactgattgtgtgtctagctagacggattggcttagaaaatttgggcactactttaaaacaatcatttttgccgtcggacaaatcagttataacacgaggctaatccccgcgaaaatagtgtattttcgtaggtcgcctaagaaagtatttacaaagcgcaaaaaaaaaacctaacaaattcaaaaattccatattcgagcatattcaaatgcccccgatccattcaacaaatttattcatcaaattcatcaaatatcacacaaagcaaaaaaaatttcgcccggtcgaagccgccggcgcagcctgagagccaccacccaacctaccaaagccgctgctagttgaagtcgaagccgctttcgagaacggcctgaggcgtcggtgatggacccgctcacctgagactgctgggtggtggatccatgtgccccaagctagctagcggcggatccaaccgttgtcgtcgtcgcggccgacggtggatccaggcgctgttgccatcgtcgtcgcggccgtcattgttgtcccggccagcggccgatccatgcgcccaaggctagttggtggcggatccagatttttgtcgtcgtcacggtcggcagtggattcatgcactgtcgccaccgtcgtcgtcacggccagcgatagatctacgcaccgtcgccgtggctatcattgtcaccgcctgagggaaaagaggaaggccggatgagttggtgaggggacagggatggaggtggaggagaagaggagatggaggaggatttggccactgttgtaagctcaattctggccataagtgattgcacatatttagtagtagttctgcctagcttcttctctaatgtcaaagggttcaaaagagcatcgattttataacataaatgcatgcatcccttgcatgattttcaaatgattttaaaattttcaaacaaaattttgttgcagaggtcataatatcatcatatagctctcttcatgaacatacaacactaaatccaatctacacattcaagaaaagcaagggccatgtttatatcatcttacaagattaaagggtattattccaatcaatagacacagatgttagggcaacgaccatatatatccaaatcttctacaattcacggtgcaagcgcttaaggtaggtggccacggaagctcacacggatacgcaacacttgcgtacttgcattccgtcacctccatggtctcaaggtcgatggagaccatccatgtcgtcttctcctccaccggcgtcacaacagcacacgacgtgctcaccgtgacgatgtccactccgccgcaaaaacagctctccttgtagccttgtagcctacgagtagcctccaccaaatggaggctcttctcaagaaccaactcatcagtgtcgcacaaccatgtcacaacacggagagtctctccctctaagacgacgacgcgcacgttgtgacggtcgccattgccgtcgacgatagctcgcagctctgaccctcgcacacccgctggcgtgcgtaaaatgtggggatcaatcccattctcatcgagaattagcagtgacccttcgtcttccttgatcgcccagaatatcgagcccccagcatggccaagaaaacgaagggaatccctatcatggagatggataccgggtctggttctgagatgcgtgacgacgacgtaccactcgaaaagcttgggtacctcatcatcttcgtcgggcttcatgtgccgggtccaatcccacatgtcctccatgtactcgcaaacagtaatcgtgccaacatctccggacacaccgaagtatggctggtacaccacgcatgtcaccttgaaattggacatggagaagctgccgttgcggtcgaagtcgaggaggaacacgccgacgcagtggtggtacttcatcacctccatgcgagggatcaccttgtgccgccgtgtgaccggctcgcagacgacgaggtcggggaagcagcggcgcatccagttggatttctttttcttggcgaggaggaggaggctgccacggctatcgacgatctcccaccgcgagccgccaccggggaggaagtcgagggagaagcggcggcggcggcggccggtggtgagaaactccggcgaggtggggacgaacgcgacgctgctgcagcagcctctgggtttgggagtagtgaaggatggtggatggagacggtggtggtagtggcccacgatctgatgcggtggtatgtcgtagtcgaggacgaagctctgttgggtgatgactcggcgccaccgctggcatgtcgccgcggcgcggacgagcgagagagacgaatcgaggttttggaggatgagctccaggagcttgtcggggacgtcgtgcagcgtcgtcggcggtggcctgccattgccggacgctgttgttgaccccttggtcgtcggcctcgccgtcgccggtgctttgctgctgttgtttgtactgcagcaaggagctttctcctttgccatgtataggaggagatcagtactgtactagctacactactggatgttcagatcgatatctaccatggattggctatatgtatatataggttgtaattaagtagccacacgtttgctatcttgtcctacaattaattaaactaatgtttttggtgtgtgatttcgcacatgctagagtagggaagagttccctccaagtagtttcgctagctgctgagttcacattgttttttgtttcaaaagagaagacccagcattgctggtggtgttatattagaattttgcatactttagctagtcagcaaacacgctttatggcaaagacatgtgcctgcatgcgtgactgagtcgtgagtccataggagaaaaaaaggagctgctttctaaaagctagcgagacaagtggagaagaacttatcttatcttctcggcgagaaaatcaagcatatgttcttccgacaagcatctgtacatattaagaacatttcactgtacaggagtattattggagcgctaattttctgagtcgcctgcaaatcaggcgtccgatttttttctcaaaaattggacgctgtgtcactaagtagactgaaaatatttcgctaaatagatcgaaaatgtttcaatcttttaaaaagctgaaacacaacaaaatcacctcataaaacattttgctacaacatatgaaacaacggtttccacaaaatcgggcgttgtttcaccatatataaaaataatattttagcaaatagagaaataatgtttcaattcttaaaaaaaaaagtgaaatacaattagatcgctagatgaaacaatttggtttaacatatgcaaaatgattttaagccattgcaactcttaaaccatctgcatcaacaaaccacgtgtcaatcaagataaaattattaagacagtatcaaaaatctacagcaatttttggtacatacataatgaaacatcatgagtacactagctgaaacattgttggtggaaaaaaaataaaacggattctcctaatagggcgtttccgtaatatgcaggtgatttgctgcaaagcgtgcgtggtgggggtggcgcgtgaggcgtgggagccgcgggagtccgattttttctccccacccccccatcgggcgcccgatggggaggattttccctaattttcttagtcacgaacttaggttatatacatgtgacctaattaagtttatgtgtcgaatttggtaatatttactgaccggtgtttgatgaagccattggagcaagcagtgtaagtaccacacttgataagcttaagtcggcaattaggcctaccaaaagttgtaggaaacaccctccacagtgtatttggctttaaatagagtttttttactgacaataaattttatgattcaactcatgcttttattcatttctgccccaatgctgagaacaattaataatcgcacccccatccccacctatcaacaactcattcgtactttccccatctccaccactccaccgagccaactgatcttctcttctcccactacaactatgccgcatagtcacccaaccgatgagaaacacgactcgtctacctcatcgatggtcgtggccagtgtcgtgcatccttccctttgcagctccttctcttcctcaacagccaattgcctttccccatccacacacgcaaacctgggggtggcgcgaccggcgagctccgacatgcacaaatcaaagccatctctccctctcatgatgacgaggaagtagagaggacgacgaggtgaagaagaagaatgaggggtcgacgtcctcacggttcgtgctgacgatctcgagctcccctcctcatcagcggtctcgagcttcagacccggtgacgattgaggggtcgtgagctcgacagaaactactcgaccacgagtctggcagtggtgcggcatagagctaggggctttctccctggctgccgagacgagctctctttcctccctctcccatggttgcacggggcatgaccattgttggatttagtcccacatcgttaattgatgatgggggagcacgacttaaaaggggggggcaatacttacccatcagactaatcttttgagttgtgtattcccaggagctaaatttgtggctccggttgagcctgtggtggagcaggcccagttgtgacatgggtggcccaccaacaagtggtatcagagcccaagattggaatccggaacaattttcatgggtcacatggtggggagcccaggtaagtcttcggggtcaaatggttaatggtttgatgtgatgcgggaggttgttgggcccgatgtgtgataggggagattattgggtttagtctcacatcggtaattgatgatgggggtgcagtactcacccatcaaactagtttttgagttgtgtaggcccaagacctaaagttgtggctccgattgggcatgtggtagagcaggcccagttgtgacttgggtgtggcccatggttggtggcccggattgcgcactgtaacagctagtgtgggccggtaccgacgatgctgacaaattcttttgaggtacgagtgtctaagtttggatccgcgttcttcatttggtcatgagagagacatatatatacgtgactagaaggcacgcagcggagtgtgcttaacatcctgagctcgccgagtcacggccttgcaggagcatatctcccaatcgctgggccctattggcactagtctatttaaccactgatctagttgtgggccaatatcatagctgagaagtaagcttcccggccttctttctcgacgttgagcgttaccgctgttcatcttcgtccccaacaaaagccgcaatgacatttctccccatggttttgctatgtagttgaactattttcggtaaaaattggagggtaggctagagcctgatggagcctacctgctagaatcgccattgctttcgagtgtagaaggtggtcagaagggtgcgtttggatccaaggctagcaggggcctagcctggccaggccagtcgtttgaaatcagaaaaaaatcctagcctgtgggggcgagctagcccataggagcgagaaaaggctggctcacaagggagagctgaactatagggcttatagatccggtcaatttgcaatcatcctcctccccttgctgaactctcaggcatcctcatcatctgcagtaatcccgtgcccttatataaatgtagtagagcctccagtctccacgtagtaaatcggagagcaaggccaactcgatttgaggagagcttgttcttgcagaagattgctgctggacacaagattgctcgtggtgagaacagagaagctcccagatttgatttcttccaccggcggcgcctcgtctatctagatttgcaggtacgaggacttttttcttttattaaatctctccatattcctgtaatgtggtttggcagccccaggttgttgaggaaatgttgcgatatgtaacgccccgattttcgttcgggattaaaaaaaaatcatttaataatgcattttctagaaattaaataaaagttaaaccaatttaatcaagtggaattatggaggaaattaaaatttcctttaaaaatcattggccaggaatattctgtaatattctttgtgccctaatgtactctctagaattttccgtgaattttcggagctcaagaaataattttaaaagcacaaagttcattttaaccaattaaaaaaaaagaaaaaaaataaaatcccctcccctcccttttaggcttggcccaaaccttcccctcctctcccgtgggccgcgcgcctcctccctctctcggccggcccgtgccttgcgaaagtctgctttacgtcccccggtttccctcctctctctccatccggccgacaggtgggaccgtggaccccacctgtcagctcctccacctacctctcgccggccaaccccaaccgccattgccggccacgtcctgccaaatccggcgccctcccgctcgcgccttcgcgcccaaaccaagtaaaataggttcctcaccacctcctccaccaaatccctcacttttccccaatttttggcgctaaatcgagcccccacttcgcccacgatgtcgcccacgtcgccggccgttgccgcctcaaatccgccacgtccggccacgatttctcctccccaatcctataaaaacgatccccggagcatcctctctcttttcccctcctcacctgagcccgccgcgctctctctcgccctccccatgccgctcccgcgcgccgccgctcggcgtcgacttccagccgtgcgccgccgccgctccagacgccgccgcgttgcgccgccaccaccgttagcctcgttgtcctgagctccatcccggcatccactttatttccccgaaccaccgccgtgatgccgtgcccgcgcgcaacccgagctgccgtcgcttttgccgcctctggccgcctcttgctgcagcgcccaggccagccgtgcctcgtccgctgctcggtcgtcgtcttccgccgctccaacccatcctctaagttcgccggtgagctctacctcttgtcgtcgccatcggccttcatttccagtcaccccgcatcggtcctcccctccctaactccctcttctccttttgaaggtcaagggcgaccccgtccgccctccgtcctcgcaagctgtagacccccgatttcggaaatcggaaatcttctgtgtttatccgtaccaatccctggatctgtagttggtacacacatacatagttggatcacaacatatcatgagtgaatttaggctaaaagagataaatacttacattagggccaggtaggccaacaactatcagagaacaacagcagaaaacaaaataatataagggcccggttaacatgccacaggcagtcgactagggaacgagacttagaacaagaccgcactctgatcatcttgtgggatacgcaagcgtacctacaagggcttctcttcaacactctcctaaaagatatataaatagcaagggtgagtaccaaccgtacttagcaagccaccacaacaacaatgcatatgatagaggatatttcaaggaatggcttcaggttcttctacataaagctaattttacatttcttttcacaaacctaaaatctagcatagactgatcaaattttagtaccagtgttcactttaaataacgacggttctgtccaccatctattgtgatccaaaggatagcttcccgccattgaatcatcgtggttttctaaggatgtccaccttccctcctctcgggaagtggctccatcagcataaaattcatcatgcaatatcccatcccccacaagttaagaatttagagtgtagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccaggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacctattcgagaagtacggttgtacgggggtcgtttcatgcttaacttcatggcccagtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcattattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgacgttgcctcacgactaaccgatatacacaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtctcttaatctttctgttatcatggtggtctatttaggagctagccaatatagtatgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacagtaaattataaaaggttaataattatccatgctttgtatgttagagttgtttaggttaatcatattatggttacagattatcccatcacataattttacaatgagtaatcctaatttacaggttaactataattataattatatgaggtcaagatttataactagtatttatctaatatacatgtttgtcatacactccctcttaatttcatatatgcaacacgcaaattaatactataccgtaccactataatgggatgtatagtatatgtgtaggcaacaatatcttattattggatcatatatttgagtagtttctttttactgtaagctatacaatacatgttgattttaagatggctctgtttggttaactaatggatatcaaccgactctatatatatatattctacttcacatgacattgtatcaactaattttttttaagtggtccaaatacaactagctctgtgattactctcctaaacaagttaaagattcttctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaaatagtgaattatatatcattggaaagcttatgaatttagatgaatttaggttcaagtttcactcaaatcggagctgaaatgaataagttatgctagtgtaaagattcaaatttgaattaattctaataattgcgaaatggtactgctcctaattcatttatttataacacaaccttatccacaagctatagtgactgacaggtggggtcaaggtcttgattttcttttctacagaattatttttctaagggaaattggatggaattaatgataggtggggcccactctaacctctctcccccattctcttttctctctctcttctctgttttctctcttctctccctcccggcttcttctccctcctctctctctcggctctctggcgacaacgaccgagcaaggggaggaggcggcggcttaccgacgacggcggcggcgacggcggcacgatgacagcgacggcgcggcggcacgaaggcggcggtgcggcggcgccagggcggcgcaacggcggcgcacggcgtggcggcacgaaggcggcggcgcggcgtggtggaggggaagggggaaaaaggaggggaaggaggggggagtggtgtgggatggaagggcgaccgggggagggatttatagggcgcggggaggggtggccggctttaaacaacgacggaacggcgtggcgacgtggggcttggggcgacggcgacgcgcggcgacgggacggcgcagcgcgacggcgacagtgcgcggcgcgggtggggctcgaggcgctgatggcgacagcggtgacgcgatgacgcggtagcagcacggggctcggggcgcggcggcggctcgtggcttggtggcgcggcaacggcgcagggcgacggcgacaggatggcgggtgacgcaacggcgcagggcgacgggcgacgcgatgacgacggcggagcgtcgacgggacggcgacgcggcgacgggacggcgtggcgcggcacggggctcggcgcgcggcgatggcgacagggcagtgcggggctcgagacgacggcgacacgacggacgcgacgcgcgggcgcaggacggcgtgacagcggcggcgcgcggcgcgaggcaatgacggcgacggcgcgcggcgcggcagcggcgacgcgacgggcaggcggcgctgcgcggggcgcgaggtggtgtgtgcgcggcgcgaggcgccggggcacggctgcgaagccgacgcaacggcgatggcgacggcgcgcggcgcggcgatgatgtcgatgcgacggcgacgacgacggcacgcgcggaggacggatgtgaccgacgacagcgatggcgcgcggcggtatggagacggcgcggcgacggtgacatgacgcggtggcgcggcagggcgactgcggtgacaagacggcgcacggcggcgcggggcgcaaggcagcggcgcagcagagggcggcagcggcgtggcgcgcgcaggggcggcgcggggagcgagggggagcacggcagaggaggggtggtggttagggaaccaaatcaaacacctagagggctaatgaacagtgctagccaactgtttttgattttatagggtattttgcaattaggaaaaatatactattgccactaattttgtcacaatgtaaaatacaccaagcctaagttaatccatcgaaatttgtattcaaatttaatattgaacatatttttatttttattatatatttttctaagtattcctatttttagggctttggtttatttataaattgagaaaagttgcaaattaaatttgtatttactcctaagcagttgagtgactatattaagtgctcaaatgtgaattttcccaaaatttaatatggtccaatatttaatatatatcctagatttttataatttcctatatttggggattttggtatttatctgttttgacacatattggtttatctttttggattggttttaccactacatggatttctataatttagcatttgtgattcaattcaatctatataatatctaattaattttcccagtaaaactattctatagatagagtttcatttatttgaatgattatcatttcctaagtgtttatatttcatggcacgcatcacatggttcaagtattcaatatttgatccataaattaaattggtaattaaccttccctttgtctggctttgttttctcgtgcgtaaatatttatggggttcataataaatattttattattataattattacttagctgtataactttagtttaattttccattgtgacaatttatagtttggcaagtaaaagcaaccataacatccagcatgatgcaaaaagtgttaaaaagttcaaaattttagtaatttttattgttgagaattttcaggatgttacacaagccgccatcgggcaatcgtcgtcgccgtcatcttcctccgcgccggccgccgcttccggtgaggacctctcctcccttcccttttttttcccgtccccctttcttgccgaccgccgcctcttggggtgcgtcgccgtccccgtgcgcggcgttgtcctccgaccgcccgccgccattccacgtcgccggctgctgccgccggtggccgcatgccgccgccgcgccttggctcggccggaccggcttcgtgccacgcctgtgcccctggctgccgctcccctcggccgcccgatcggctcaggctgatctgggccgtccacgtggtggacgcgcacccgacgccacgtgtggaccatgtccaccgtgcgccctcccgctttgactcgctgacgtgtggggcccgcgtgtcggcgccggccgccccttgctgacgtcagcgaggtccatttcctttgtaaaaataaataataattgcgcaataaatcgagtttaattcttaaaattcatttaaatggctcaaaacttctaaaattcatatctaattcatacgaactccaaattgggccattcaatttgcaaaattcatctaaaattgatctctacatgtttgtttaatttttatgtactattcccttggtttttattagagtttttccttgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttacaaatgttttactatttgcaaataaatatgcatattttgctaattacatggggtcagggttttacctatctgctcgcttgtgccatatttacttgatatatgtcctttgtcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgtgggatgccctaaaagaacttattgtacttaccacaagccagcgtgggcaacggctcggttgtagtgtagctttcctctagtcgacacatctaggcaagggtgggcgtgatggagcggggcgggccctgcgacggcctctgtcgctttcggattcacctaggcacgagcggggactacccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgggtcttgtgggtacagttgtacacctctgatcagagtaaaactatt

SEQ ID NO: 58484 - DNA, 6161 bp, Oryza sativa
  unsure (1)..(6161): unsure at all n locations
acgaccgtttcagactttcagttgctagagcggtttcgctttgcacccgtatcctatcctatcattctcacaaatatctaaccccctcgccattatcaggaaagaaaattcttgaccactgctacgcgtactaacattacagacaatgatctgatgttaatcgtttgatttaattagatgtaagttaaaagaaaatctgaatatactaagccttttcagaaaatctcaactgtaccgtattctttcccctttttttcttttatttgttcttttgtttttctccaattcgatggaggcacatctggattgcacgaaggaaatgggaaatgtttcaagctggaaaggaagcagagagaactgaaagccctctgaaacttgatggattctatgctgctttgctccttcatcagtgtgtcatcaactcatcattgtcagtatgtgtatgtgtgctgtgtgggtcaagtgaatcttcagcagtgagcactccatggcgtatctgcaaaagccaaatatatttttgcgctttgtactccattgctttctttttccttgcttgcaaaaatgacacttttaggacatggttatatccattttaaatagcaaatggcagatagcaaaagttttagtggtaaaagttttagcatttcaaaagtactaattggtgtttagatcatcctaaacttttatcattctagcattttttggtggagagagagtggtcgcaaagtttgccattttggaggattggccttacgctcaactttttgttttgcattcctctgtcctggcagagaggtactgtttgatagataatgtgatttatgataactgttcgaggatagatacaaaagaattatgacaactacaaggttcaaaagttgctttaaaaaattatataagaatttatactaaacacaaagcttgggaagaacttcagcgaaaaaacaaaatccaagataagaaaagaaaagaaaagaaaataacatggccaaatggagattcaatgtgacagtagaaattaaaagcagggggtagtaatagtaacagtcatgtgcagacagtaaaacggcaacagcaacagtactgcagaacaaaaaggacactgcctaaatttttctcattacctttccctctctctctctctccagtgacaataatgtcagaggattcaaggtagtgtgtcctttttgcagcttgcatttgaagtcgatctgtgtgaaaatctaaagttttactgcgagtgaaatgaaggtcctcctcttggctcttgctctgaatatactggccattctgttggccaagcaataatgcaggtaagcaagcgtcttatggatggaaagactataacgatagagacatgtggttgctgaaattttgtatggaattgcgcccaagttgacgatgtagaagtagaacgccatcatttgtgcagtgagcactgagcaacgaggaaaatgccgtcctaagcatggcatttgcaagaggagacagtagtgcgacagctttgtattgccaagctaccaaggggatcgttttgtcctgtctccacctgcagctttaacaaatgaaacttggttagttttcaatacttcttttttgttaggttagagggcaaacacattgctaatcacacaagggaacatgaagaatggagtgaaccatgtgtgctgcatattcaaggactaaggagtgcattggtatgtaacaataattaatatatgtacagttagaataattaaggacttgctatttattttctttatgagtatttttttattattatatatgaaagacagctacgtgcacacactacacttatgcattggtgagtactccctaaaaaaaaccaacttttggcaatgcgtctagttcattgctagaagttggttttttatgggaataagggagtacatgagtgtggatggaagtgctcttgccatatcaatttaagatgaaaaacattgatcttgatcggtggcgtttaagaaaaaaaaagtaatttgtagtattaaattaaactgcaattttcaatataaaagtaagttgatagagtatttgcagcaaactaaagttgaaacaaaagcatcacattgtttggtttgaagaatgcaaggacattttagtatcatgtactccctctaaccacaaatgtaaacatttcaagcgtttaaatttttatccaccaatataagtattcatagagtactacttgatccatcaatcattttttatttcaataatttgtttttcatctcacccctaaccattattcattatataaacacaaaaatcttgggaagcttctagcagttacagcttttacagcttgtcctataatcaaaagttcctccaaacagtttaactttttttatattatgagaagctatagttgtaagataaagaaaatgaattagaagacataaactaaggaaccaagcttttctaaattatcagaagttgactaccaactagctgcttctataatattaagttatcccaaacatatcatatccttaggtttagtttggcactacacttccgaattgctaaatgatgtgtgttctggaaaaaaaatctatatgaaagctgtttaaaaaatatattagtcaatcaaattttaagtattttagctaatacttaattaatcacgtgctaataacttgttccatttcgtgtagagattcccaactagatatgccgaacatgaccaatatagaaaaggtcatatttgtgaatagagagaagtaataatatgaatagcaaatacggagtacgtatatagcatcatataacacatggaagtctctttcagttagttaatctatcacatgcgggatttgcggttaaaagctctgttccccaaaacgataaactaatctaaaatcctcgcaaaaaaatttaaaaaatctgtaatcttaaattcgaggaaactcatgtgaagaatgaggtggtggtgacgtcaccaacaaacagatgcgaaatggagaagatgccctggcctgcaactgggccgagccgccgttggtccggtccacgttctgattgccagtttgccaccaactccaactccatatggcacgtggggcccaccacgcccgtggagacccaggcccacaagtcaggcagcaattttgacccgcctaccgccgctgcggcggctatctctgcgaggcggtccggtcccacccgtcagagagacgtcctgatcgcggcaggtgtgaaaggcaagggggatatttggtgggctatttaagcagccggtgcggtaggtggtcgactcgctgcacgcctttccgcgatttcgtcagttacccagatctcatcttacgcaggtgagctccgatctcccctctcccgcgctgcgattttgatttgatccgtcgcgccgcatcgcgtcgtcgcttggtaggatcatccatccgtcccccgcgcagcgcgagctgtctagtttctgctcgattttttagttcctgtttatgggggagggagggagagagggagggattgggtggaggcgaaccaggaatcgtcctggcggtgtgatgtctggatgaattggattggcagcgtcttttagtggctgagagattgtttccttgttactgttccgtggggtttacaactttagaatttgtttcttcgacagcatgcagcaacttggtagaatttagctgcatgttctaggtggtttgttgctgctgatcctgctcgtttggatcaacgatttttggggggctgagattaattggttggtacagtcttggttagttacatccatgggaacatgcagttggttattggtttgcacatggagtactactgctaatggggtagatatagacagtgtgtgcgccaaagctttgctaccactagtttctttaagtatagtgcctcccaattaccaatattacctattttcagtgtaaagtgttaaatagaaagattgcttctgattgctatctcctttacctgaattggtagttaggtgcacatcttccattgtaacgtatgtgttaccatggctcatgtactagttatgctagatatgttgtgctgctaaacatatatactagaaagaatgctaccactcgttccttctgttgttaattgtggaatgttttgcaatctctagtttgtagctcacaactgaccatatgattccccatccaagtgtcgacctcatgtgtgatttcataaataaaaaagagcatattttcaggatcctgttatgatcctcatttcatacatttatataccttttccataatacatgaatgatgcctcactcaatgctataaatgttcacattatatattacctcctcctacaagtatgaaatatgaattgccataggccatacaaaagagcccactccctatattggactcgataaatatttttagtacatagctcttaacttgcatgtcatagtctgatgtactgtcctttttgaattggaaactctgttactttataaaaaggattgacatttgtattccattgttaaaagaaaagcaacatctgcacaaactagtttgttctgcgcatgatgtattgatacatttggtgcatctatctgcaggcagagatggctgtcactagaattggtcttgctggccttgcggggatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaannnnnnnnnnnnnnnnnnnnnnnnnnnnnnnnnnnnnnnnnnnnnnnnnnnnnnnnnnnnnnnnnnnnnnnnnnnngatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcgacaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggnnnnnnnnnnnnnnnnnnnnnnnnnnnnnnnnnnnnnncggggctcacacctacgagagggtcgacatgcccggctccttccacaccgagtggttcaagatcgcgcgtgctgctaagatgtgaaatgcttcaaattttcggtaatatttggttgctgcttgctgctgagtcgcttgtagggtgggaggaactgttgttaaattttatggtcaatgtgctacgcttaatttggataaggaggt

SEQ ID NO: 58485 - DNA, 4978 bp, Oryza sativa
atcccaccgcaaagctcatcactgctagatccatcgccaccatccgctccaccgtatcaaacccgctgccgccgggctcccaccccccctcccgcgctctcgctcctgcccgccgccgagctccccaccactctcgctccctctctcgtccaccgccagagaaagtggtcgtcggccgctcccgagctcgccactcccgctcctgcctgccaccggcagaagtggttgccggtcgctcctgctctcgcctgttgtcggccgctcctgatcccgtccgccaccgaaggagagaggaggaggaggaggagcggaagtggaggaggtggaggaagtgatgggtggagagcggagaggatgagtataagagagagagaggacttgatattttaagggtaagcttgatctgatgagctggtggcaggcggggctttgaacatgccgtcttacgaaaatagatttattttcacacgtgatttttgaactgtgtttgagggaacgatttttccataggaaagcagctatggaccacctgcaacctaaagggattttataaaaaaaaaatcgattctgtggtagcgtgcacgtcgatcgtcactgctgatcccattgagacttgagagtcacccactagctaacgcaatctgctactcactagctagtagctgtttctgcagctgcaagaacctattctgctccgacccggcgaaaaaaaaagaacctattctgctcacatgtcgcagctgagatacaaatattgttcattaagctatctcatgcatgcatgcatggtcctaatagtttagttatacgaacagctaataataagtttattcgaatataattcctactgacattagcgttcctgcttccgatctgaattcagaaataatgcaaattaactgcctaataactttattcgatcgaatccattcaactgatggaggctgatgagctgctggtccagtggcgtcttttaattctagttgcatgcaacgtcgcttgcacatttggtagctagcaagaattgagctcagctcatgcacgtagctgtgtcaagatgggcgccatggccaagatccatggtcatccgaggcggtgtctcctcggtgctctcgtcggagccatcgccgccaccgccctcgtcatcgccgcctcgttcatcctccgcccgccgccgctcgccttctccgtcgccgacgcgaggagcggcgccactgacgagaacaaggcggcgttcctcaacctgaccctggtagccggcaaccctagcgggcgcgccgccgtggagtacgaggcgctggacgtcatgctctggtacggcaccaccgactacatcgagaccaacaccagcctcctcctcgtcggcctcgccgccgccgacgaggcggcgctgctcctgcagccgccgcgcaacgcgacggccgtggaggtgacggcgcggacgctggacgacaggtttgtgcaggagatcgtcgccggcgaagggaggagaaccgggctgtcgaaacatgaattcggcaataataaaagggggtagcgcacgagacctaaaagtggatggatgcggagacaaaggatttagacagattcaggccctctcaatgagagataataccctactcctgtttggggatttgaatccgccgagtgtgtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgacctattacatattccatagatataagttattccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaatcaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccacctagaaaatgaccacaatatataatcagcctaagccataatattggtcaataaaaatgcacacttacgtggcgaaaagcaatgatattgtatctaatcaattgcttaaaaacccaaacagcaccttgacttatatataaaaaagtcagcgggacagctatataaagctttactgtttgacaccttttaagatgcattgtaccaactcctaaaaaattaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcttaggccaaaaaatatgccttcgacaccctttaaaggatgacgcatgtgacatgctcccgagtaacaaatcttctgggtaatatagaccaagtgtagctcatatgaatagcttctgatctgaatgattatcccttatgggatactccaaaataaatataataattgaatcccgactggcgcaagtattcggttgatagcccttacggggaaaaataattggtccagtctttgagcatagaaaatagactcatgactatgaatccatgtggaatgtatccgaaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacaatgacaccaatcaaaggtaatgaagttgcataaccatggaggcgaagaaaccagtcggctacagccaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaatacttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggccgatgaagcagaggtgctggtgatgatgtcagtgacaataatccatcaaattaatgttatggctgttgtagatgcttcacttggaggagagttgatgtcaaattaattttgagccttgtatttgtgtagcccccgactctttggttagttgggaaacaactgaacatagagtcgagaattatagcttcttgtcgtcgagtagttattgcttgattgaagatatgtgttgaagatgtccaagtagaaatcatgaatgttggagagccacttgttgtagtaaaataacacggcatcgcatgccgagatgtcgagattcacaacaacgtcgtggttggtgaagtagtaaaacttgcgaagtagcaataatagagtttgccggtgccgaagataataaagatgaagtcgctccaccatgatgacaaagttgtattgccgtaatgaagtgaacataagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagggatgaagatggtaaggccaatcaacactggcagaatcatgcagccatggaagtgcagaaaccagtcggcagccatggcaaacgtaggcagcttgtgttgaagatactgatgcctattagtagtgacagcgatgtagccagccgtgaagaagatagcatcagttggcgttataacaggccagccgtacaggcggtgacaccagtcagcagcggatgcggcggccggtcggtgaagacatagacgcccaacaacggcagcataataggccagccgtgcaggcgaaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggccagccgtgcaggcggaaacaccagttggcagcggcgaaggcaagccggtcggtgaagacgtggacgcccaacaacggcggcataaaggccagccgtgcaggcggaaacaccaatcggcggcggctaaggcaagccggtcggtgaagacgtagacgcccaacaacggcggcat

SEQ ID NO: 58486 - DNA, 8952 bp, Oryza sativa
aaaaaccttttttttgtggtccgttgtcgttgtttgggtatctcgtccatgcccacttgatacaaaaaaagaaaaataaaatcaacacgaaaggatgttggatgcatatttgattcagagtcaaaaccgaatgaaattaaccccataaatacaacaaggattccacgagactgctacaacaagtaattgaataagacaaagcaattggtgagatctgacctaatttcatggagggcaactttgacttgcggtcaagagctccaagcagcagtgcatggcttcggtgaacggtcgaagctcgacgcatctccccaccgatgtggcaggtcgtaggtggtggccggttcatgaggaggcggagggggctcagtaggcctctagcgagaaggcagcaagagggctctgatggggccaaggcctcctagatgcggcggccctcaacggagaggctcttgggcttcagggtgtcgacgaagccaggcagacggagtggcttcatgtatgagctatcctcgctggtgtcgtggatgaggatatgccgtcgaagccttaccgaagagcgcccgtgccatcggacttgtcgcccgcgcctgtcggatttgcgtcctaggtcaccgccgctatcgtatccatccccaacgccccgagccgacgccggatccatcgtccgcgacccaagccgccgctggatccgccgcccgctacccgagctacactgccgccaactgtggaaggaactctgcccacgactccccttgccgccgccacccctcccgtcgaatcgagagagggacgagaagtcgaggttgaggtggagaggaaaactagatcgagaacgaggggagagctgagctaggagacaaaagaagaaagagagcgataaaacgagagatctctgcgcctcaccgatagctcatgttggtcacttggtcagagcgaccgctcacctttttttccttttttaatttattgatgacaaaaaataattgatttctatgtttattatttccttagatgaaaatcataaattgtgaaaaaaataaattataaaagtttcataaaaataaatacatataattaataacttttagggccttttggtttggtaggaatttcaacattacatgcaaggttttaagaacgccgcttgaaaaaataggtttttgagcccttatattttttttataagcggggttttttagttcaccaataaaaataaaacacaactgtcatgaaagaaaatgtttttatagtgttgtggcctctggcatggaagggttggatggccaggacatcaaaggggaaaattaaaaaattattataggaaaagaaaaaactaataaattagaaaaaaaaatggactatggcaatatatgcagagtgagatgaacatgatacaaaaatatagcaatataaatatttcatatatggtaatatttatcgatagctgggataaatatccatctcttccatatccatatatatacacacacatatactctccgtagtttttaatatactattcccggttttcaatatatggcatcattataagtaaatttataacaaaaatgataattacataatttttaaataagataaataatcaaccatatataaaaagtaaaagtatcgtacattaaaacaagaggagttatctacttaaagaaatcattttttttttcaatcggcacatatacacgcatcttggtcatctgcgtgtcttttgttttgttatcattagctttctctttgtatgtcgttcgattcacacgtcgagtctgggtattgcctctctaagcttttactgaccattaatttcacttttcacgctactgacttgctcggcttttactgatcacacactctcttttatcactcatgtcccctaatatgacgcacaaacatatttttcaagtaatctttaatactccctccgtcctttaatatataacgttgactttttacgtcatgtttggccattcaacttattcaaaaatttaagtaaatgtcttttttttgtttgatgtatcactaaatgaaatttaagtattatttatatttttaagatttacaaaaattttttaataaaacgaatgatcaaaggttgtaacaaaagtcaatgatgtcttcgtgtaattaccaagtaacatagtatatttgcgtgcgctagcgctgctagcaggcaacacagctcagagataatatgcacagacaagtttcgatcaatccaaacggatttattcttcgcgtcatttgctttctttcaccaaagaaaatgattgaaagcaacaggagtataggacatcaggaaataaagctagcacaccgctcgtcaattatggaagaataatcaatatgtataacacaagcatgcgcacgattcttaagagaattgatgcagggcacacatgcatggcatcaattttgtggttttagtgctttgcaaacacacttctacaaagcaaaaagaacaaaatatatgatacgatctttgtcagtcagctggtatatatctaatatattatgcattatactagttgatgtcccacacttttactgcagaatgcatgaataaatatgtattaaatatcatacaaattatgtatgtatgtatgtatgtatgtatgtatgtatgtatgtatgtatgtatgtatgtatgtatattgaaatattgtgtaatggtgtatgtatgtatatgattatttgacacatatttttatgtcgagctgtataacatattagagttctataatatactccatccgtttcatattataagttgttttgacttttttctagtcaaatctttttaagtttgaccaaatttataaagagatataacaatgtttataacacaaaacaaacatattatgaaaatatattcaatgttacagtcaataaagctaatttggttttatcaatgttgctaattttttctgtaaatttagtcaaacctaaagaaatttgataaaaaaaagttaaaacaacttataatataaaacggagggagtaataaattacagatgatgcgtcatgtatgcttcgataagttttaagatgttttgaaacagtacttacttgtaggtatatgtatattgtgggttctaactatatatagataccaaaagatcgattaaacgtccttcggaagtcagaacgctactaagatgtcacatgacgctccaataaattaaaaaagtttaaaatgttagaaaaagataaaatatctgaccgcaagttttcacttaaacaagtggtcctattatttttaacctttagatttagaactatttgtaagctaaagggaaaaatgtcccttccacctccccctccaatacgtatgtgtgcactccggcccatgccgtctcggactctcgggctctttcatatttcttcttcccaactttcttaatcacaggggtgggcctacaacaattcaagggtattcaaatgaatacccaataattttatcaaaaaatagatatatatactatgtattttatatgtgtatttaaaaaattaaagaaaaggcatcaaacaactcatcaagcagagaaatcatcctttttgggccgcctcctcccccttatctgttggcctattagaacaattgattcctcattttacccaaccaaatattttggccgtgatgacgaccacactgccccgctcactagaccttgatgacgtcctcctcctagtctcctctatctcctgcctcccactgtaccgcaacccgcatcagcttgactactttgagggattgaggttagaaataattagcttactctagaccaacaaattgatgatttaaagttcaattttaccgattcaatttaaattttaatacttatgttgactcgacttcacctttaaaaagtactatagataccacattttacagggaagcggagtataggacatgtatatctccttcgtctctatgtaacaaattgcgtcaatatgaaccaattaaagcagggctagcttgatcgtataaataaaacatatatagtagaaataatagttttttgagatatttttaagaaaagagaacatctacacattcaagtaaaaagggaaaaacacattacttttgatttaaacttaatccatgggacataatttctaaacaaattaaatctactttcattttagatgatgacgtagattataaaaaattgcttatagggatgaagtacatattatatactataaagataacaaatagcttagaaagagttatctcaaaaatgtccatgaagaagaaagttttccaatgcatgcccacacatttttatgggctatcttcctagttctataaaaatcagaattaataatgactgagttgtagagtttaagttacatactttttatgattattgatttataaattcataattaatatatatgaattaatttgaaggtgtcataagcccaaaactcgtaagtagatggacttacatgagtttttaatgtggcttacaaatgtttgtgttgacttctaaatatttgacgccgttgactttttttaaatatgtttgaacgttcgtcttattcaaaaacttctgtgaaatatgtaaaactatatgtatacataaaagtatatttaacaataaatcaaatgatagaaaaagaattaataattacttaaattttttgaataagacgaacagtcaaacatatttaaaaaagtcaacggcgtcaaatatttagaaacggaaggagtatatggttacaaccgtatgatctatctgattgacggccaactctttctggttaacaagggagttcattgggaaatgcccaattaatagagaagtatacattggactttatgaattggattttagtaataagaccgtaaggtatatgccctcagctcgcttgttatgttggtgctaataatcgtaaattttcaggaaatatgcaagattgattgttttgttccgctgtttcatacacatgtaaagtcaaaattgatcgatatatacagatcggacaaataaaagtaagaaatatatatattactccctcagtttcacaatgtaagtcattctaacatttcttacattcattaacatcaatataaatgtagaaaataatagaatgacttacattgtgaaacggaggaagtagcctcttacatatatttgtagcgtgacatgcatatgggacacaattatccgcgtttatacttttttttaatatagaacgtgtttattattgtccctcattacaaagtatattctcgtcttcctctcgtaagcttgagatcatgggtccattggcgcaaatatatagctagctagcgaccaatttactcataggtaggcaggtggcaagatcgatcgagcgatgacgtccgtgacctcagatttgctgcagtcgtgttcggaaaccatgatttcattcgtccacaacatgacggcttcctacgccgacaagagcaacgagtcctccgtggtgtccacctccgtcgtcatgttcatcctcgccgccgtcttcttcaacctcaacctcttcagcggcgtctccgacgtcagcgccgtgctcaaccccaccgtccgcatcttcctctccagcgcgctcaacctcttcctccccgtcatgtcctacctcttctccgaggccaagcaagcgccgctcggagtcggcgactccactaccaccaccagagacgcccactccgatgacctctcgctgctggcgcgtgtcatcctcacatggatgctcctcgtcgagctcctccgcaagaaggtggaggccatcctcatcaccaccggcatgcacgtctactccagcctcatcagtcacgccaccagcgtcgcctggctgggcaacctcgtcttcttcaacctccaggccgccggcaagaaggcgctgttcggcgtcctctgggtgctctgcgcggccaagctggtgcagcgcgtcgccatcaccgagatcgggaagcgctccttcgcccatggcaagaacgcccgcctcatctcctcctacatggcgcagctgccaaagctgctcgaggtggatgagcatgtcgccgccgacggcagcaggatggagcggtgcaacttcgccgtgatgggggaagagaacatggtgctcaaggccggaccacacggctacgagctcgacctcggcctcgccgccgccgtcgtcaccgtcgggaaaatctggcagaccaaacaacacccaaggctcaagaggctctgcctctccttcgctctcttcaagcttctgcgccgccggttcgagaacctgccgccggcgaccatgaaggagaccgacgagtgccgggacctcatcttggacggcatgtgcaaggatgctcaggccaccggcgacgtcccggcggaggtggcgctgttccaggtgctcaacgacgaggtgaacttcctggccgagtactaccactccgtcctccccgtggtgctcgcgagcccctacttcttcgtcgtcaactacctctgcttccccgtcgtcgtgttcggcctctgcgtcatgaccatcgtcctctgcggcaatggcaacgtcttgtacgccttcaagagcctaaccaacgacaactatgccgtctcatccggcatactctcgctgacgaaatgcctctggaaaaacgtcgtcaggtctccgctggtgttcttctccatcgtcgacgtctccatctgctacctcctcttcatcgtcgtcgtctacgaggaggtgtgggagttcgtcgtcttcctcctctccaactggttcatcgtctctctgctctgcaccttctccgccaagccccgccgccgcgagagccccaccttccgtggctccgtccgctgcatcctctggctccgccgaaacctcagccactaccctagcctcatcaccatcaagcagttcaccgtcctgagcacatgctgcctgtcgccgaggttgcccaccgccacgctgcccaggcatgcgaagctcgccatcctagaacgcttccgcggcggcgatcctctcagcaacggcggcgccgtgctgacgtcgatgggcggtaggcaccggcggttctcgcggctctcgtgggcgtgccagagcggagccgtcgcggaggtgatcctcacctggcacatcgccaccagcctcctggagacgaagcagcagcagcagcttccgacaagtgccagccggagccggaggacggcggcgaggctgtccagatactgcgcctacctcgtcgccttccggccggagctgctgccggacgaccgggaaggcacggagcgcatctacaaggacctgaagaagggcatcaaggcggcgctcggcggcgcacggggatactacctctcgtcggagcggagccggcacgagacgatccgtgcgctccgggtggacgcctccgccgccgccgacatgacggtgctcgagaggggcgccgtgctggggaagcagctggtggaggacgacgaagccggcgacggcgcggtgtgggagatgctggccgacgtgtgggttgagctcgtcgtgtacgtgtcgccgtcgcgcgcggaggagcacgccagggggcacgaggcggcgctggcgcagggcagcgaactcgtgacgctgctctgggtgctcgccacgcacaccggcatcgcccgcccggaccacgacggcgaaatcgaccagccggcggcgccggcatagcggagctcgcttgcattgcgcgcattggcgcgaacaccaagtaattaatgcggtgtactcggatgcttacgtctacgtgtgccctgtggtttggacgacattgctttcccggccatgtcttgttcggtttaatttccatctcatgtggaatctctctttgttatttgtgctctattatatttccttttgcaattgatgtcaaacatgttaattaatttgtatattttggcactcctatatgttactgatttgctaccagttctatataaatgatttttctgtacgagaacccttataggttacaagcaaaccgtaactgatcgagcttataaaaattgacctccattttcacgtacggctcacatctgggcctctaaggggggcattttcacatgctgagaccttaagtgttgttcatgcgaaaataccccctcttcacaaattctcacctcctctctcttttccctttacatacttcaaattttctcaattcatcaatcttatctcctctacctctctccctcacctattctcatcatattatattgacctactctgttgctgtcctttactatgagttgctctgctccgagcacgagcgagcggcggacggctcggggacactcgccatactgtaaatgaatgagcatatgaaaaacattctttcttaaccagaatgaacattgaagcacagtgtattttttctctcgctcccccatgaccatgtcagcaggtagaggttgtagaagtcttttgttctactagtatatatcaacttgcaaagtttttgcatgttcgaaaaaaggagaatgaacatggtgacacgcattaaaagcgacaaagaaacatggcctttttcttacaggaattatttttttaatagagccagcacgagattgtgttttttcattaaatatagtaggagaaaaatacagcctctaaaggtaaagaaaaggcatgttatacatatgctccagcctgaaccgtggtgcgcgtcaccatgttcattctggttctggaaaaagatttttgcactgcttacttttatataaaacatgcacgggatatacacatgattcaagtatagaattgaaacttgaaagttaaaaatgagagcatatgttcttcagagatcggctagaaatgcgtaaaccaagttcgaaggcgtattttacgatgaatcatataagtagcgaagatggagcatcagccttaatttggaaagaaaattaagattggaaacatatcatcatatcaattatcactaaaggaaaggaaagattggaggag

SEQ ID NO: 58487 - DNA, 19405 bp, Oryza sativa
cccgccgcccgtcgccgacctcagcttctcgcccgctgtcgccgacccacccgtgaatgagagagaggaaaagtgaggcatagattgagagagagaagagagagaggaagagtatgacatgtgggtcccgcaatttttttttataaatacaatgctgactagactgccacgcgtacgccacgtagaccaaaaccaccatggattgaaccaggggggtaattcgtccggtttgcatagttaggggtgaagaatatccggttttgtggttcaggggggtaattcggacgaccgcgatagttcgagggtgtaattcgtactttttccaaaaaaaaaggctacatttagtttatttccaaattttagtaagcacatatgattgccaaattttttgacaaccttaccaaaatttggtaatgccaaaacttggtaaggttgaaaatggtagcaaaatgaacaagcactaagatgtgttagatccgatactagattaatttttttagggatggatggagtatactagtaggagtattccttctataaaaaaaaactcaatcttaggaagggatgtaacctctcctattaccacgaatctgaaggtactaaaatgatccttataggttgaggttttttttaatgaaagaagtaatgccgaaggttgaaagtttgaactcctgctattcgaagttcactttgcagattgaggtggtgtttggatttagggactaaattttagtacctatcacattgaatgtttgcacattaattagaagtattaaacatagactaataataaaactaattgcataaatgagagttaattcgcgagataaattttttaagcctaattaatccataactaacatatgtttactgtagcatcatataggctaatcatggactaattagactcaatagatttgtctcgcgaattagtccgggattatagaatgggttttatcattagtttaggtttaatacttctaatctatctatctatctattatatactaaaagttcattaaacttcctacaaacgctctcaagccgccacgtggcgctcctacaaatgctcctaggccgccatgtggcacaatataatctcaccgtcgattttcgcttaaattggtggactcattattttataccgttagattagatctttacccgccgttgattttcacttaaattggtggacccattattttataccaatgaattggatctaccttctcccgtacgtatgtatggtttgccggaaggattagtaactatggttatggttgttagaagttgagattaattagctgtcatattgtgttgctactaatcatatctatatttattatatgcacggcaatatatatatggaagctaggagattaacaagaagattatacatagctaattaaattagttattatacatgatttgtggaaggaaattaacggtaatataacatatacagctaattaaatcagtttatatggctttatcgtgatattacgtagctaattcgaaccaagcaatctccacttaaatcgtccagcttaaatcggtgtatctaagattacctttttaactcattatgatgactttaaaattaaaaaagattttctaaaaaacaaaatacatgataattggtttttgacctgaatgatttagaaaaaaatagaaaaacaaagtcccctccacctcaccctcaccattagatacgcacaacactttgtgccccctccacttctctctataatttttagtagctatgataaagagaaacaaccacagttattttaagctacacatattatatctaatctaactgttgctctatacataattaaaccaacaatttaagattcaaaataaattaaaatcgataatacatattaacgtcagaacaaaatcaatggtctttaaaatataactttttaccatataaaaatatattactccacaaatatgtgcaaatataaactagatctataatataaataaaaaatatcaaatcaattatctctaaatgttcatcttttaaattattttaaattatataatcaatttgtgatcctgtcgtatttctttaattaaataaaatatttgtgtcttataaattttatattgcggttctagatacatcaccacctcttgggaaaaatatataataattaatgttatgataattttaaataatttcatatcatattttaggatgtcaaatatcacttgataaatgtactacgtaattgcgaaaaaaataaaacaatttagttgtgttttttcaagtagatctgatttaattttaatttgtttgaattaagccaagtgacactctaaaatctatccattgatttttttttaaattggtgggtctaatatttttaactattagatcgaataaaaaaagtatgtgctcccaccttctccacaccctttcctggtacggacgtactctcctcatctcctctttcctttcctactctcttaggaaaaaaaatcttcaaattttctaaactattagatttatctcaaaatttaccaattaaatttgtaaacaataaataaattgcccgcgtaactgcgcgggctacctttctagttagtactaaatattcgatgtaataggggctaaaatttagtctctaatccaaacatggcctgaatgtcaggaaacagaacactccagctatttttttacggtcacaggactcagcaatcaaatgtgctaattaataccccaaatcaagaaagcaccaggttacacgccaagcaactcgaagtggtgagccccctcgcaatcgcagggacacacacctctccctctgtcctctcgctctctccctggtggcgccaccaatcctggccacctttcgctaccgaacccggccaatcatcgtatgattgccggcctcctcctgttcctgcccccacacgccaatcaaaaagagcgcggcacaggcgcacagcacgtaggcgtaccgtatagtggctgcccccttctccgtgcttaaaaccgggtgcggtcaccgtgattttcactacactcgctccaaaatatcactgcctagtacatgatcgaacacatccgttaagaattattgtattaggaagtgctaaatcacatatagaatagtaacatttcaaaacagatgttcttttttttaagtgtagtatgaacgtatcattaagcgagacaagctagcccaaaagcagcacgacgagacgagacgagacgaaacaaaacgagacaagaccaagacccgcgcgcgcgccgcgcccggccacgtctccactgaactatccacccccccgccgggaaacaaacaaacgcccctgcgcgaacacgggcgcgatacgctacggagaaaccaccttttccgccccccgcgtgcttgatcccccccccccccccgtgatttcctgcggttttgcggccgccgcgccgcgacgcgtcgcgtcgcgaaagccggtgaaagcaaacgccgcgagacagtggcacacaggcgcatcgatcggggggagaaggggtttagcacgcggcggccgcgcgagggcatgtcggtcgcggcgcgagcgcggagcggaaaacggtaaaagaaaactgccactccaccacgcgccgtccacccgtcgggtcggggaaaaaagtttaaaacgccgagaagaaggctgtgtctagttcaacgcaaagtttagattttggttgaaattagagatgatgtgagtaaaaagttatgtgtatatgacaggttgatgtgatggaaaaggactgaagtttactccctccgtcccaaaaaagacaaaccctggtttccgtgtccaacgtttaaccgtccgtcttatttgaaaaaattatgaaaaaaattaaaaagataagccacgcataaagtattaatcatgttttatcatctaacaacaatgaaaatactaattataaaaaaatttaaaaacccacagtttatcttttttttagaactgagggagtaaatccaaactttaaatctaaatacagccgaaggacgatagcgtaggcgggaggcagaggtcaaacgcacaaacggcgcctcgtggacggtcggtcgtctcgcctgcgggtcagggtctcggggacatgcaatgcaaccgggagttgtgtgcagggaacaacacagtgaccgggagcttaaacaaaagggccacctaactcgcccccctttggagcacatgcccccctgccccacatgtatcaatccatccatccatccatgtgtacttccaatcccaatcccaacgagatcagcaccgtcagctacaccgatcggacggccgacaccactgcgcatgcatgcacaggcgcgagcattcccagcgctgctctccctgtacccgatatggacaaaacgtatggcgcgtacaggcgctcccctagtccggcctacagcttccagccgaacccataaacaaagcacgcaacttgggagcgagcgaggggccgcacagctagccatcgatcgagtagccaggccaccacatcgccgtcctcgctagctggctgtgtcaactgcagcgacgacgaaacgaacgatcgatctcgccggctggctggctagctgctcctcctataaatccccggctcccagccgtccccctccgataccgtcatctcaccacacaaacgcaggcacacaaacacagagagcagcccaaaccgaccaaaatcactgcagagttcaggcacttcttcagatagttctccccctctgtttctttctctctttatttctttctcgagttcagtttgagagatggatttggcgtggtggttcgcggtggccgtggtggtgtgcggccttgtggggggcggcagcgccgggctgctggagaccaacccgggtttggcgtacaacttctaccagaagtcgtgccccaacgtggactccatcgtccgcagcgtcacctgggcgcaggtcgccgccaacccggcgctccccggccgcctcctccgcctccacttccatgactgcttcgtccaggtcagtgccagcaaaaatactcccgtttcttcgctgcttcagctctctccaagcccccatttcgccgtgtcggcgccgtgccgcgcgccggcctagctagccagccatggccggttttctttctccctgtctacatcctgagaggaattaactgcgagagccaccatttcgagctacctagctctagctacagtctagaggccttcactggtcctgcattctttgcatggcgtcgattggggacgaaacgaggctcaagtgaaccggggtttttaccgcggtggttcgtggcttttactctgattttcacagtggcgggaggaccagccgagaagatattatcttgcttttcgcctgtgcctgtacacatatacgtaagcattacggcaccttttccccggttcgcggcagcgcgaggcgaggggcgaggcggtcgcgacgcgccaaagcaacgagacaaacgggaaaaatactgcgtgcctagtacagggggggagcacgccgaatcttgtcgtatttttccccccattttttttccccgtgcggcccgtgcgttgcgttgccgtgcagctcacatgcggcgctgagccgatgcatcgcgcgcgacagctaagcttatcaaagctgccgcgccctgtacggcgcccatgcatgccatgcatgggccatggccacaccaccggccttggcccccttgctcccgcgattttttttcaaaccctgcaaagcgcagctgtttgtggccgcgtgtcaatggcgcctggctgaccggtcggttttcttctttttgtgtgtgtggttttgcgtgcaggggtgcgacgcgtcgatcttgctggacaacgccgggagcgagaagacggcggggccgaacctatcggtggggggatacgaggtgatcgacgccatcaagacgcagctggagcaggcgtgccccggggtggtgtcgtgcgcggacatcgtggcgctcgccgcgcgcgacgccgtgtcgtaccagttcaaggcgtcgctgtggcaggtggagaccgggaggcgcgacgggcccgtgtctctggcgtccaacaccggcgcgctgccgtcgccgttcgccgggttcagcacgctcctccagagcttcgccaaccgcgggctcaacctgaccgacctcgtcgcgctctccggcgcgcacaccatcggcaaggccagctgctccagcgtcacgccgcggctgtaccaggggaacaccacctccctcgacccgctgctcgactccgcctacgccaaggcgctcatgtcgtcgtgccccaacccgtcgccgtcgtcgtccaccatcgacctcgacgtcgccacgccgctcaagttcgacagcggttactacgccaacctgcagaagaagcagggcgcgctggcgtccgacgccgcgctcacccagaacgccgccgcggcgcagatggtggcagacctcaccaacccgatcaagttctacgccgcgttctccatgtccatgaagaagatgggacgcatcgacgtgctcaccggcagcaaagggaatatcaggaagcagtgccgctccgcctcctgaatcctgacgatcaccatacaaacatattttcttcttggtttcttgaatttttttttcttcttctcctctctcgtttcatcggcgctgatcaaaatatattgtgcgccatgatgattaattaaggtcccaagatctgtattaatttgttaagtgctcgattcgatcgttcaaggtgtgacattttgttcatcttggccttcgtcgcgcgatctaatcgaagaatgaaagaatgcagctcgttctttccactgctgcttcaaacaaacatgcagatactacgcacgtaggagtacaaatctactgctactcccactgttctttgtttaatccagctaagatgatggtgacacgagcataacaagaacatctttctctgcgatccaggattagtttatctgattctctgcgcccactagtgatcttgaagatgtgtgcgttggtgcaccactagccccagcgctaatcccatcgctaattgttgtcctactctgatcccaccacgttctgcctctgaaaatctgaacaccattggcacgatcagcaaggtgctccgttctctgtcccgtcactcccgccatgcgtttgcatattttgaatcatttgaatgacacttgattagggcaggcaaccaaagaacgtctgatttgacgacactcaacgtgctatcttgcgctatgcagaaatgggacaacagagaggctttgaagctgcatcgttcttgacttcttgtgctcgtgatgaacagtgaaagacacagcttttctgactggtctgatgagcactcattgacagttttttctgtatgtgggcgtctgtttcaaaagtactagagagattctttctctgccaaacttttcctataaacttttaactttttcatcacatcaaaacttttctaagcatataaacttttaatttttctgtcacattatttcaatcttagccaaacttccaattttagcgtaaactaaacacacccttagttccaaaataattcttcaaactttcaaattttttatcacatcaaaacttttctacacacataaactttcaatttttccgttacatcgttctaatttgaaccaaacttctaattttggtgtgaactaaacacagctaaaaaaataccgtttctcgcaaaatctttctgtaaataaactcatgtaaaatttgaacgagctcagatctcgaggaacgctgaattgctgaaacaaaaaaaaagggaaagaaaacaaaaaagggcaagtgagagaaaagataaaggacgccgttggcggcggggtatgcagcaggtccacgacgacggagtgagtgaagaactactgaaagcaacagtagccgcctacgattattctcctaccccgtctcgaaacaaaacaaaagagaaaaaagggctcgtcagcttcagctttcctccctgtctcctggcaagctcaggacacagattccttcccgtgtttctgctctctcggcctacgagcaattggtcgacagctccagatgatcattttgctagctagagatgatcattttgctacgagttcttcctccttttaatttctttttccatttgatattttccctgtacgccatgggtgacgggtggggcccattctccgcgttcatgcatgttgcttgatgccgtcgtgcacagccacagcagcccgtgactcgagaacatggacgaaaacctggtgaggacgtgaggttcgtgtacgtggtggagattaggttatggcaagtgaggccagtgtgcacaccccatgttctcttgttggatttcctgcttatatcactacacgtgagatgataaggcaaatggttgcgcttgtgctgttgtgcactgtgtctgtgtccatccttttcgatcgatctcttcttcttttttggacatatatatttcctgtccatccttgatcagctaggtagctaagaattttaagtttttttttctttttgttatgtagtacgtccacatcacgcgtaacagactcgatcgtgtccgtgatagcgtggcagggagttacgagattaattagggcccatgatagcctaagctgcagctgccgcaacccacaagcctttgctgttaagagattgatgaccaatcgaggccgtcgctctcgacaggttggatgccatcgatcgtttcgccagttcgatcgtggccgccccgcgcgcgagagagccgtgcgtgcgtgcatatgcgtggacagtgcgcgcgaccgtgagctgccgcgctcgcgtccgcgccgcgcgcacacgtcgctctcggcggaaacagagagagagcgcggggcacatggcctcgctcgcgtcgttgccgagcaagccatgcatgagcacgggcgggtcgctgttagcggatgcgcgtcgaacgagtcgcggatttgccagttgccatgcaccaaccaaccctgctgcctgttggctcgtcgtcgatcgctacggctgatacatacgagatgaacatgcaggtggggtacagggtacaggccactatagggacgggtgattttttttttttggtttcgtttcattctggtgattttcgagtcggttgggccaccccgatcgagttgcataggacgggaataagtgggccaagtgtagtttagcctaaaataaaaggaaaaagtacacccaaggtccctcaacttataatcgagatacaaaatcatcctgaaaccgtaaaaccagatatctcgcgtcccttaactaatcaaaaccggtcacaaaaggtccctcagtggttttgaccctagttttgtactacgtgactactgagtcagcgtgggacccacgtgagccccacatgtcaaggtaatccacgtcagccgcctctctttttcacctgttctctcccgtcgtcatctctctcactcttctcttctcttctcttctcaggcaagccgggcggcgctgctggggacgaggccgccggggcgaggcgggagaggaggcggcggcggcagcttcgacgcgggagaaggcgagggcgcacgtctgctccgatggcggcgagtgtcgtgcgtgtccgacaagtccggcggcggcggagagagcttgctccaagcgtcgcggatcttcttcctcgccattctctcgccggtgaggcactcataccgccgcatccgcgtgtggtagatcagcgccagcatgtactggtcggtgtcgtacacgtcccgctccggcagagcgccgccgctggggagcgccgggccaaacccgtcgttcacgacgagcttgcacacgtccatcgacctcgagtacagccggtaccaaccgcggagagagctcgtacttgtacactcgccggccggtgcaccggtctgttgacactgtaatttggccagttgggttatttggtttgccaaattactgactggttagtgatttgcttaattaattgctttattgggaatttgtgtgctgagttaacggatactacacgtgggctttgcatgcatggcggtgtgtcgttgcctcgttgggcagcgaaggcattgctttgcttcatagatggcacagcctgttgtcacgaagaaccaaatcaatgtggtgctactggtttgcgaagagacgatggagatggaggcccatgcacggcgcggcgcagtggttggatgggttttgcgtgaaggcatacgtgcgtgtttttggtagagctagagataaacttttgtttgacgccgacgtgctccggtggcaggaccgcacatgcggcggcgcgaccgccggtggctctgggcgttcgccggcgcgccgcgcaccgggagcaccaagaccgtgcgcgcccagatcatcgagcagtgcaccgcgtcgccgtcctgcacccttcggaagctcgccctcggggcactacaactcgccgaggcggatcatggagctcctcgagtccgcgtgttctgcatccagccacgcggcgagcgactcctacacccgcaagtcgacgttcgactccatgcttgccggctgtatctcggtgttcctccacccagcgtcggcgtggcagcgccttgccccggcggcctcctccccagcagcgctgcttgcctgagaagagaagggaagggtgagagagagatgaggaagggagagaataggggaaagagagaggaggctgatgtgggccaagctgacatatgcaactcatgtgggtcccacgctgactcagcagccacgtaggataaaaccgaggtcaaaaccaccgagggaacttttgtgaccgattttgattagttaaggcatgtgggatatctggttttgtggtctgaggatgattttgtatctcgatgacaagttgagagaacttgggtgtactttttccaaaataaaacaatggccgcggtcctacgaatcttggatttgctttgcatcaaacgagttccattttccaagcatcttgaatgcgattaggtgccgacacgctgcggttctagggctcatgtcatgtcagggagttaaggtgcagatcgaccgggaattaatccgctttttatgcatccgcgtctccgggccggggcctgctgtaatgtgtgcgccatcgtgtgcttgggccgggctaggtcatcagcgttaggaataagttcaccggccgtgtctcaactttacgtcgagtctatttgaagtcccctaaccgcaataccagataagtgtacggtgtacccctaaactatgtaaaaccatcccaaaaaaggttccgagtcaatatagaggcctggtttcactgacgtggcttcttagtcgcaaaaataattaagattaatatatggggcccacatgtaagtgagagaaaatggtgtgggccccacatttctcctttcttttcttttcctcttctcttctctcctaattctctcgagtgggcgcggcggtagagggggagagaggcgaccggtggcggagcggggacggtggtgataggagagggagagaggtggccggcggcggagcaagggtggcgagaaaggggaagagaggtcggcgcaacggcgagctcggccagctcgcggctgcggcgggagaggagacagttggtgcgacgttgagctcggcgtggtgcggtgacgagggagaggagaggagaggagaggcgcatggcacggcgcggcggcgtgggagaggagcggcgtggcgcccacctcttccctcttcgagcgcacgctcaccaacctcctcgccggcatccccgccctgcttgccggcctcctcgccctgcttgccggcctccccatctccttcccctccactcctcgcgcctcttcccctaagcggcggtcgtcgacgttggagccccctctttgccggtcgccggtagcagccactgctgaccacaacgactgccttgcgcggacaagaaagagggaggggacatacaccaccggccgcatctggcgctcatctgagcccgctgccgcccccatcgacacgctgcgctccactcctctccctcgccggtgcgccgtgcgctgcttctctcctcgtctccctcgcgcgcaggttggacgagctcgaacgggcttgccggccgcgtccccctccccttccaaaccgctttgccccactacccgccaaccgttaccgcgctcgcttgccgcccaccgtctgcatccgcgcatcgccactccgcccgccgctggcctctctcactgaagaagagaagagagaagagagaaaagagaagagaaggagaagaaaagggaagaaaaaaagatgtgcagctgacatgtggccccccgcatccttttttaaatattttgctgactaggatgccacatcagtgaaaccacccatactaccataggatcttgagtgtacgttttgagtgagtttaggggtatacatttctgattttgtggttaagggttaagggacgttaaaaaatctcgctgttaagttgagggaccttgttatcaccttgttaggcataacataatcttactaggaaaaagtccatattgagttataaaaaaaagtccatattgcatctctcaacactacactataattcgcatctcttaaccgaagaatagatatggaggctcactcaatcacaacccactcgttatttaattgcaattattaattttagaaaactaaaacgtctttgtctatctacgatggcatgttttattggacataaattcgtactccctccctcaaaagcgtttaagcatacattcaatctcattattcatcactttatctactctcagtctgccaatacaattattctcaacttccacaaaccccaatacaatagctacactaaaatgagtttattttgggacaaatgaaataagttgaaaatgaacttaatatgatacggaagaagtaatttataaccgtgacctgctgccatatgctaaccgtttactagctccttgaggccatttctcccacattccagtccaggttccttcctatatgcatgcatgcatgcgatactgtcttatcatggaccgctccacccctctgaatctccgatacgcgaaggcgttatgtcaaccatgcatggactggctggagagctaggaatgcgtacacacgcgccaagccaagcccaaaattagggcgacgaacgggacagccaagatctatatatgcctcaatgccgtcgtccccactgggcgggtgcaaaaaaataggcagccgtagcgatcgaccttctccgacgagttctctctttcttctccttcccccggcaacgagcctgacgccgctcgcgcccgcggaggggaggggaggggaagatctagaaccgcggggaagacgacggctgatggctagctatagctgattgatttagcggctcaacatatataccaaggcggcgcggccggccggcacgccggcagggtggtcgccggcgaacctcgcgtagagctcaccctcccctcctccggtggtctgcctccccctgcattggcggatcgaggacgcacgcacgtacgactcgttcgttcgttcactgccatgccggcccgtgccctcgccgtcgaatcgtcgtcgtcgtcgtcgtccctgcgcgtctgtgacgtctgctgctgactcgtggatgtagcttgattgctcgccgtacgtcgtcgacatgttgctgtaacgagccgaaaacaccagcgaaggtatggatgtgttgcatgtgcgagtcgatcatcgccattggtgtgttgcagtttgcacagtatgatttgagtaattttggttgcatgcatgcatggcagtccgttgcgtagccggccggcctcacctccggtcgccgacgccggaggtagcgtgaattcgttttcatcggtcaggatggcaatcgcggtcggccattgccgcgagctgagtccccccggtggcggcgtccgcggccggcactgccgcctccgctccgtcacccagctagactgcccggtgttcgacgaccatgacctggacctggaccgccgagagcgcaacgggcacgccggcctgtcgccgcggcggagcctctcctcgccgtgcttctccaccgtcgtccctcccgccgccgaccgcgccgagcccgcgcgcgacgacggcgagaagatgatgccgcgcgtggagatcgtcgcgggcggccacgcccgcggggtgcacgagctcatcgcggaggccgcgggcgccatcgcgacggggacgcgcctcgtgccggcgcagggcgggatcggcggcgcgctgctgctcgaggacggccgctccgtcgaccacgtggcggtgatcaagccgctcctcgacgacgcgtcctcgccgtcccacggcggtggaggaggctacgcgagcaaggccgtgctgcgggaggtggccgcattcctcctcgaccacgacggcttcgcccgcgtcgagccgaccgcgctgatcaagatctcgcgacccgccatgccgacgaccacggcctcgatccagcgcttcgcggcgcacgagtgcgacgccggcgagctcggcccgtcgcggttctccgtggcgtccgtgcaccgcatcggcagcctcgacgtccgcctcctcaacatcgaccgccacgccggcaacatcctcgtcaagaagtcgccggagagcgagtgcgccagcggcggcagcacgttgacgccgctggacctcgtgccgatcgaccacgggctctgcctcccggagcagctcgacgacccctacttcgagtggctgcactggccgcagtcgtcgctgccattctctggcgccgagctggagtacgtcgcgtcgctcgacccgttccgggacgccgcgatgctccgcgccgagctgccgtcgctgacggaggcggccatccggatcctcaccctctgcaccatcttcctgcagcgcgcggccgccgcggggctctgcctcgccgacatcggcgacatgatgacacgcgagttctcggcgatggaggaggggctcagcgcgctcgagtccctctgcaagaacgcctacgattcctccaccaccaccgccggctcatcccctcggaagcaccaccactccgacgactccgacgacgagagcacccagttcggcatggacgacgtgcccgccgggctccctcctcacctcttcctcctcggcggcggcggcatcgccaagagcgtgagcttctccgcggcggagcagggcgccgccgggcgcggcgccgcgcggaagcgcatgtcgttcaaggcgctgagcggcgacgagtgggcggcgttccttgaccggttcgagcagctgctgccggcggcgctcgacgccaagaagcgcgccggcctgaagctcaccaggctgggcacctccttctgaattctaatctccgccgccgccgccgccgccgacgacgacgacgtcgccggagctagagaagaagaagatcgaggtcgagagcttgtgtacacatacaatgcgtgtgaattccgagagcccttgttgtatttgtacgtgacgtgtgccagcataggtgtgtgagacgatcgatcgatcgagaggccatcgcgatcccgccattgttgcttgcgcgagaggttgaagttgaaccctaacatttgatgctataggggagccagggagcagctctggaatggtaacaaatgttccaacgaagctgactagcagtgccaacgatccaatgcatcgagcaaaacacaaacattgctcattgttgtgttgtgatattgacatgtgtttgtctatcgatctctgtctcggctgtctcggctgcagtttccatggatggatacgtcattgcgtatacgaattcagggggtgcttctacgcttcactcattcagagttcactttgcaaatttttttttttgtttttacactcatcctaaatgagtaagcagagatcctgtattcctgtcaagctttttaatagggaattgctaaaacactgtcccaagtttttttagggtaaagaacttttaaatataacttatagtattatagttgtagtttaaaaaagggtaaatagctaatttagtccctcaagttttaccaaaggctcaatttggtccttcacgtttcatttttgttgacggtgggtacccgtagaccggatatagagggtattggggtacgctggtacgaggatctacgtagtacgacatcaaggaaacaagagacaaagattatactggttcaggccccttaacaggtaatagccctaatccagttgatatgggattatatggaaataaccacagattacaaagggaataatagaactcggtggtaccgacgagatcgtagtcgagttgattcgactagatcacccggcgacttggctcctgtagttttcggcttcgtaggctgtggtcgttgtgtaggttatgagatttgatcccttaggtcccccaaggggtcccttttatatcgcaggtcaggcggtctccaagtaggacttggagacatcggaccctacacgatataataacgacacagtcctatacgggtaggaatctttccattggcggacttcgtgatggatttccttagcgtgttcagagaacgtctgtatatgcaccgctataccgtatttccgtatagcatacatccaagggtagagggtataccttatccgtaaccctgacagtagcccccgacttctacttaaatgaactcgtgtaaccaatcgcgacttctgatgtcggagttgttgtcgttctcgactggtcgatctcggtgtagggaccgtagagacaaagagtgatcgacaacaccatgcgaagtctaacggttatgagtgaatttaaattgaagtccaaggaaccgcttcgcgcaacggacccagaaatttccggcgtccatctctctcctttccttgggattcgcaccgtcagtagtgcgcctatttaagggagttttgggaatccattttggagtccggcagttgtgagaaactttcaagccttccagagctctttgtcttctccgcttccgcacaaaccctagcttgttcatctcggccccttctccggcgatcttcgaccggaatggacctcgacaagtccacttctaccagcgtgtcgctggagaagttgcaggaggaaggcgctctccctggtcgcgggaccatggagagggaaccaggaggtactgaacctgaacctgtcctgggtcgcatggttgcggtcgaggattacattctttgtggttttgttcctcctccatccgagtttcttcttttagtcttgaatttctacggtctctctttgctccatttgaatcccaattctatcgccttcctcagtatcttttcccatatttgtgaggcctacattggggtagagctgtttcttgacctcttccgcttctactatgagttgcgttggatggaatccaacagggtatctggatgtgttgggttccgacttcgggatggcctgaagtctcgctatatccccttccagtgcccctcttctcgtagtaaatgacgggcgaggtggttctatcttcagatagaaaactcggacccagtctttgttgttcttgaggaacaaccagacaagatttcgtcttggaccgtcaaacccgccttaaccccctcccttcaatccttcatcgatatcgtcgatgacctccgagtgcgagagttgtcgggatatgaagtcgctgccgacttcattggtaaacggatccagccgctccaggctcgagcccatccagcctttgactactcagggcccaaagacgcgacccgggtttctccttggggtatttttcttgtattctgggttccattccttaagtgcatgttcctcccgacttatcgattttggttctcgatctgcaggtctgaacagcgagaccgtagggcgccgcatcggtcaagtgatgatcagcggccctacaacagcgagcaatgtccctgttcctctctgcgagaattgggcagccgaacgtgaagctgcaatcaatgtaagtgtactcggcagcccttttgcctttttaacccgtgggttgaaaatacccgtaggcctagcccaatatgcagatggcccaaggcccataaccatcaaaaccctaggtataaatcctcttttcctcactcctctaaatcctattccccttctcctcctatcctctccctcctgtctccgtttctccgccgtccctcatcccccaagcgcccaagccacggccgcaccgcacgggcgcacgccacacgccggcacgccaccgcgcaggcgcgcacggccgcagcaccagccgccagccggtctcggtctcgccgatggagtagggcgccgccgtgcgggcagccgccagcgtgggggcagacatccaccgcgtcggtcgccgcctggggcagggtccagggagccagggacgctgcttcctaggggcgggatagccaccgcatcgatcgctgcttgggggcagtgtcacaccctgaagttcttttcccaagcctaaattgaatttttaattggcctcaagaaaatatcggtgtaaaagcaagagagaaaccctaaataaattaatgcgaataataatcggaattggcatatggaatttttcttgagttctacatgtcgaaatgtgctaacaagatttttagtggaattttcagagctctagaaataattttaaccaattaaaatcgagcacaagcaatatttaatccgaggaaattcatttccttctttttattttcttttccctcctttttctttttcgaatgggccgccggcccattctcttcctctccccctccgcgctgggccagccgaaggctacggcccagccgagacggccgcctccctcctctcttcaggtcgccgacaggtggggcccacctgtcgggcccgtctcccacctccagccggcgccgctgcatcccgcaaccgccaccccgctcgctcccgcgtctctcgggccacgtcgcccacgtcgctgcctgcgcccgccttccccgcgcccactccctctcttctgcccgcgtccgcgcacgagacggccgggattcaatttttgaatcccgcctctctctcctccccacctctctccactccgccggcgaaatcgcggccaccccggccacgatcaaccctcgtgagcctatataaagcacccccgttccctcctctctctttttcgttttgcaatcgcccgctcccgtgcactccaccgccctagcaccgtccccctcctttccaccgccgccgccaccgctccggccgccgctagccgtcgctagccgctgcgccaagtcacgccgtcgacgtcgtcgcgttcgccgtcgtgcgggccaccccatccacccccctcccgttggattccgccgccggaacccactccgcaccgtgtgccggtgagtaatgccgtggccgccgccttcggccggtgttcccgccatc

SEQ ID NO: 58488 - DNA, 94330 bp, Oryza sativa
  unsure (1)..(94330): unsure at all n locations
agtggacagtcatatacagtaaataggctgtactagaataagaagatcagatatgtgtaactaacaaggcgcatttgtgaaatacccaagcagtatatttccactacgaattatccaaacaattaaacataaacactcagaagctgcacaagacactacattactaactatataataaacaagaggaggaggaggaggagcaaattcagaactcaccagggcttacacgcgaagcattccgctccacacagagctgactggataccgcggtcgagcaattctccgccgaagcatagcagcggtcctgagaccggttgccaaacccggcataagaaacaaactccacatcatcgtcggacgtcgccggcttctccaaatcgatcacgtagcgatgcccgccacccccgccgcatttctcccgcgctctgacgctgacgtcgggctttatccggatcgaattcctaccatccatattccgctccgcgaagcaggagcccctcttccgcttactagaattgctggaagcatctgggcttcccagcccggacctaacgtgatgcatgggggttgttcagctgaacccccgcaaaaaaacaaaaaaaaaatcctccttttttttttcctagcctcctcctaaacagaagctgctgctgctattagtaccaggtgagggcatggggattcagttcaaccccaaacttttggatgaacaaacaacaaactgttactcgtattaaggttttaaggctctgaaattaagagaaggagcttcttccagatctagaagagaagaaactagggttaattcgagacaaaaggcactcccgatgggagtgagagatgaatcggaaagaggatgcggatggatgctcaccaggatcccctgctctgctctgctcgcccgatggagatcggcggcgagatggcgcaaggagcggaggagacgagagaccgggagattttcttttacgccgagggaaaggggggagatacgcgagggcggcggcggttagccttcgttatttattacaactatataattttgtcccagttactatacagttttatatcctaatggccgaaatacccttgggatgaaaacttctcaatagtggtaaaaaaattgaaatatcagaatgtaaaacttttattaagtttaagacgagcgacttatgtggtagtttacaatgatatttcggaatgttcagtctgattttgaaaattttcaactcaaaccgacctatagtgggaccaaactaccggaaatcatcgtagaggctcacctatcagtccctggtgaaaaggcggtgaagagaggtggtgtcgaggggtgaagagaggtggtgtcgagggttcagccgaaccgccttcggcacccctcatctccaccctccgcgtggcaactcttggttggctccgaatgacgatcatgggagttaccgacctccctagccattataagctacctacttaaagtagttgagcttcttacttcacaatacacacatcaaggagcaattctttctctctatctcataatgcattctctatagtttagtagaaataaaacttaggagctttagtcctattgttttctcggagttttggatatgtctttagtagtttactcttcttgtaaactgtagttgaattaatagaattatattctttatttatttatgctcataacctatgtctttctttattgaatgcatgttctatgggaagtatatgcttcttatctgcttcatcctaggctagttgatccatgctacggtaacggtccaatgacctttataggttgctctaactcaaatgtgaccattcgaagggtgggagtcccaagggagttactgatattatttactagcacaagcatggtgcttagattagataaatgtttgttggatgtgggtgtgccccacgaaaagtgaggtaggaggcatgtagtgatagttctatttgttctttgtattcctccatgttcaggtatgacgtaaaagtgcgtaaatgccataacctatgctggtataccaacaggaagtggtctctcgatagtatcagagtgcccggagctaggtcctttgttgtaagtatgtactgcataggttaagtgtatactagacatgaatagaattgaagtaaaattacatcgtggttatctaatgctcttttctactaaacattattatagaggtaaatcttctaggtatccactaccttaattatattatcctaacccctattaaactatggtgaattaattatagattattttatgatgaacaaactatatcatatacggccatcttcactatgaaatataaatgcgatacccaggagaagagagacaacactagtaacagatgaggaggaaggggagcgaggggtatattagtcattcattgtcattgaaggagtagctttttattgtctggtgttagtgacattggtctgtctccctggctgcaatatgtggctcgcaactgcgattgattaaaaaggctttgggtgcaaaccataccctggttgaaaaaaaatctttatctattggctactccttccgtctgaccggatgtgacatattctacgtatgtccaaattcatcatactagaatgtgtcacatccggtactagattagttttttatgggatggggtagtatttgtcaagttaatatttatcatctgaatatatgagaaataaacacccaaaattgttggaaacattattcggttcagaccaaagtcaccataaacaattctatgacggttctttacgagcgattagccgattaataattgagaactattttaggtgtgtaaaagtaatcttacaatagttctccatgggtgatagataattgagaatctttttctgattaggtgtgtaaaagtaaatagtataacgttcttcgcttgatattttcttttccttgatagggtatgcaaaaatgttcacatgggagtaataaattagggtttggttaattaaggtttggttatagtcacatgaatcatgcatcagaacacaccacaaagtcagtctcctaattatttgttgttccaatatactccagtactaatggagaattgacatcagcatgtacgaaataaaactgacaactgagaattctttggatactaggtcggtgtaaaaatatataaaatgttcatacattactagtagtactaataattagggtttgattaattaaggtttggttctagatcacatcatgcatgtatggaaaaaaaacccacaaaaaagtctcatgtttggctattaattccaggatggtactactactaatggggaataattgacatcggtatgtacgaaaatgagatggagagctgcattttttagatgagatttagctgcagatagtactgcactgccttaacacaggaccatttcacatgtgtggttgaacaggacagcatatatggcgtactaataatggaggctaacacatggcccgcttgtctatcacaaaacaggtgtgtgtgcacatcaacaaagttatgtgggcacgtgcaagcctggccgatttcactctcatgccgacctcaaaactggcccggattgaaaaatgtttatgcaattatacatattaaagttttcttttaatataaacctcagaaaaaaaggctaaagtttttccatatatagaatcattgaaacaaaacgtttttgtagttgcaaatagtcgtggccaggaagcacccctgatgaccacgaagaatttcgacgttgctatagagactttattttcccctttatttgtctggactatatcacacgatatgttaaaggtctggattaattataaccggttgttctactctctttgtcaaccaactttttctttaaaaggtaaaataacttttatacacgattttgaatataacatgtgtgttagatttgtgtgtataaatgttgatttattttgaaacgatgtaagtatcctcggagtgtttacatagtgtttatctgaaagacgctaaggtcatttccaacccaatgactaggatagtgtccatagcattaaataagctgacacctaggattaaaaatgatgtggcaagtgaataaatgaggaaagaaaagaaaaccatatcttacatgagatatggtttctacacaacatctaagacatatatgagataaatagcattaaacttaagtataaaatagtggtacttgtattgaaaaagtaatatctagcactagtttcttgatgatttggagtttatgaaaactacgtctaatttcttaagttggaaatggcctaaaagaagaatctttcaaaaggaagagatgaggaatgaaaaagagtcaaagctcatgaagggactcaagccaacgcaaggaggccaagtgacagcagccggtagctgtccccatctctacaatatccagcacccagcaaaatcacacacgattctcagcttcttccccttccttcccaactcatctccatctttttatttacacgcacacttctcaaactcgcaaaacgatacggctgaaaaaaaattccctttataaaaattatttaaaagaacatattaatctattttttaaaaaataagataatacttaatcatgtactaataagttactttgttatacgtacctgaggattactccctctatctcaaaataaccaatctcgtataggatatgacacaatctagtactacaaatctgaatatcatatactacgaatccaaacataggtatgtttatatctgtaatactagaacatgtcacatcatataatgagatactctattcgtccgtaaaaaaccaacatagtatcggatgtgacacatcctaatactataaatttggacatacatatgtctagatttatcgtactaaaatatatcacatccagttttagattcgtttttcatgggatgaagggagcaggtttattttgaaacgaagagagtacaccacatgcctacgcagcctcatgtccagtcgagtgtaaccacaagcccacgggaatttgctgtccaatgaagaccccacaaaacgacaaactccaataccacacacctccgcttccctccaaatcgcaacagaaatccgaagcgaaatcgcgcacgcaccgtctcgcgatgccgtccccgtcgctccgcctcgccgtcgtcggcgcgggcgccgccggcctggtggcggcgcgggagctcccccgggagggccactcccccgtggtgttcgagcgcgccgcctccgtgggcggcacgtggctgtacgacgccgcccccgccaccttcgacccgctcgccgccggcgccgcccactccagcctttacgcctcgctccgcaccaacctgccgcgggaggtgatgggcttcctcgactttcccttcgcctcctccgccgcggaggccggcggcggcggcgacacgcgcaggttccccggccacgacgaggtgctccggtatctggaggagttcgcgcggcggttcgacctgtacggcctcgtccgcttcgggacggaggtggttagggttcggagggatggcggcggcggcggcgggaggtgggcggtgacgtcgaggaagatcggggagaaggggaggcgtgaggaggaggaggaggtgtatgatgccatcgtggtttgcaatggccattacacggagcctcgcgtcgcccacatacctggtaatctcctcgtcactagcaaagttgcaatctaatcaattttgcttgaactactcctaatcatggacagattcaaggaattaaataatttggtacttcgtactgttgccaatgtatggttgcaatgttgtgatcgtcgaatccaggaaggttaatttaactccaaattgaactcaaccgtttgaagttttgaaaatagattgggattgatttcaaatctgtatttttttaacactgttatgatgatcatcaaatccaggaaggttaagtaaactcaaaattaaactcaactgttaggttgggattgacttcaaatatgtattctttaaacactgacaggggtggaggcttggcctggaaagcagatgcatagccacaattaccgcgttccagagcctttccacgatcaagtaactgtctttctttacctgtgcaatctttcctatcatgcatttgtgcttaaatgttatcttggttgatgcgttgcacttgtaggtagtgatcataatcggggcatcagcaagtgcagtagacatctcaagggaccttgcaggtgttgcagaagaggttcatgttgctgatagatcagcacctgcctgcacttgcaaaaggcagcctggatatgataatatgtggctccattccatggtaaacgcccttttctcgtggtgagtgatagcatatggtagctttatccgctgaaagggctgccacatttagcacaactagaaaactaattttcaagctgcagattgatcatgcacaagaagatggctgcgtggtgtttcaggatggcagctcaatcaaagccgatgtcatcatgcactgtactgggtatgtaaacctgcactaccctgcaacccatttctcggcttcttgtgcgaaattgcatttttgttactacctccgtttcaggttatgcttagattcattaatatcaatatgaatatgagcaatgctagaaagtcttataacctaaaacggaggaagtacttcagttgaaactaacaatgtgttcctttcatctgcctgtcgactagctacttgtatgattttccattccttgaggatgatagcgccatcaccgttgatgacaactgtgtcgatccactatacaagcacgttttcccaccagaagtagcacctcacctgtccttcatcggattgccatggaaggtcattatgtgtgcaaaaagtgatgccattcactttagatgcacttgtaattaagttgtcttgatcttgtgatgatcataggatgtaaagcattcccctgccttgcttcttgcaggtcattccttttccattgtttgaactccaaagcaaatgggttgccggcgtgctatcaggacgagtcaagcttccttcgagcgaagaaatgatggaagatgtgaaagccttccactcgaaaatggaagcgcgtggatggcctaagagatacgcccacaacttttcagactgtcaggtagcctggagatgctttgagtgtcagttaccaaagttctaatgttttgaaacgaaattaataaatatgattgtcatctacctgcaatttttcagtagtttcgtttatgctcccttgataagcttgttttcatttccagtttgaatatgatgattggcttgcggagcaatgtggccatccaccaattgaacaatggaggaagctgatgtatgctgctaattcagagaacaaggctgctcgtccggagagttaccgcgatgagtgggacgatgatcatcttgtggcagaagcagcagaagatttcaagaaatacttgtaaaatctcaagaagatttcattcaatgtacatgattgcaaatttgcaatgcagaaaacatcagagaataattctgtacacccaaaatctcaattcatgtctggaatgggcacaaatgctcgtcatcagatagttggtttacttgtgtattatttgatcatttgatgcctgtagattgtaataataacctgaagcaaaaacaagagaataattctgtgcatgagaaaggagaaaccttgagtctggaacggatatgctggtcttttttatagtctcttgggaaatgaaattatcatttgagctttgtaggctgtgtaagatggcaaaaaaatggtannnnnnnnnnnnnnnnnnnnnnnnnnnnnnnnnnnnnnnnnnnnnnnnnnnnnnnnnngtcgccggcttccctgtcatcagttcaccaacttccttgnnnnnnnnnnnnnnnnnnnnnnnnnnnnnnnnnnnnnnnnnnnnnnnnnnnnnnnnnnnnnnnnnnnnnnnnnnnnnnncacccgggcctggtcattgcgaccctcttttgcgagggggcaccccttctcccgaacccgggtctgtaccgtggcagggtactattctaccactagaccacaggtgcttgttgtgttagttagacaatttctcaattaaatagtctatattttccctgcaaagcgcaaacaaatggttactcccttcaatgtctcaagggaccaaggctgttctgctgcatgatttcatttaatcatctcatcaacgcatacaattattaggcaaatatcaatattacctttcattatagcagcaattcgccttgaaccatcaaaaaaacaacaagaggagcaatagaaaagaaaatgaaaatctaacaaaaccaatgtactccacatccatccgcccaagtgtgaaggatgattggatgaaacataaaactaactactcattcactacaggtgctcaaatccaaacttgagcatatgtcatcaaaaccatttcttgagttctagggtccaaaaaagatcgctgcgaagtgaaaactgatgcttgcctccctccatcatgctcaagattgtcaactgtttcatgatttcatttaatcacctcatcaatttatgcaagtataaggccaatatgaaggtcgctcaatttatctttttatcatagcagcaatttgctttgaaacatcacaaaaaacaagaagaggagcagcagagatgaaaatgaagatctaatgtacatccgcccaagtatgaatgatgattggaagaaagtaaaaaactactgcttcctccgtttcatcatgtaagatattctagcattgtgcacattcatatagatgttaataaatctaaatatgcatatatgtttttatttattaacatctatatgaatataagcgatactaaaaagtcttacattaggaaacggagaagtactaatcaaaatccaaactggagcaatatgtcatcaaaaaccatttcttgatcctaggactcgacggcgtcgtcctccagcgagtatatcctctccggctcgccgtcgtccagcgcgcggacccgcctccgtatcctgcggagcgcgccgtcgacggcgaggtcgacggcgtccttggccgtctcgctcagctccgccgtgctcccgtgccgccggtacagcaccctcggcgccatctccagcgcgcgctcccgcatcctcctcacctcgccctcgcccaccgccgccagcgtctcggcgatcttgacgccgccgaacaccaccgactcctttggtatgtacaccgagaactcgtcgtacctctccgggggcaggtgccacccgtactgccgcctcgccgccgcgtcctcgaagaacaccgggacgcagccggcgaggatggcgtcgaacgtggagcgccgcgtcggcgtgtcccccggcggctggaggcagaacctggagtgcagcatcggccgcatgtaccggatggggtcgtgcgagcacctgccgccggagcagtccacgacgacgcacgcgtcggtgcggttggcgcactcggcgaggatggagccgcggatgttgggcctggaggggcgcgacacgccgccggagaagagcatcagcgcggggcggcgggcgcggcgcgcgcgcgccagccacgcgcgcagccgcggcagcgacgccgggtggaacgacgtcgggtgcgggatcgcgtgctcctgccacggccacgcgcgggactccagcgtcaggaacgtgaggttgccgagcgccgggagccggagcagcgacgtggtgccccacagcctcgcctcggcggcggcggcggcggcggcgcgcaccggctgcgagtagtcccacgcggacccggcgagcaccaggaaatggtcgtggccatggcggcgcgccaggatctgcggcctgtcccgcgccaggaactcggccagctccgcgccgtgctgcgcggaggagtcgaggagcgccgggtcgagcacgtaggggagcgagtcgaggcccgcgtagtaggggaggtagacggcgtcggcgagggcggggtcggcgacgaggcagccgcgctcggcgacgcggcggtggaagaagacctcgaggaggcgcgtgtcggtgcggtaccaggagcggctgctggagtgggtgcgcgggccgaggccgtggttgacgagcgactcgcagggcggggacgaggtggccggcgtcgacgggtcggcgagcgggaacccggcgtcgcagtggcggaggaggtgcgcgttgaatcgaggcgggaggcgacggatgtggatccgtcggccggcgcacgggtccttccgcgtggcgccgccttcgccggcgccggcggtggcggcggcggcggcggcaaggaggaggaggaagaagagaggattgggcattttgggaggagagagaatgtgtgggtggtcgtgtaactgaaactgcacggttatttcagcggatgtgtggctcagatttcacactttaatatttttctcctgtgcagttattttcagcggttaaattgcaccggttaaaactaactgccatcatgtcgtggattaagctttagtgcatgttttgggggtagtttttggcgagttgcaacttttcttagaatttttaggtgttagaatctctctcaaacagttcagatttttatctaaattttaaaaatttgtatgaaatagaacttagaagttaggaaacttagttttttccagattctcaccggtaacattttaaaaccttaacctccccaaacaagatcttagtctggcctacatacagttttctcttctgtggtcaaattgagtttgatatttttttcaaggaaaagcttgttcgcctaatctctacgagaaaggaattgttgaggaggattagagatgattaatttcacatcatccctctaattcctcttcaattttctcttgagggagggattaactgaacaagacaataaattattctttttctttctgggtgtaaagcactgaaagaataccgaacgagaagcagttttgcacttgttcagaagttcagacgctggacgaacatccggtcaaaaatattccaaactcacacgctgctactctatatatataatatattggatgatctgggcctagcaacttcttattgggccatacacagcatgttgttagctgggcctattttttccttggaataagttcatatgaggtcccttaactttacaccgagttcgattttcgtccctgaatcgcaataccagatacaacggatccctcaactgtcaaaatcggtgtagatgaggtccctcggcgggtttagattgcggttttaactgatgtgtcgctgacgtggttagtttgacttactccttatcgtatgaagcggcgatgtggcacttggaagcaaaataaaaggcgggacccacgtgtcagtcattaaaaatagtgggacccaccctgctctcttgtcccttctccctcccggccattcttcatccttcctcgagctccctagctggcaggtgagcgtgcgcggagagggagaagggcgccaaccatcgggtggggagcccgacgagcgtgcgtggagaagaagcaggcgggtaggccgacaaccgggacgggtaggtcggtgagcgcgcggcggcaggcaagaaagcagcggccggaactgcacgaccccccccccacccccggcaccgccgcatcgatctgcacgagttgcggcgacggcgagctcacagccgcgggacacggacagcgtggtgttgacggggcccgggactcgagctcgtagccgccgctgcccacttccccaaccccctccacctgcgtcaaagtttttgatattcatggcattctgctcttgttctggtggattgattgattggtgtgcttgtgcggatgatttgtgcgaaggcgacgccaagaacgcccacctgatgtctctggacggcgtcgcggagaggctgcggctgttcaaggccgacctgctcgactacggtagcgtggcggtggccatcgccggctgcaacaacgtcttccatgtggcctaccccgtgctcctctccgcccctaacccaggggcacacctctctcttttttcagcaaaataattccttttcttctccattgacttgttcaaactgtagactgcagttactgaaaatcgacaaaatcaacagtttctactaaaaatgatttgtcgaaactgttgatttctcaacaagcagtagtagctgaagtctgcagagttgtaattaaatcgtcatgttcttgtagctaaatgaattgatgttgttgtaggttcatacacatgctgctgctgtaacgggcacgacgaatgtgcggaaggcttgttcagaagcaaggttgggacttgggagggttgtggtggtgtcatatgtatctgctgcgatggtgaatcctaactggcctgaaggcaaggccgtagatgaagattgcaactcgtgcagatcgatgcggcggcgcagcaggagtcttcgtcggcggcggggccgaggtcgtgcagctccggccgccgctccctcctctcccgtcgcgcgcatgccggcctaccctccccgcccaatggctggcgccctccgcacttctccccgccggcgcccttctccctctccgcgctttctccggccggcgagggagctcgaggaaggatgaagaatggccaggagggagaagggattaggacgacggcgcgatgaagatagagagcagggtgggtcctactattttttaagactgacacatgggtctcaccttttattttgcttccaagtgccacctcaccgccacataggaccaggactaagttaaactagccacgtcagcgccacatcagttaaaaccgccatctaaaccgctgagggacctcatctacaccggttgtgattcagggacgaaaatcgaacttagcgtaaagttaagggaacttatatgaacttattcctttttccttcgctgataagctgctgggccagattgccacaggccatagaagagaagcccatttaaatccagcacttgcgagccgccacggcggctggctctctactctagtcccatccaacgtgctgtactagcagtttcatccaaaaatatactacccctatgtttccgtccgtcccaaagaaatccaattctaaaattgaatctggacatagtgtatgccgtatgcccagattcaaaatctaggattgagtgttttttaagaatggaggaaatagtatagaaaattaacaccagatgagacacatcatatattgtcctaaattaaactctacggaaaagacattcaggtagcactccgaaatcagaaaggagaaaaacaaaaggaggcggcgatcttgttgaacacgtgcgtgcaacgcaattggttaagagtacattcactagtagtgacaagtgagtgagttgattcgtgaacaaacgatatgatgatgtacaggtcggatacacgtgtgtatcgtacgcacgtcgatgcgacgttgcacacgttaattaggagtattctgtcttgtgcgtacgtagctgctggctgctgctgctgctgctgctgcgtcagcacatcgttggatcgatcgagacgcgctgggtttaatttcgtcgcgttggtctcacacgaacgccggcataatctatcgctagatattactcctccgtattaacgtttggcaaccttagcattttatttttggcaaaagaaagtgttgcgccacaggttaccatcaaatcgtgtgacaaattaatgttgcggtgaagttagctactctctccatttaacagtgtaagactttctaacattacccatattcatacatatatgaatgaatctagacgcatatatgtgtctagattcattaacatcaatataaatattgacgatgctagaaaatcttacatcgtgaaagtagctagcagcaatcggttttaaattttacgacctctcgtttcgaagctagtttaccagtgtgctggtcgctttcaatactatcgttaacttttggaaaaaatatataaaagtaccaaaagtcttacctcaaattggttttgttcacatacccttggttaataaaccgtagctaaaaacaacacgcaatgcattatgagtttatttttcatccatactacacataccaatacaaaagaaaaaaaaactagaattctcatatactttattaaatctcaataaaactattatccaccttatctaattctaatacaattatttcttgttttaaaaaaacttagatgcaataattactctaaaaataaatttatttttgaacaaatggaaggagcttaaaacgaacgtattactaggacggagggagtatgagtatgtcttacaagtcaaatcatgaacagtgaaaacaagagttccagtaaaagaaaacacaagtggacgccaagactgttagatcacactctattgtgtcatgtggcacggcgaaaacgtcaagactgttgttatgtacacatgatcacactctattatgtcaccagcattgtcatgtacacatcaacacatgtatgatctcgcttgtcactagcacatatatagacatagacatgtacactactagatgcaaatagatttgggaataattttgtattgccatataagaactttgaagtcgctggcatgacacagtgggagaaaatatatattaatattggtaatcgttagggttagaattgtttgaccgcccaatcagcagtagctaataagcaatatcttgatccaacaccatcggggtaccatgtgcaaccattgccccaattggttaaacggttgcctaattaaacctgtgggatcgtgaccagactagtattgttattgtaccgctgggaggaacatctcgatcaagtgaggtgtaccattttctgttaaaaaaatgcaaggagctaatatatatagttgctatagtagtatagtttaggagacaagttgttggaacgatgcagagacatcatccaagaaatacctttgtgacccttgtctcgaagcttgattaatctggcctcgatcgtgaagatgtactattgtattcatcatatttcccttgttgtgtagttagcatcgtttcgtggttatattatcttaattggaatgcattgatcttttttaggtaagccctactttttttagaaaacgggattacatgccaaattacataaaacttcctttttttggcttcagcactgttttcaataagaaaaataacgaacttcctgtctctgcactcacttatagatacaagcaaccatccaaactttttaccttaatttacgcatgcattattcatagttgtataggcaaaatcaatatcattaatgagaagtactctactccatgatatctccaataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatatcatccacatggcaagtacaattgtactactagtgattggcaaatttcataagcctgtccgaaggaagtactaaagaattaatctgcaccatctctagggacagacaaaaaaacattattgagtactcacaaacaagaaaaatatgaaaaatatgtagtgaaaatcatatatgtactagaaacttgaaaaccacactgaaaaatggagggcatatgcaataggtactggtactagctagctatcagcgtgtaggtgtgtttgaactgtattaacagtttgagtacgcagattaatgcaaaaccatacatactaatacggtgggcatatatgcttagtttcattgatgctagctactgctcctaattaatcctagttcaactcacaaatcaaggaagaaacatcatttgattaattgaaacagagcaggtacttgtactccctgctagtacaattcattcttggaggacaagacatgcaagctttgctagcttccttcgttttgtcaaaggacacagcgtctctagaaattaaacgtgtcacctgtagaagttaaatctccacgcaataatcaacctgtccagttagtccctgtccggcaaaagattcagaaaatttttaattagcccctgtcaatgtctgaatcgatcagcgtacacacacagtatgagtcatggcgatgtggacgtacatacttcacgacatccctccgaagtttccgtacaatttcatgagcttgacactccccgttaatctcttgtttaatgactatacttgtagttgtaccacgcgattccatgaccttgactctttcgttaattaacctcttgtttaatgactacactgtacaacgtattactggtaggtagcttgtgtcgagaaggaatttttcgttggtccatctgttcatgatctgcctgcttctgcttgacctagttaaggccccgtttagtttcccaaaaatttttttaaaaaaacatcacatcgaatatttggaagtatgcgtggagtattaaatatagattaaaagaaaaattaattgcacagttaagaggaaatcgtgagacaaatcttttgagtctaattagtttatgattagccataagtactacagtaacctacaggtgctaatgacggattaattaggctcaaaagattcgtctcgcgattttcatgcgagttatgaaattagttttttcattcatgtccgaaaatcccttcctacatccggtcaaatatacgatatgacacgcaagttgctgctgaaattgccaagcaatgcatgactcggacatatgtgcgcaccgaccatgaatttttctctgaattttccttgcgattctctgaagattcgacaggtatctcgcacacaaatacattcgtatgcgtcgtcgtcgtcagcgcctcgtctgcagagagagagagagagagagagagagagattacgtttcgccgccgccgctgcatagctgcagctaaattgcaccgacaaaatcaaaacgtctcgatcatgatctgacgcgtgatcgatgtggctgccgtctcgatcgctctacacacgcaatcgatctggactctaaattaaccaactcgatcgatcgttcgcgattaatttagccgccaaattgggcataattaaacaagagcgttattaattagcacacagggttttgggggtcgtcgtaatcgaagaatctgcagggtatcttcttcttcgtcgtcgtcttccatgccctcacgcaaattaagcgaggtagctaaaattttcgattactaattagtaaaagagtcttagaatctgtttgggagaacttaaaattataagatgtagctagatggtagtcaacttttgagaagaaaaagcttaaatttcaagaaacagttgggtggtaactagcttctaacaatttggagaggggctggcctagttccccagcttcagaattcttgttcattttcctggattctataatacatttttttcaaaatctgagagcctgttcacttttgatgccattttttcaaccataccattttttagtaaagttgtcaaaaaatgtctatgtttagtttattgtcaaatttagtcaatacacaagaaatcctgttaaaattttgataatattaccatcttgctaaaatttgggcattgccaaaatttagtaaggtttattttggctacgatctgaacaggcactgaacgaaaactgaactatttagggagtttttgattacgagagaaagtagtatttagaagctctccaaataaaccattagttcttgaccaaaagattaattagttacacgcgggtgatagctagctaggtgatcgagatggtggtggtatagctagtagtagcaggcatgttcctgtcccgacaattttgccgctgtttcctccccatcggtttgattttgccttgggaaaccaagctagtttgcaacgcgtggagccatttgtataatcgcgtgcttaatagtttaattatcgtgaggaacgaactaactaactatagtactagctgatccctgtctctacatataataatcttagcaccagctattccagattttaccagctccatcgtgcagatcgatctcacgttaatttttgctgaccttcgaaattgctgaaacttgttcggtacattatattaattgacttggctagatgtataacttaaaaaaaacaagagatttgttttgttccagtaaaaaatatcttggggtacgagtacagagtatctcacgatactgaattgtactatcatgaggtaccagtaccctcaggtatttttttctggaccggagcgaatcgtaaagtatttttagaacggaggtaacaatacaatgtttatctacagctagcggtaagtatatatataatgcgttaggtaattaattggttgtatacattgctatggccttgcacgcaaaacacattgccgattgcatgacgtgcaatttcaggctttcagctgggctgatgaaacgacgggctactaactggaaagctctgatataagttaggacatgcagctgtctcgcatggccgacgctagcttagctgttagcgtcacatgaatactgtgatcgactgacccctgcattactagtagaaattaaactagcttagctagccaatgcgagcgaagtaacgcacatgtctgaaaatccggacgtctcaactgtgagattgatcatatatgcagctagctgaattagcagccggtatagctttgagagaaaagtcctataaatacaataattgacctcaccttgcatctactagcatttgttattgaagtcagtcaattggcttttgctgctaagatagaacatgttaaaggggtgtttaatttggtttatggtcacattttgttacaccatattttttgctgacacaatttattagatatgagtttggttcgtggctcgtcacactttttcaatagcatgtcctatatattatagactcaatttttttgtcaactttatcataattgtgactattaattcgttcattatacttttgtgactgtcacaacttagctaatcttagttatggtaaaatgtgatcggtaaccaaacacattccaattttaccattgttggtttgggcacacctaccatgcgtaaagtataggttgaattaaacaaagtgagaaaagcatcatggggatgagtgccccgtgcgggcatccaatcaacggatgcagcagttggtccgacaagatccgagcaacactgcaaattgaccacaaatggcaagaattaatctccccttgttttctttccccttctccaatctatacctggtcttctcgtgccactgtacggccgcgaaaaattttaagaaaaagaaaatccatgacgacttaagccggccccttgttgtctgctttagtagcttctcagccacagctaaaaatttaaacttaaatatttaagaccttttcattatattgtatcgctagctaattatataggtatagaaatttacttaaaaatattttttatttgtttttcatggcttattatcttaacatttctaagcagagatgctgactatcgtcatgtttaagagaccttgagattccgagaaatgagaatatgcaaaaacattggtcgggtgccctagcttctactttcttaatatatttttcgaattttacagctacaaacccctcacaattcagataatcttttttttaatatttaagcaactacagattctttcattttcaaacaatacctgtagcgctcggctttgatgaagctgtttccccatgtttggcggatccacgtcattgccagctcatcatctatacactgctcgtgctagctagcttgccccggcggttgcggctcctcctcccaaagggcaacgccggccgtaccacctacccccaccagaaaaggcgaagaaaattagtacagtaaaagttttttagtagtgtttgagtttgtcaccgtcaagcataatataaaataaaacaccacattttaaaaaggacgcttcacattgctcccacaaacacgcagaagaatttaaccaccgcctcctcatcattcacacgattgattttagtttggtgtagttgttgacatttttttcaaatatacccaaaaaaatgtatttcaaatttgactctaccgctaagcgttcaaaatctgatggccacaaatattagacgcatgtagctatatagatagactttcaacaggattttagcgagatcacggatatgtcgctcgcatggtgcacatttaaagtgtggtgttgtatatacagtgatgtgtgcacatgcttatagtaataaaaaaatatgtttggaagcaaaattaaccaaagagatgaagggcaaaagcgtcacgcgcgacgcacgagggcggtcgacttgtcccgggccgaatcatgggtggggttgggcggaagctggtcacgtggcgccactcgtggccacggtccgcccacgtggagatcccgtggagcccacgcaggcccacgcgtcgacgcgtcggcccatggtcgagccgagaaagtggcctcggccacggtcaaggaatcgaggcccgcacggatcccgggcccaccacgcccctccccccacaccccccccccacgaaccaccatcgccgtcgcttccgtcgacgtggcgcccccagatcatcccacgtcagcggaccacaccccgtgggccccatcgcctcgctttattaaaaaaaaatcaactaatcccgtgatgcagaaaacgaaacggaaacgcaccgaaacaaccgctaactacttttccctctcctcctcttctctctctagagagagaaaaaaagaaaaaaaaaagaaaagaaaaagaaagagaagctctagagagagaaacaagagagagagtcgccgcctattaatacacgcgctccgccatcttctctcctctcccctctcactcctcccaaatcccctccattgccttcctcgcttcgcatcgccgctcccgccgccgccgtcgggctgctcgccggcattggggtaaggccggcctctctctccgggatcagcttctgctcttcccgttgtttgattgattgattgattgattttttttttggttttttgggtggggtttctgacgcgcgtggtgatgcggtggtgtgggaggtctagattagatctcgggtggggaggattgctcgtcgtgatcgggttgtgtgtgtgtgccattttttggcgtgttcgatggttggatgctcggtccacgtctgcgacggcggccacgagtttgagctgtccaaacccgggacgaaaccgaaaaaaaatatatgcaaatttgtttttggttcaattggtgggaaggcggaggacgaggacgaagacgaacagtagcagtagcttctcttgccgttttcctcaatttttgtttggatgcattagcaaggagaggacaaaaggatcctcttgtttttttcctttcaagaatttcttttttttatttgattgatgattttcgcagtacatatgggcttgtcgtcgcatataatgcgcgctgaaagttctggttggttggggggtttcctttcactgccgccgtttcggggaggcatgttgcatctgcctggccacatgacgcgagagcagattgattgattgatgcactgctgatccaatcgatgtgttagcgtcgtcggaatagataatcacccatcaatgcaacgaatgaatgatggaagtttcgacttttttttctttttaggtgctcctgttgagtgctcaacataagccatgtgcccttgtcctaaatttagctcatttgcatgtgtttattagctgttaattgatgagatttacaaagggatttccttgtctaagtttctttggattgataatgatggatgatggatgaaaagtcgttttccgactagttttttttggtgctacctaaagtgaatcaggcatcaccggttgagggcgtgccccatttttcattgtcgctcgggaatcttcagaccaaaagttgtactaattaatttccttttttaacttgcaaagacaaaaacagtaaccgtactgtagggcaatcagatcggtgttgtcagctcttcctgcattaggttatctggtgttctgttacataataaaggtttgtcgtctttgttctattgcagtgttggttgtgaccgtatacaattattgtttttggagctgagcgatcagatgcatgagccttccttttaaatgatctgtgtccaccatggcgatgaaccagtaggaacctgagcagtatgttatcatttttcagttattgtctttttttttggtagttgaaattattttcattattgcagaatgcaggaacttcccgcttaatgggctggatgcgttgtatgcacgtttgcagtgacaagaagacattgaaacgttggttttttattgacaagagggttggttgagtgtctaactcttaaggaatcctatagtctacttgcttgctcttgtgttgttagtaactgttcttacaacaactctgcggagagttctgttgatggatttgaagacaagcaactctcctgttattgctgatcctctccctaaattagccttgccatctgctgtgatgacgtacactacacctacgagtttcccctctaccgggctgtacttgaacactccgaaaaagaagcctctgcctggaaagatcgaagaagtccgcgccgctggatggcttgatctcatgctggcctcctcgccacctcgcaagaggcagactaaggactttgccaatgatgttcaagctgacgagcttgatttgctataccgtaattgggtggtatgtttttgaatctatagttattgctgaagtacatcaaacatggcaaacaataaaattttccactgtttttcttttgtaggtgaaccatccatctgctttaacatcatttgaggatattgttaatcttgccagaggtaaaagattggcactgttccttgattatgatggaactctttcaccgattgtggacaatcctgaaaatgcagtaatgtctgacgaggtattctttttctcctcttatgttctttagtcctcattattatcagtgaaaatttatctggcagttttgtaaatattctattcgacagatgcgctctgctgtgaagcatgtggcatcactttttcccactgcgatcattagtggaagatctcgtgataaggtaaggaatttatgttcacatgtaaaatactccccctgctaaccttttgcatttttcactctttgttgactctctcttatgtgtgttttgttctttaggtttttgactttgtgaaactaactgaactgtattacgctggaagtcatggaatggatatcatggggcctgttaggaagtctgattcgagtggtcagcatgtggaatgtatcaggtccactgattcagaggtgcaacagctttgttgattttttccacagacaaatttctctcttgtgacaaaattctaattagttattgctttttggctcatagggtaaagaggtcaacctcttccaacctgcaagtgagtttttacctatgattagcgaggtatgtatttccatctcgaacttggtaattattaggataccattttgtgttgcacggttgaaaattattcatttttatacctgtaggtgtacaaaaagctcagtgaaagtattaaggacattgatggtgcaaggatggaagataacaaattctgtgtgtccgttcattaccgcaatgtagcaccacatgtaagcctgcattgaagattttaatttcacacaggaaatatgtggtgtaaaatgtttgctgaatattattctcattgttacatcttaggactacggagaagttcatcaacgtgtgactgccgtcctgaagaattacccttgtctaaggcttacccatgggagaaaggtaaggaatatacacaaccgcacagctgtttcgaagcactggttaagtaccattgttgtatttgtttttaattcaactgcgctcttgaattcaggttcttgaggttcgacctgtgatagactggaacaaggggaaagctgtggaatttttgctggagtcacttggactatgtgggaaagaagatgttcttcctatctatgttggagatgacaagactgatgaggatgcattcaaggtaagccataaactggtctgcttgctcttacctgcaaaatatcaattactacttccatgtcttgatgtataatattgctcacttggctcaaataggttctgaaggcaaacagcattggctttggaattttggtgtcatctgtgcccaaggatactgatgctttctattccgtacgggacccagctgaggtaattcgtcttctatctgcattaagtaatctgtcgacaatagattctgaacaatctgatttggttacaatcattgaatcaactgagtatgaaaacattctttgtgtatttaggtgatggaattcctgaagaaactggcatcttggaaggaggaatccacttaagcagaagggaggaacataacagaatcgttttttgaggatatggagaagtaccaactataaatacgagcaaaatatacactgctaacaaataagtctggccaaaatgtttttgatttggcatcctattatataagaggctccctaaaccacccttttttggtctcactttcatcttatgtttctgggattctgagacatttcattcttttattagttctgttcctttagtatatataaaatatatacacatgtatgctgaaaaattttggttcctgtccctgtcgtcttaggcaattatttattctaccggcaagttgtaaacaactggttgttcatttgttctttagtgtgctgcaacgttttgtagctgttattccagtgtgcccttctaaaagtcaacttgtgtgcattggccctgcaaactactgtaattagaacgataattgatgcaaccaattgtatatttgcctgaggctgtggaatcttctgcttgtttaacttgaaattaactggctaattgcttgtaaacgcactcatcaacgagagtgacttgcttgttcaaagcaaaggaaacccacttgcgctgaagcattcaagtcaaaatcttattcgaaaaaaataaatctgctccggacttgacgacagctaaactgcatacgacttcaacacggtaaaactgtcaatttcttatgagtctgtcgaaatttgatggaaagaaactaattttagaccaaatcctggcgtatgcgtaaattggcccaataataattcatcgtttgaattccggcccatatgggccataaatatgaacggaataagttcactttagctcccttaaaagtgacccgaatctaatccataaccctaaaccgcaaaacgggatatctcgacccccgaactatcgaaaccggtgcaatttgactcccttggcggttttggagggtggtttcggtgacgtggcgctgatgtggcggtgttgacctagtctgtggggttgacgtggcgcttaggtgtcatttgaattaaaaatggatatgtgggacccgtttgtcattcatacattaaaaaatgtggggcccactgacatgtgggacccattcttcttcctcccttctctctttgtttctctctctcccctttggccggctgggccgccgggggagcacgggctagagcggtggcgggtgggggccagagcggcggaagctgaagcggcggcggcggtgggagcggcggcagatggcgcttgccctgcaggccgactgcttcaccagcgacctgagctagctcatcgccgacatgatgtccgggtcggtgccgcttgacgcaacacgcaagcacaagtatccccgagagggtggccatcttgggcgtgttcaagcgagacaaaattaattgctcccctctgcctactcatcctattctttagtggatggtgaacgacctgctaacaatcaattttatctctggttagttgctaaatgaatcaattttatttttggatttttgtgatgcttgtggccttagcagcactagttcaaggagacgcaacgggggatgagatggtggcgatgatggggctggcgcgggagttgacggccacgcagcgagctcgagcaatgacttgacgacgtcgtcgttgcaatgctgaatggcgtagctcgatggcagccctcgcccctaaccagcttgacaggctcgatgtcggccgtgtcgtcagcttgtcgcatatgccagatgcccggatcttgttgttgcaatcggcggagaggccagagtgccggatcttgttatcacggacggcgggaggtggcagagggagcagggagcttgttccccggtgagggtgccgtgctggtggaggtgaggactggggttagggcgcttaggtgccgtgccgtcgaccaccgtccccccgctcgatgtcatcggcgtcggcgtcggcgctgctgtcctctcccgcctccttgccggtcatcgagctgcccgttgccgctctggaacccgccgtcgctgcttcagcttccgccgaccgccaccactctagccctgccgctccagccgtgctctagtccccgcggctggccaaaggagagagaaagagaaagaaagagagaagggaagaagaggggaggaagaataaagagagagagatgatgacatgtggtcccacatatgtgtttttaattcaaatgccacctaagcgccacgtcaaccctatagaccaggtcaacatcaccacgtcaccaaaaccgtcctccaaaaccatcaagggagtcaaattgcaccggtttcaatagttcgggggtcgacatacccagttttacggtttagggtcatggattagattcgggtcacttttaatgaagtcaaagtggacttattccaatatgaaccgactatggctcaacgggccggaaaatgtgcttccttcccaaacgaggcctaagatgactatatatgggccttgttgggccgtttcgacgaatcgaaatgaggccaagcccacattggcccattttgattcatctcggagtttttcacatgggccactcagctggtcacttccttctctcccacttttgcttactctctccgccctcctaaaccctacgaccatgccgaccctcgccgccgccgccgccgccgcccgccgcgccggcggggcactgcgatacgccgtgctgggcggggttcggtcgctctcatccctccagccgtcatcctcctcctccgccgcagccgccgccagcgaggaggtaacgcagcggttctggtttcgccgccgcttggccgcctccgactccgatcggaggtgtgaggttctctggctgacgtcgcgtgtctcggcaggtgctggtggaaggcaaggccagcgcgcgcgccgccgtgctcaaccgccccggccatctcaacgcgctcacgaccaccatggttcgtacgccttttcctgttcgataaaatgcgtgcgtggtatcaggtgatatgttcctgtgacgtttgttcacattcgtgctctccacactcctataaagggcctgcacgttctagtgagaatgtgctcttgctaccgatgcatgaaacacacctgattgtaagggcacaatatttttgtggctttcctatgtgatcatttattctttaatggtatactgcggttttcagtaaattgacttttattttgagtataatgcttgatgaaacatagacatttgtacatgtcttggtggctcattgatctgatttcctgtgactgactgtcttgacagggagctaggctcaataagttttatatgtcatgggaggacaaccctgatattggctttgtcatgatgaaggtatgctgcttcagcatttgcatggtatcgatgccactatataggtctaaattgatttttatattatatgaagggcagcggccgagcattctgtgctggtggggatgttgttaggttgcaccagcttataagtgaaggtgagtggctaggccctgcatggtttataattatcgtttccttgtttagaacaccagcctctggatcagagcctcagaggttgccatgcttgtattattgttgaaatataaattttttttgtgacacagcttagaatgatagtggtatccagttcttttgtgacatccttcacttgtataaaggttgtttacaacactgcaaaagaagagatttggttccaaatggacagttccactggaaccatatacatggccaactgatttattctttcttttgcatgtccaaaggtttcctttagtgataaccctgtctcttttttttttaatttttttttaaaaaataaaaccaggaaagttggacgagtgtaaggatttcttcaagactttgtacagttttatttatgttctgggcacatacttgaagccacatgtaagtgcatggacttcaacttataatcactaattttgtttttatttttcgctcgaaaatttatattaccttttgtgatgtaggttgccattcttgatggtgttaccatgggtggaggtggaggtgtttccattcccggaacatttcgcattgtcactgatagaacggtatgcaatttttttttgttgatttgtatttttgtgcttggggactaatagttattgtgcagtagcatttctgcctgggtgtgcccttatgttatgcatttatgagcatgcggagttcaacttaaacaaatatttatttacttaccatgactgtttccaggtatttgcaactccagaagtacatattggcttccatcctgatgctgctgcctccttttatttgtcccatctgactggtcatgttggttagtgttcagttttccctttcaattgaattctttaatatctgatatccccgttcatctcttctttgtaacccccagcccttttaagtaacctgtgcatttcaccgttggtcctctttaggtgaatatttggccttgactggtgaaaaactcaatggagtggatatgatcgcacttggccttgctacacactattccatgagtgatgtaagatccttttaattgaactatacattttggatttcttgtgttctatctcggtattagttttgctagttgattaactttataattcccatttccttttacagcggttgaatctggttgatgaacgccttgcaacattgttaactgatgatccatcagttattgatacttcccttacacattatggagatcttgtgtatccagataagagtagcattgttcataggtaagccgtacaaaaagtaaatataattctgaactgacaatgtcttattaaatgctttagcatgtcatactacagaagctgctggaattccagattatgttgtcttctagttgttttttttaaacatacaccctccatcccaaaatatagctagtagaatgggaattgaaagatgctttgctttccttgatgttttggactgcatttcagaattcagatcatcgtttgtttctttgtaatgccattactctgcagaaagacatgcagaagtatcctaaaagtggtacttttatatttagaatgtgtgtttattcttaatccttgaatcaagcagagtgtgatactgctgtgatttgtgaatctttgcattagctgtagaactgtgcttttatatttgttcgggaccaggattctcttggtaatataattggctgttaataataaatgatacaatgacatgcgttttgaatgtgcatgatttttcatgtggatgtctataatacaatgtttatgctttatggaatcaatgtatatctcatttgtgccctttgtgttactctaggctggaggttatagataaatgtttcagccttgaaacagtcgaggagattgtggatgccatggtgagtgatgtgtcagttgcttttactaccaaatctctgggaatggcttcttttcttattcatttgaacatgaataagatgctgttgattgataccacagcttgctgggctaccttctattcccatatcattatttactaaaaagaatctcttctagatgttaactgtttgtacagtagttattgttgttgttttggcattaatttcattcccttggttagcttactagatagttcatttcaaggtttttgtttcaacagcagaaattttgcttatgcttcagaacttaagggctatgctcttgtaaccaggaaattgaagcagctaggttaaatgaagattggtctaccttggccctgaaacggttgaaagaggcttctcctcttgcgttgaaagtttcactgcgatcggtaaataaaaaaaaaatctgaaaaacctcactctttgtgcctttgactgtcgatggttgacagattgtgtatggttatcctgtagatacgtgaaggtagataccagacacttgatgaatgccttgtgcgtgaataccgcatgtctatcaatggaatctcagagaaattttctcatgaatttcgtgaggtatgctgtactgcatttctttttggttctcacaggtttatcgaatattatttattgatgaccaagtaaccacggtgctaagtctttgaggtaattaggaatctgtctgtgacttgaaaatttatttaattatgttataaatgttgcttcaatcatgccagggtgtcagagcacgtcttgtggagaaggacctagctccaaaggtaaattacatagctggttgcacaatctatgctgttaaatcgcaaaaaatagaaaataaaagttgtgttctgcatttttttcataaaaaaaatgtggttcttgcagtgggatccacctgcccttgagtatgtatcagcggacatggtcgattcttactttgctcccctgggtgaatttgagcctgagttgacactgcctactgaatcgcgagaggcatttgtatgatgactctgcatgacaattccaagtagcgcttttgtttgaagccttatagatttttgagcccacactgtcgaccgttggcagcacataataacagataggattctcaatctattcttgtaccatatatgccttggtgtattgaaaggaactgatctccaaggtgaactcctaccattctcactttcataaattaatgccttcgcttcatttcatttatactattgcaaagcgtgtccaagtcgccttgtgattatgagtttgggactcatttgtattgttgttgtctttgagctcgtgtgctgtgctaccttgtattcctcatgtgaggtactgatattcaggccgagccagctatagtcgggggcggctgatacacgatcagccgcgcggggaggcgagcgcgcgatcagtcgcccccttcctctagtctctctgtatctaatctactacttctatacgtgtgtgtgtatatagtatatacatacatatatatatatataaatatatatttttaatgcataaaaacacacacacacacgtatacgaagtttatataggacatatacaaactttgtatacgataaatacaaactttatatacatacgtattaaaaataaaaaaactaaaaaatacacaacgtatacaaaatttatatacgcgtatacaaactttgcatccacgtatataaactttttatacgtgtatacaaactttgtatacgtacaaatacaaacttagtatacatacgaatacaaactttgcattcataaaaatttaaaaaaaccgagaaaaaaacagaagagaaaccggaataaaaagtaaaccaaccgaaccggaaaaaaaataaaggtaaaccaaccgtacagaaacggaaaaaaacaaaaaaaaaaaaaacggaaaactcgctcttcctcacccgcgcggcgcgtcgccacccaatctccgcgcgcgacacgtgcccagtcacgcggggaggggggcgcgcgactgaccgccaactagctttctcggctatagtcgtcctgagtcttcacaagtattcgggctgggcactgaataactggtctcatctggacctgggctggagcgtgataggccacgtacattgcagtgagtttcagccagaagatcggcccaatttcttggcaggtacactggttttaggcattgtaagttgtaagaaatctgtcataagtttaaacgaatggatggtgtattagggcttcttcggaatgcaaaatagaaaaaacgtaggaatagggaaaacataggaatacagtaagattgtatgtgtaaaatagagaaatggaaaacatgggaattttttgttcttcgtgtgcaggattcttacaaagagatgagtggattctttttttttttactatgaaaacatgggcagggaaaggtgttcctctgaaattcaaggtagcgaaccctttgaaacgaatgcatctacagtacccaattcaaagaatcatcaatcctccatttttccttcacatttcctctattccgaatgagcccttagtgtcatatctagattcttagactagagaaatatgactgatccaacctctgaatcttttgatcctagagtcagatggtggagatggtttttcatcccaagtaatgtcccctcgtatatattttttcatcactcaaatacaatacaaataacagtaaaaaaattctgagagcagtgaattgtaatttggatagctttttactaccaaagttttagtttgaactaattttattacttttttttagaaaacagccgacataagatttacctaatatattagagagaataaatggcctggccgaaggccttacaaaagatttgcctattatttttcatttggattggacaattgtcatttctaatttgtatcagccaactctcttttctatacatagataagatatggcctacatatagataagagagttgttatttgctcgaggttgttgatgtgtattgaaaaagtttaggtggtccaaactgcaatattgatttctaagagtaaatatcataaaactgcagatatttgatgaaactatcgcaaaactatagatttaaaaatgtgtatcacaaaaccacatatatatcgtcaaatttatcataatactacatatttaaggcatagtatcataaaaccgcatatttaatgataaagttatcaaataactacatattttagagtttatatccatagaacttttatataagtcatagtatcataaaaccacccatatttaaagatgaaatttactcattttctaatatactccatatacatgataccaatatacatcaaatatttttacaaattcccacagctattcatatgtagtagtttgggagaacgaaacatatatatctcctcaaggaatatgaaacccccccttagatggcatatagattatcgtaccacaaacacatggttaggccagtaatcagtactccgttatatcatcgaccgtattcgagctatctcctatttgcattatattgcatccctcacatgcatgttgaaccatacagtaagctagcaaacaaacacacaagaatatttgtgatctggacacaacgtgcagaggggtcacattctcagagtacaaagctcactgctcaccacagctaagggactgtttagttggcaaattttttttttacctatacatatcacatatatatcacataggatatacggatacacatttaaagtattaaacatagtctaataacaaaacaaactacatattctgccagtaaacgcgagatgaatttattaagcttaattaatccgttattataaaatatttattgtagcaccacattcttgaatcatggcgtaattaagtttaaaagatccgtctcgcaattttctggcgaactgtgtttttttttgtctacatttaatactgcatgcatgtgtctaaactctaaacattcgatgtgatagcgtgaaaaattttgtttggaaactaaacaggccctaactccacacactgatcaacactaatcagcatgtacatttggccccaggcacgtccaaatccaaaccgcatttatcaattagcgctatgattaattaatcacctcgatccgccagctcgatccacatgcattgcctcccctcccatctccggcgagctatatatacccccctcgccatgcacactccccaaccacagcaaccaagcagcagcaagctcgagctactagctagctacactagctcgattagttgcagcaatggcggcgaaggcggcgcttgtgctggcggtgagcctcctggtggtggccatggccgtggcctgcccggactgcccttcgccgaagccaccggcgccgaggccgaagccgccgacgcctcactacggcggcgggtcgtcgtgcccgcgcgacgcgctgaagctgcacgtgtgcgccaacgtgctgggcctcgtcaaggccaaggtcggcgccgtgtcgccgtacgagccctgctgctcgctgctcgacggcctcgtcgacctcgacgccgccgtctgcctctgcaccgccatcaaggccaacgtgctgggcatcaagctcaacctccccatcgacctcagcctcatcctcaacaactgcggcaagatctgcccatccgactaccagtgcgtgcactagatcgagatctagagagctagtgttgcacttgatcactccatggctgggagtaccgtatcttcatgttgtttttacccccaatatcttgatgtgttgttaatttcttgctttttttttcttttgattctatggttcgtgatccgttggtagcgctatgatcattgtatttttttttgtttctcatgatttgttatagtttcgtcaataaaatggaaatgtatttttttgtcgcatatatgcaatggtcagagattggaactctaagatttggaatatctgtcggatgaattaatttatgcatgcccaaacaagctcaagcaggacgcatgcaccatgcatgtcgaggaaaagttaactgtatacagtactccctccgtacaccgttaactttttagcacatgtttgaccattcgtcttatttaaaaaaattgtgaaatatgtaaaactatatgtgtacatgaaagtatatttaacaatgaatcaaatgatatgaaaataataaataattacttaaattttttaaataagacgaacggtcaaacacgtacttaaaaagtcaacggtgtcaaacattttgaaacggagggagtaagtactaagcattaagaagaataaaataagaacaaccatattagggtctaggaaattaccacgttaattagatatatatatatatatatatatatatatatatatatatatatatatatatatataatgtgtattttcagattataagagtgtagattgattaatatggttgtgtaaaaaaatacatttatattcatagaaccttttggtggcttggtaggtgaagtgatgtatagcatcttcaccactgcacccacccgagagaagggggatctcaataggacatatggggcacagttatatccctaaatttattttttttgacaaaaaatatgcaatttaataggtataatatgtgtatatactattagtttagtcaaaacaagcaccaaaagtcatccttagcaagagagattaaatttttccttagctattttagtaatttttctgtacgagttatctttagttgcattagtatcaaaattatcgacacttcattttcgctattaggaagctttatttttttccccattagaccatgcttaagtactaactctgttttcgtattgccaaactcctgtgctcacgctaagttgtcccccccccccggcgcccaaaattgtgtatagttaatttgttcaacatgcaaatggaaggttttgggcccttaattatgtttgccatgattctagcaaaagagccaatgcaagctggtttattgccaatacatcttttgtgccgacgtgctgttaaatttgaggtgaacaagttgtccacatgaactatatttaaaaccttaggccttttttttcaacttaggcttttgaatggtctttatttttgctctttggcttctaaacatatatatctaaactaagtggcttacaacttccacaaaagcgttaatgataaagttacttaattgtttgtttgaagctcaggctttcagacagggacgaagctagaacgaaatgaaatagggtaccacttgtttaatttagggtgtgttctttatttccccatcttttccaactcacctctctcgttttccgtgtgtacgctttccaaactactaaatggtgtgtgttttgcaaaaaatttctatatgaaagttgtttaaaaaatcatattaattctttttttaaaaaataattaatatttaattaatcgtgtgctaatgagtcgtttcgttttccatgcgaaggaaatgagttcccaacacagggaaacaaacgcagtcttactctactttagatcaagtttaaattgacgtggatgtctaagtttgtattcagagggtgcacacaggtgaaaataactgaagtatagctaaacaattttcttgaccgggttcctggacacccccttgcccttgctttcagacttataaactggtataagcccaaacacaatgagaatgagagactaagcagagtgcctagatgatctggaagcataattatacacatatatgtatgtttcttttagaaaatggataatcaggccactacatccaactgaaacgatgtacacagcctattttacacatatatgtatacctgaggaaaaccctctgaacatctggaattaagaatatatgtcaactgggacagaaaacgctggagaatataaatcacaagcacacaacacagccaatcaatttcatgcacatccaaatctgaagaaaatataaaaaaccgggaataattgatccttattcgccagattggaccacatgcacgatcgtcgatctggcccccacacgacatatgcatccatacattctccttcatctcatctcttcttctccatggccactaatccctcgagggaatatcccctcgtatacctttttctttcaaattcgatgtaaatagttatgaaaaaatctgaaaaaaattgacaatgtagagtataatgatacctaccagtgcaccaaaattcaagttcaaattcgatctacacatcgagaaacaaaaaaacaaatttagatataaacagtacgctactattcatatgctgaatttgtcttttttatatctcgacgtgtgagttgagtttggacttaagattttgtggagttgtatatatgtgttgtatgaatgttgtcaaattttttcagaatttttcataaccgtttaaatggtttttaaataaacgagggaacatcctctcaagaaattagaatagtttccctataaattcacctcgccatgcacactcccagccacacagcaagcagcagcagcaagctcgagctaaccagctacaagctacaagaagcagcctagcaaattaagctcgatcgatagcaatggcggcgaaggcggcgcttgttctggcggtgagcctcctcgccgtggccgtggcggcgagcgcctgcggcaccgactgcccgccggcaccgaggccgaggccgagcaccgggtcgtgcccgcgcgacgcgttgaagctgcgggtgtgcgccaacgtgctggggctcgtcaaggccaaggtcggcgcggtggcgccgtacgagccctgctgctcgctgctcgacggcctcgtcgacctcgacgccgccgtctgcctctgcaccgccgtcaaggccaacgtgctcggcatcaagctcgacctccccgtcgacctcagcctcatcctcaacaactgcggcaagatctgcccatccgacttcaagtgcgtgcactagagctggttgttgcacttgtttctccatgaccatggctgcgagcttgagagtactactgtatcttgatgttgtttggagtactttagttcttgatctatctcttggttccatgtgttgtttgattcccatgaatgattcgccaataaaatgaagctctacttttcatcgatcgtatgctttgagatcagctgaaagctagctcgcacattgctgtgataactgatagtgaacaatcaggatgaaatgttaatttttttaaaaaaaaaatcggcaagaataattagcaaatagctatatttagtggtactaaataattaagctagattatatatttatagcaattaatagggaacaataattgcacacaataaattgacacgcttgaggggagatatctaacgtctcttgttgtgtcatcatgaatgttaagcttttggtttgcaattatataaaaagataatttacgagagagggcgaaatggagtcaccatattcattctaaaagctattatactctcattccggccaatagctattattatgcaaatgtttggtcacggtagattggtagacttagattatgagtgattctaccgtacttgagcaggtaccttcggtactaggtgaaattttgcactaaagttattgtacctaaatatctcttaagttataagagtatactttgactggtacagttgtatataaaatatacctgtactcatgaaaagagatgcaagaattgtatatacattcaattttgctttcaaaatctagtttttttaatacttaattaattatgcactaattcatcgctatgtttcaagggttagtatattcagtacctcaaagaaaaatacatgcatgggattccaaggttagcatgttcaacacataaggcatgcatgggattcccttgctggcaagtagctatggtggatggcacagcttgcaacaagggaaggtccacccccaagggagagtatgactaggatgactcacatgccgcacgggtagtataagttttaagggaacgtatcctgtacacataacctttccatgtacacaccatgcatactaattaacaaaatttaaaaaatctagagaaagaaattgtacatatacttccaatagcattatattacacatatgtgtaaagtcttaatctcaaattcattatgctctagccgtaacaaaaaaaactataatttctggtagtttcaagggaataaatcggtcataattttgtcttatttggtgcttcatatatatagtgaatttgaagatgagactttacatataaatatgatactactgaaagcacatgtacaattttttttaaaaaaaattgatgaagttttgttagttgatatgcatgatgtatataaaagaaagctggcttgtgtgcatatgatacgtttccaagtttcaaagtctgtaatttgaaacgactctaagtgatgagcacaatgcatgacacctttcgagaatgcagaaatgagggaaatacacacccatgcacagtcccacaccatgtctcacactcatattaatagataggcccaaactaacatcatgcatgaataatcttataaaatattgaattgcattcaatatatgcaccctttggtggcttggcatgcaggtgaagtcatgtacaacaccacaaaccacacacacccaagaggtagttccccacctaacgtacctagcttgttcagcatgcaagtggaatggtttgggccctcatatatatctgccttattccagcaaaagagccaaacttcttgcctaccttttgtgctgatatataattaagctgttagattgagatgtgaattgaaccagttgtccatgctccatatatatatagaaacatagctaaaactttaggtctctttttttttggccttggcttttatggtagctctttggctagagcatgcggttttcaagtagcaagtttaaaagtcgagacgtaaatccaaatcaataaaaagttttttttttaaaaaaagctactcaaatctagttttcaacttcttagagagctacggttacttacaacaagtttaatagaaggttaatttaaaatctgcttttttgtttaagtttaggcattctaacttatatactttagctatgagacctaccttttgtgtgggtggtcttcaataaccacagtctttcgactgccaatgaaccaagccagcatacatgtggcagtgagaccctctggcaccttcaattcctggtgtttaagtctgcatgtgaagtggatgatgtcgatttagggttctagcattagtttgatttgaaatttgattgggtgtttttgcaggtggcaaacgtcaaagcttctcagtttatctctttgccgctgtgtgtgcgcatggtaggaaggttatgacgtgtttgtattctcttctctgtgtccccggccgtgtattttttcctattatcctctagggctcctgcgcttgcataggcgaaacccaccttgtgtaagatcgttggaagtaatatattcaggtgggtatttcgccctccggtgaccagtctaaaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacacacaaagcaagaacctcgagctgatctactagctacctagtactctcatcttcttcactagcttttgcttgatcaattgcagcaatggcggcgaaggcagcgctcgttctagcggtgagcctcctggtggtggccgtggcgagcgcctgcacctactgcccggagccgccgacgccgaagccgaagccgccggcgccgaggccgccgacgcccggcggcggcgccgggtcgtgcccgcgcgacgcgctgaagctgcacgtgtgcgccaacgtgctcggcctcgtgaaggccaagatcggcgcggtggcgccgtacgagccctgctgctcgctgctcgacggcctcgtcgacctcgacgccgccgtctgcctctgcaccgccatcaaggccaacgtgctcggcctcaacctcaacatccccatcgacctcagcctcatcctcaacaactgcggcaagatctgcccatccgactaccagtgtgcttaatcacattgggacactgcagccgatcgatcgatcgatcgattgacagtgtgctacacgtcgtctacatgtttttgttggttggtttactgtgagcagtctgaactctctgaactttggaaactgtctgttttgtctttgtttatgcttgcaaagtttaattagttctgggaaaaaaccattggccagtatgtattattacatgtgtaagtgttggttgtgaccccgggtgatcagtttactggtcaatatatatgtattttttgtgcttatgatctgttatggttcagatgtcaatcgaagttgcaattagtattttcttttgtaaatttggagctctggaatttggatatgaactctacataggtaccaggtgattgctactcaaagtccaaactcaagctctgaggaccagaattatacattaactaggtgaaaccccgtgcgttactgtgggaattcagtatgataataataagtaaaaaataatatataaaatagctagacaacataaagttaacgtggtttatgataatttaaatttaaatagtatatggaataatgattcaaatgcaaaagtaaggttatatgactttatgagagaagaaaaaaaaaggagaaagttcaaaccatagattaatcatctaaagactaaaaataactgaggtgatatgacttaatgaagaagaaaaggtggagataatttggaccatagattaatcatttacacactaaaaacaattgatgtgttgtgtcttaatgagagagagaagagagaaataacattaactaattgaggttaaactatataagtacataggatattataaaaaaataatgaagatatatattgaaatattatgtgaattatgtaggatgatgatttaacatgcttgcattttcaaagctctaaaatttaataaattataaaattatagataatataacatatttgcatgatgtttaaatgtagtgattgttagtggatgatgatgtggcatctttgcatgttaagctttaggagtcattgggttataactttaagtaagaaaggatgtggtgtcacaccccaatctggcaccgccgtacaacggcacctgacaggagcgtgtcgtagggaaaacggcgtgaaccgcttcctacgaaaccacgatctcggtaccagtcccaggacatagtgctggtacccacagtgacaaatatgaatcatagcaatccttaaaataaatagaggacttatttaccttaacttaggttgcaactcagaacaacccgagaatgcaaccgacgacacggacgaggaaacaccaacaacagcagcagcagcggaaccaacgaactaacacccaacaccacaggcggcggctaggaaccaggacgaaaccctaatcttcacttcactttatcttctcttcagggcggaggaactatatatatatatatatttatatagagcaagggtgagtactttcgtactcagcaagtcacgggaatttaggtgtttaatgcaagcttggaagagaggcaaggttgttttgcaaatcttttatttgaagacctttttttgaaatcactaagtgatttatttctttttaagtttgggcgaaaagagacttgcgtctcgattcgactttaagagatgcttttcaacagctcatttagtaatgtaccgacctcccaggtcagatcattacttctcggctcccagagccattccacttgattaatcggctcccagagcctttttcattttctcggactcccagagtccagctgcccagcagcacaacaatccgcttccactcggaaagcctagtctatgatgcccgcagacatcccgaatcacacagattcgtttctgaccactcaggtcatccatctgccacataggctgattctggttacaattcccacaccacaacaacttttcacaaagcacaggcaaacaaatctatgcaacgggaaccacctcacatccgcccatgaccgtgggcacggctgttcgaacagttagttaacctctgcagaggggtacactttacccacaagacacaaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgtactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgtgctcagagagcacgaataccgaggtaccacaagggtggagcgacaaggattcagggtagtacgacctacgaaaattagtacgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaagcaaaagaccaaaagaaagatcctatttagactaattagtagtgccactaaatagatctcaattttacggaattactggaagtggaacggagttaatcggagttacggagtgggtgatatgaattttggaagtttaattggaatttctggaataagaggaatggtttatggaatttatagaaataatattctcaagaatattattgacagtcactgtcatgtgggaccaaagaaaatggtttatggaattttgtaacaaggaattgatttatgggacaaaggaaaaaggatttattaaatccctgaaaaagaaaaggatggagggatgtatattagactttttcgggcggcaagggcgcggcccaagggtcgaaggaggctcggccaagccatttgggccggcgcgggcgcgggaaaggcggcccattagggcgcgcggaagggggagggagcggtccggtggaccgggtgcacctcgcggggtcctgggtggggcccacatgtcggcggcaaggctcacggtggggagagcgcacgcgggtgcggtgctagggtttggtgggtgcggtgtgcgggcggtgcgccgggtggatcggatggcagcgggcccacatgcagccggttggcgcaccgtggaccgcgcgcacgggaggggggggaggaaggaggcggcaccggctcggctcggtcaaagccgaggtggcgccgacgtggcgcctacgtggcagccacgcgggccggcgggaggaggaagaaggggcggccgagatggacggcggacgacggccgagttcaccggagctcgtcgcgacgattcgagagagagggagtacaccggaacgatgggacggacgataggaagtgagccaccggatcggattcgccggagggaggccggcgttgacgaatcgcggcggcgcacgccggcggcgagaaaaggggggggacttcaccggagcaacgggggttcgattaaaaggggtgggagcatatccgggattcaaggaatccgtttccggcgccggatgggacggaggagcaccgagggcagccggcgacgagaggcggcctccgggggtgggcggcaatggcggcggggccatgccgggtggcggcggtccttggggcggcatctacgcgtgttcggcagggctaccgagctaccacacaagctagaggggacaagggtgagcggggaaggggaacgggagggaggcactaccgagccgggacggcgtggtgacgagcagccaacggcgcggaagcgagttccccgtcgtcgggccggggaaggggaagaagaagggtggccggagccctcttcggctccgcgcgcacgccggcttcccggcacacgcgagggcggaggaaggcgaggacggcggcagcaaggcggcgatggcactgcagcggtggggactgaagtgggagggatttgagaggagggactcggctttatagtggaggcgaggtcagttcgcgcgggaggtcggttcaaaccgaccttagggcgatcaaggcggcagctggcggtcgtgctcggagctagcggccaagtggcggcagaggcggtcacgggcgtgacgccgatcggggaaaaagcaaaaaggggagggagaaaggagctcggctccttgccgattttggacgagctgagggaggagagagcgcatgggagagagaggcgctgcctccgcgtcttggacacgcgcgcgctgcggcgcagaggtgggggcagcggcagagtgggcgcgggcggctgcgcggcgcaggcgggaatggtgccggtcggggaaaaagcaaaaggggagggaggaaaagggggctctgcccacgtcattcagggagaaaggaggagggagagagggctctgcctccgggagttggacgcacgcggcttggagtggccgggcacgcgcgcggggccgtgcagctgtagcgcggcagggcagcggggccgggaggcgtaggcgcggcagggccgacgcggcggcgaccgggcggtcggccacgcacgagcgcgcgcgcggatgcgagggcgcggccggatttcgaacggcggcggcgggaaatcggcgccggtgggggagcctttacgggagagagaaacggagagagagagaaacggagagagagagagagcgaggatgggaagagagtgggcgctctctctctcgagcgcggcgcacgcgcaacgcacgtgcgagggggaggaggaggagcggctgagaggagatgggccgaggagaaaacggcccacaaaaatccgaggaaggcaaaatagactttttcggaggagattgattcgaagagaatttgaacttggaatttgacttagattttggaattgggatctcgatgagaggaaggagtagacggaggattcaagacggggttttggatattttggatctggggaagtatttggcgatgattcaaagagagggatagaatttcagagtttgatttggagacttgagtcggaagaggaatttcgatggggcaatttctgatggtgacgagagggatcaaggacggatttgaattgagatcttggcacaacttagactcacacacaaggaacgaaaattttcgcaattaggattttgccgaattagtttttaacgcctcacgaaaagcggagcgttacatgtggacacaaatacatatttaccgaactgagtgatattatacgtctgatccttgagaggtattaagagatatccctttattcattataaaattcggtaattcatacaacttttttatataatggaattaaaccaatctttacttcaaaggagctacaaccacttattacataatcctctcaaagagagcaaacatttaagtaacccataaagaacaactaacaaacaccaacacttaagaataaaacaattagtaataagtcaatttgtaaatctctagcccaaattgagatacaagaggtatcaaatcgatcttatgctaaaataccttacgtcttagtacctttggctgtttatatcttacaaaattcattccattgagtggtgtaaacaaaagaatgtgcaagttttatttaacatttaacatgttttgagaactaggtaaggaaacatgtcattgtctcatggatagatatgcaactaaggcgatgtcggctcggcaaatagccaatacactgaagctggcatagcgtggccacagtggcccatgtatgacaagtataaggaagagaaggagtagtgaagtaagagagattatacggttcctaagaaaatacctggagatactacaatttacactaaaaattttggtacctcgaggtacctagtacctagagataccacattttacactagaaaatatagtaccttgcttccggtagcttttcaaggatggtaaaaatttacccgtgaagtaatgattgtagaactctataatacaggtatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatatagattcttgtgggggcaatgatgataaggaaatgcgagaacaatgtaagttgaaaccaaaatatattgtacatatataatgaaatatccactgcatatttggtatgtagctacatgtgtatacctagtatctgattagtgaagtacactatatagcaatgattttaatcagaaactatagagaaatgatttctgagaaagaaagacattgggtgtaattaagaaatcatattattgattgggaccttgtggggagccaaggcacagctgctagttcccctccatctgccactgtctgcaagctgatctagtatatatgtgcaacaaaccattggtcaaaaaaaaaagaaaaaaaagcgaaagcgattaattaaagttgaaacctaaatcgtcgtataacgaatggttgatatgatgtgtagtacatttgataaatctagtacaactatatgtatatcaatttatgtgatagtaactagctagctagtactgtaactgtaattaacaagagtgacacgaaaagatctatatatctcagatcgtacagttagctagatcaatgacgtcaattaactatatatataactagctgggttgtaactatagatagtagaagaactttcagctatatatccagacagtacggccactgcataatgagtagtgataaaatgccataatcttctccagcaggtgacaaaaaacgcatggctggcaccgatcgagagatcatgtcaaggctaaaaagctttagctcaacttggttcatggaatattcaggttcagacaaggcgagtcattgtcgcgtatcaaaaaccggagccctacacgatcaaaaccagcatcacggtggtcaccaccacgaagaatatgcatcagaacacaacagtacagtacagaagaagggagatagctagctaggttggaatggtcgaattagctagcaaagcaaattaacaagcaaatggcctgattaatcaagctcgtatccgatctcttttgccacccgtgaacccagataatccgcggctgatttgtcgcatgttatagctcgcttcctcgaactcgcttgatccgtgtggattactcggctcgatctgatcagctgtagtagtagcttaatttgttgactccatgctccatccatgcatgttcagacttgagaaattcttttctttttttcagtaaagttgttcagaagcaacaaaatgtgtgagaccgtccgtgtggctgtcaggctgtgctagctgctagctgatggtaggcagatcacggtatttctgaaatcaaatggtaattaaacatttaaacatatacgtgcacattgattgattgattgaacgtagattaattactaagcaggttcacatgcgtgcatgcttggccggcatgggtacccacgacgaacttaaaattatattatacaaacaatatgcaccgatcgatcgatgtcacctcctgtaatgcacatcatatcatcccgttgatctcacatgcatgctccttgattttttttttttgaggacagatcaaattgcattgcattgatccggcttttgggagaaagccaaaatgctccttgagatcatttcagcgatgcaattgagtgagtacttgaaagtctttaagtctgaaatcaagtggctaatgcaagttgacgatgaacacggcatggcaagccatggcagtactcgaattcgtcgtcgtcgctttgctctgtgatatgatatgtcgatatgatcgaccaaacgatgctcgtggtagtgttgccagccgagccctgctgctgaccagcaatgcatgcagttcttgacagcgaaaaaggagacttcttcttttgagttttgacgccttgcgccgacgggtgagccgccgccgccgccgccgccggagaagacaaggcgtccagcctcggggcccacgagggatagtacacgggaatcggattaaacgggccgaatccgccagtttgggccagagtaaagtgcgccaccgcgactccgcgagcgcgaggcctcgtttggacaatggcccaaatgctggcgcgtttgcttgtgtgggctgggaaatttcgagcaaaatctggcccatatactatgatgggctggggcttagacttttacctatcccgacgagaccagagttaggccgggcggaatatatgggccgtgttgcgtgggccgttgccagatttcacgggccgtgcagccatccggtatgctttgaacctggctgaactttttccaatttatagacccatagtttcgcttatgcttagacttgtaagctaaaatttaaattttagagttgaaatttttagttttcccatcttagtttgttttacagcattttaaaaaaaatcgctaagaatgtttatataaaacttttgcacgcaaattattttttatcggtaataagcggtatacataagcataaacataagcaaaacaagtactccagtaaaattgaaggtgaaggagcgcagcacaaaggattagacaaaatcaaagcattttctttctgcattctgtgagttgtgcagtttccgaactggctatactgtcatagtgatagctaagaaatttacaggaaataatggcacatatatatatatatatatgccaccaatacagttcgtaattaaaggttacatcaggaaaatgaatactgattcctccttgcatgatcttggatgacagaacggagagaaaggtttggaattagctgctggtgcacaatcggctgtcctgtaatgggagataccctccgtcctccatcaagccaggatctgatcgcatcggtttcgtaggtgaatccgtctgatgcaatgcaaggctccctcataacctcctgccattacaatgcaaatgatcaaatttctatttcaattcatcacaagtgacaagtatttgtgttaatctacacaaggagcagtgctaagttatgtgcagaacttttcattgaatacctgaaggattgggcagatgaagtatgaagggatgcagcagtcttcatcgaaaggcgactgcatcactgatgatggagaaaatgatgcagctagcttcctttgtatgagcaacgtctccggttctctgacacagttctcatcatgatcaagatactcttgcagcggcttaattatttgcccggaggcctctaagatcaaattgtctgaaatcacttctttctgttcctccatggttgtgttctgatcattcttgggtagatctctttcttgttttaactgtgcaatttcttcgcttgctctcagaagtgcttcttccagttctttcctctttttaacctcctccaagtacagctcctcgtattctttggcctgtaaggttcagagttctgatcaaaattctgaagaatatattcatatgaaatctggatgtttttttttctaagtggtctcgtttctgaataaaatagtcaaaggacaacgaattactttctgaagagatgaaactacttcttcgtctgctttctgccgtctgtaagattctcttaaagctctcatcattaagttgtcagctgctttgcatgcttctttgatctcatcgtaaaaacccagttccgattcattgttgtcatcctaaataattggaaaaggaaatcaccatattatgtcatcactcttacaagacaaaatattcgaaaccataagatggcattgcaagatcagaagaacctgttcctggtgaagtgtcaactgcagagcatcgtgaccagtatcaggaatgaaaggcgtatgtccaggtgcaatttctacttccacgccactatcatggaaaatgaatcagagatttttgagcttcactattcagtaatcatcataaatcgcaaaattactactaaaaggtttttaccttgtacagattaaccgttctttgcagacaaaccaaatcttgcatgatgggtcagctctctgcataatttctgttgctgtcctggatgcaggtttgtccatttttctgaaacagaaaacaacaattattggtcagctctctgcataatttattttgtcttcaattacaaaataaagctttgcatttcaagtgttatattttcttagaagaaatatttaccttgagtaattcctgtctggggcagctgaaattactagcttggtcactccatgcaagttgattagttcaacaagaccgtctacaacattttcgttctcaatgactagcttctcacatttcatctgaaatatacagacaatgaaaaaaaaactgtcaataagctgtagttctaaataaaaaacggctgtcaataacaagccaaagccatcttgagataatgaattcacaggaattaacagaacccgtcacaccttcatcctcaggcattgattgacgtagtgatctaattgcttgtccaccttgtcacgctcagccattctgaacaagctcacttgctccggattcagtttactggcatggaacttgactcccactgcgaccaaaacagaatcaatacaacactagacagattatagccaaatttctcagtcttctgaattgaaagggctaagaggagtcacaaacccatgaactaatccatggtttccatgaatttttggccggacaaccatacatataaccatgaaatctttcagaaaaaaaagaagaagagaagaaaaacaatcggatgatgcagttacgtactgacggggatcatctgcggcggcacatgaacatgcgtgacgacgatggccgtggcccggaaatggccgagagcccacgacagcgtcgacctgccggacttcgcctccgccggcagcgccacgaacaccttctccggcgccgccatcgaccgaccttctcgtcaagcttagctccagttaatttaatgttcagttagcataagtacaaagctagcaagaacacgcggctttgggcgtacagaccggagactttggatggtgacaggcaccatatgcgaccgggaggaagaagaagaaggcaaaattaacagtgacacattaatttggacgacacggaaccgcatggagatttccaattttccaccaaaattaagtgatgattaattaactagcgccaatatcagcgtcatcgatagccttgtcattgaaaagaaaacttgcacatctcacagtcgcatcgttatataatttgtcttgtgccttgaccgtctccactgatcggttacatatactactaactccatattttaatgtatgacgccgttgactttttatctaacgtttaactattcgtcttattcaaaaaatttatgtaattattatttattttattgtgatttgattcatcatcaaatgttctttaagtatgacataaatatttttatatttgcacgaaatttttgaataaaacaaatggtcaaacgttgatcgaaaagtcaatgacgtcatacattaaaatgcggagggtgtacaaaattaatctgctgcttcggtttcaactaactgtttgaactcggaagggccgaagcacacggcaaggaaaggaaagggatttggcgggtggcaccgtgcacatcctgaacccccacagttcgttcaggtgtcttttcccggcaaattaattattaggattattactcatctgaataagtcccattgaataaactcctaatactttggtaatgacgttttgaaactttaatgaaatgatatcctccggcatcgtgaacatcgtgataacttcgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggcccaaatttatatgggcctaattaggccgtcaggtttgtgcactatccggccgaaattgagtgggccaataccacagttccgtcatggttcgccggatgctccagcgtccaatcgccgccgccttcttccaggtcactattgcatatggagatacgaattttaatacgagtagttcagaaataaacatctaaacatcactgacttaaatttgtacattttatactgtaatcgagctgaaatacggatagaacgtacgtaatgcatggtgcgaataaactgtggaatgatgacgattcgacaggctagcattaataattaacttaatccatatatggttaaagaaatcagcatgcttatcacattaaatcatggagcctaaatcatgaatgtaagcatgttacgtcgctaccttaacttatctggtgcggactttgcagtttgcagtactctcttccagccattttgttcacacaacgatcgatctgtgtgtgttcatcatctctaatcgtattcacataaatggtagtctgatctgattaatattctgatggtgtgattaattaatataatcctgtaacgtgatcctggggatcagatctcagctcccgatgcaagcagctagctcaattaagcccataatttcttgtcttcttgtttctagctagaggcagtacgtggtatcgatcatcaagaacgtactcacagctggtgtactttcttcggaatcagaactcagtttttgttcgttagcgacctacttatatagagccaaaaggaaaatcggttgccacatgcatgtaagtgtgcaatccagctaggctacaattcatagatgtcagaccatctaagaactagttttaacagcagagtcaactattaagtataagctaatattacagataacgtttataatagatgaataataaggttatctctattttttctcctctctttctctcacctatgtatttaatttagttatcttaaattatgaatagttaactattacattagagctaacacaacttatttttccactatcctcccctccctgtaagttttatagttgacttatagcctactattaaactatttaaactagatcttgagcttatacttgctagttttacaattcttgttatttaaacaataacacaatcttcaaaatatatatttaactatatttttaatattatatataataaataaatatatttgtacttattttagcgccccacatccaacgttggcccactgcccctccatccccatggtatcggcaccgttttaattaggtgcctatttgcttgtctaggttcaccgtccaccgtcaaaccgtcatctctcacggccatccctctaaacccacccgatgatctgcctcctcctcccacccccaaccaatcctaacttgggaccctaaaccattactccactgccattcgtcgaggttatcggagatgtaggagaagggttgccagatctagtgaaggagttgtagtcattggagcacaaatcgtgtaggaaatataatcctgtggtaaaaaaaattgaaagattttgattgaagcaattccaattaaaattacaacatcaggcaagcaatataagaattttttttacaaatatacttattttttcaataatttacatttatatatatgcatacaaattttttgtaaaaatatacccatcccgcagaacgaaaatgcgggatcgcgacggtcccgcagcttcaaaacacgggaccgtcggtcccgcggacggccgcgcggcactgcaacggtcccgcagctccataacacgggactgtcgcggtcccgcagctccaatacgcggcaccgtgttgccagcgatttttatactgtgcgcactgttgaaacactgtttgggtactgttttgaaccgtgcgtggagcgcttccgcacattcaaactgcgggatcgcccatgaatattgccaaacagtacgaaaacagtactaaacagtgccgcgcagtataaattttctggtatatagcaggcgcgtggtagaggatgggaacgcgcggtcccgctcaacgactacgcgcgaccggtgcggttccgtgcatcggcgacgcgccgcgcaacggcgatgcgggaccgtctcgggaccacgcgttcccgcgctgcttctctccgagccacgagagcgagccggtgccgcgcttccgcgccgcgggagggagacggtgccgcacggccgtactgcgcaaccaccggtcccatggaatggcaaggcggcactgtctcggtcccgcatccttgtcatgcggtggaggtatatttatgcaaatattttttatgtagatatataaacgtaaaatatttttaaaagaggtatattttcagttttgtttcagcaatataatgtatcactttagagactcagaagaaatttttatcggcagatcaaacatttccacatatttcaacaaatgcaactggtcaactcgcttcaattccccgtgatgagtcggcgatcgatttccacgaatatctgttctctcctggcaaaatcttgtcctatctctcgcgaacacctggcccatgcacctacaacaaccaagcaatcattcatcatgcatgcaactagcaaccgcaaatacatccattctagccataatccggctataaataccagacgcccaaatcaaacgatgcaaagcaacacaagccgaccgaagcaaacatagctatagctagcacacaccactagctaattaagctcgctcgatcacttcatcagttagcaatggctatcaccaaggtcgctcccctcctcgccctcagcctcctcctcttcgccgtcgccgccgtgcacggctgcgagccctactgcggccacggtggcccggtcatcccgacgccgccggtggtggtgccgacgccgccgtcgtaccaccgccatggccgctgcccgatcgacgccctgaagctgagggtgtgcaccaacgtgctcaacgggctcgtcggcgtcaagatcggagccggccccgacgactgctgcccgctgctctccgggctcgccgacctcgacgccgccgtctgcctctgcaccgccgtcaaggccaacgtgctcggcatgaaactcaacctcgccgtcgatctaagcctcatcctcaacaagtgcggcaagatctgcccctccgacttcacctgctaattgagctcaaaccgtgcgtgcagcatgttggatatcatgattcatgagtttgatctttcatcccgattcccgacgcagcgttaaacattaatcttgaaataattctcttgtttactcgattcgccatttgcagctcgttctatattataatgtaaaattcttgaatcacttggttgttgtatattgtaacgcccattatatatagtagtattttttgttctcacaaagataactgccatatagcttacacgttcaccttaagttctttcttttctatccgtgcataaaaacactcgcacgatatgtgataatcatgggcgatgcggcaattcttgacctaactgttcctatttcctcaagccggtccacacatgttcctagccatgtgggtcctgcatcatggtagtctcttttggcccaacatgtcgcgtgcatctcgttttgtttgggatgttggcgggctgcttcctgttttggctgattagaagggttactaagttttgaatcctaataagggtaaagaagagatttgtacgtgacattgatgtgacatgtcatgctggcatagtcatgactgataaataggacccacttaaaatttttcatttttatttttttctttctcttttctctttttcctttttcttctcttgtttctctttttttccctttctcctccttcctctcaagaccatcgccgcatggggtgcttaggtcacaaagaaaggagaagaaaagaagaaaaaagagaagcagaagaaaaagagaagaaaagaaaaaaagaaaagaaaatgttttaagtggatcccgtttgtcagtcagatgactgccaatcacgtccatgtggcatgtcacatgagtgacatataggattttagatgggttgtgacgatctgggacttagatgacacacttcaataagttttgagatttatatttatattttaagagtttaggaatctgaatgacacaaaccatacaagtttaagaaccaggtgtggcaagatgtgcctacctaggtccacttcaaatagagcagctagcccatataacaatgtgtcataacccaaccaatatttccaaaacatatgaaaagagaaaaaaaacataaaagtagaatataatactcattcaattcctatgagattgaaacactggaaagtttcaaattgtttttgatgggcacacaggaaaaacacagaaaacatataggaaattgtaacatcccggcctaggacttaataggattaatagaatactcatatcaacaagttgcaacttcttttccggaagccaatctccaaaaaactccagggttaagcgtgcttggcctaaaattcttcccgggtgcacacgagtgaggacaaagtgtgcagaaaagacatgtgttggtctgtgagggcagtctatgacctatgaaagctatcagatataagcgggcctacctaggaaagctatcagatgtaagcgggcctggcctgggagaggcgggtcgttacagaaatagaaagaatgaattgagacttcaggctatttaatttcctccaaaatgtttctagaatagcacatttcatatgaattctgaaggaattattagtagaaatcaatccgttgttttaaaaggctttataggatttttatcatagaatacaaatcctgtaaaattcataagtttttctctcttttttttgaaagggccttcatgtctataccgtgggagagcaaaaaaaaatttgagttaattgcactttggactaggaaaatttaacaaagttttactttggacaaggggtgaagttatattcactttggactagataaatttacaaaagttttaaattggaccacccttcttctccatctcctttctttcccttcttttctctattaagcagctgcgccatggatctgagggatgatcaagcaaagcaccaggattccttctctatgtgctctgttccccagcttgaagaaccatcaaaatcaagactggttttagctggttgctgtacctgtctcccgcaagctcgatgcaatgatttgttctaagctcagatgaacttttacggggaaaaaaggttgaagtcaagcagctaaatcaatgagtaaataaatcaagatcagatggaatattaattggtttgttgtgttgcgggtaagcccgccaatgaaatcaagaagtggcaaacaaaatagtggcccaatgtgcagtagaaggtaagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggagctagcctaataatgcatgttgccacctttctctgatgctggctagccattttgttcacatcgagtcagcctgttcatgtgatcgagtattcataatctgatccataatagtactattttgacggtgtgattaactaatataatcttgttcgtgatcctcgggatcagctccacaaagaaatatcagagtctaaactaaccagacaaagttataacgaccctcactttgcatgcatgtatgaaaaaaaaattagtgggaattcctcgcatggaattaagctcctatgatcatattgtcagtagcgaaggctaagacttagctgttctcaagctagatccatctttaggtacatccagctagccaatacaattcacggaggccatcccggctatgcgtgtacaaatggagcatattgactctgccagctcaagtacctaaaataatgcaggagagaggaatggatggatggttacgtatgacacgatgtatgcaaaattacaagtccatagcaagcatttcagaaagcattatattcagaacaagtattattcggcagatatataaagcacacatccatatattaatgtcaacaaatgcaactggtcaacttgcttcttccccatgaataatcgaattaattaaacgagaatatatgttctctctcctggcaaaatcttgtcctatctctcgtaaatacctggcccatgcagtacacaaccaagcaaataaatcatcacgtacatgcactacacaaccaaacaattaatcataacggatgcaaatattctactccctccttcaaaaaaaaaaacaaactctgggtttccatgtccaacgttgactatctattttatataaaaaattttataattaatatttttattgttgttagatgataaaacatgattaatattttatgcgtgacttgtctttttaatttttttaacaatttttttaaataagacggacggttaaacgttgaacacggaatcctaagatttgttttttttttgaacggagggagtaagcttcagctagttcagtacgtgtatagttccaaacagcaagctcgactcgatcggctataaatacctgacgccccaagcaaacgatgcaaagcaaacacaagctgaattgaagcagcctagctagctaattaacaccactagctaattaagctcgctcgatcacttcatcacttagcaatggcttccaccaaggtcgtcgctcccctcctcgccctcaccctcctgctcttcgccgtcgcggcgcacggctgtgagcccaactgctccggcggtggtccggtgatcccgacgccgacaacgccgtcgtacgaccgccatggccactgccccatcgacgccctgaagctgagggtgtgcgccaacgtgctcaatgggctcgtcggcgtcaagatcggagccggccccaacgagtgctgctcgctgctgcaggggatcgccgacctcgacgccgccgtctgcctctgcaccgccgtcaaggccaacgtgctgggcatcaacctgaatctccccgtcgatctgagcctcatcctcaacaagtgcagcaagatctacccatccggcttcacctgctaattgagctcgatcgtgcataattaatcttcatgcgatgacgaggattgatctgagttgcatgataaattaaagattaatcttgaaataattatattgttattcacttctacatttttgcagcccattctacattgtaccttactttatcattcttgaattacttaattgttgtaagttgtaacgcattatagcaatgttgttctccacatgataattgttatatagcttgtcctccttaatttctttctttttcatgtatgcaaaaaacgtgttcgtctcacagcgtttatctataccatctgtataattgacccacaaagtattaatactcaacaaagtaattattactactcttaaaacctaacatgcaagtatatcatatcaatccactaaataactaaagctcaagatgcaagcaagcatagcaattacatctataattttttacattctaaatcttaacattcaagcatgctaaatcatcatcccacatcactttcacaatatatcaacatataaatttatctatcatttatacaatgtttaacatatattcctctacatattccgtagcaaaacatgggacgtcatcgtatatttagtgataatggcgagtgaaaatgattgatctgtatctaacgatttcctcaaacaggcacacacatgtaagccatggggctaggcatgaatgcaggccttgcacgtaccatgctcgttttcggcctagtacctgtgtgcctcgtttcaacacaaagcacattcgacgtattggtgaacttctggttccgtcctattaaaatagtaactaagcttggtctgtctaaaaagggttagaaaagatgaatgacccaaatgacaagatgtgtctaactaggtccacttcaaatagagcaacccacagaacaatgtgtcataacccagtctttgcacaaaaaaaaaaacaattttatgtctgaagttaattgcttctaagccaactacaagaactagattataagctattaccgtccccagattctagggttaggggatcgtggctgggagagtggccttactctgtgttcccaacacagctgctgcgcacgaaaacgttaacggagcggtacattagaacgtgattaattaagtattagctaatttttgttcaaaaatagatcaatatgatctttttaagcaactttcgtataaaaactttttacaaaaaacacaccgttgagtagtttgaaaaatgtgcgcgcggaaaacaagaggagggagttgggaactcatggaaatgaacgcagccctgatcggctttacaagcatctgaccctaggaacaaattgtctttaattttctaaatgtttttcttcaattatatcgaaaataaaaaaaataatggttacattgtcgcacagctaattttcaatttttcagggtacgcaacatatgtcctacgggaaaaattataaactttagatgtcatgccgcaaatcttgcctacatgtttatagtggtaattgagcaaaattcctttgtatatgttcgtagactgcagaacacttgcatatgggatatgctgaaatactgacagagaacgtaatggttcgaataaacagtgtggaatgataacacgatcggagacctgctagcattaattaactaaaccgatatggctaaagaaacaagcatgcttagcacattaaatcatggagcccaaatcatgcatgtaagcatgttacgttgctagctacttaatttgtctggctcggacttactctcttccagcgattttgttcgatcaccgatctgtacgtgtgttcatctgtaaacatggataagcatggtagactgatctgataaattaatataatcctttaacgtggtcatggagatcacagctccgattccagtagccaaattaattaagcccataatttcttgtccaccatgtttctggaggcatagaggtcaagaattcacagctggtgtacttaatttgttcagaatcagaactccgttttaatttgttcattaaagacctaagagctaataaacggaagttaaaatcggtcgctacgtgcaggtaagtgcgcgtgcatggtcagctgggctacaaattttcatggaggtcactatgcgtgtatatatagagtatacattatagtgactctgcttaagctagctccgatccggccagtagtagattaatggtggaagaaattaaggaggctatgacactacgatatcgatgcacatttaggcaaaaataaaaactctccaaggcatgcaactatgtcagaaatgctcgatcagaacaagtattagtcagcagatacaaacacttccggccatatatttcaacaaatgcaattcgtcaacttgcttgcttggccatgaatcgatcgacgatcgaactgaaagaatatcatttttccctccaggcaaaatcttttgtccaacctctcgcgaagtacaccagctggtccatgcagtacacaaccaagcaatcatatatatgtccatcatgcatgcctaacaacttagacagaacaaatatgtctttttacttgagagttaacggtcaacacacggttaaactgacggtagtggcatgaaagagtgcgcaaatttggaccaatggcatataagaaaagagccaatttccaatgatatataagagatccgaccaattttcagtggcatataaggatccgaccttattctagtcctctagctactactagttcagtacgcatagtttcccaacagagctagctcgatcggctcggctataaataccagatgccccaagcaaacgatacaaagcaaacacaatctgaaacagcctagctagctagctaacacaccactagctaattaagctcgctcgatcacttcatcagttagcattagcaatggcttccaccaccaaagtcgtagctcccctcctcgccttcaccctcctcatcctcgccgtcgcggcgcgcggctgtgagcccaactgctccggtggtccggtgatcccgacgccgacaacgccgtcgtacgaccgccatggccactgccccatcgacgccctgaagctgagggtgtgcgccaacgtgctcaatgggctcgttggcgtcaagatcggagccggccccaacgagtgctgctcgctgctgcaggggatcgccgacctcgacgccgccgtctgcctctgcaccgccgtcaaggccaatgtgctgggcatcaacctcaacctccccgtcgatctgagcctcatcctcaacaagtgcaacaagatctacccatccggcttcacctgctaattgagctcaaccatgcatgcataattagtcctcatgcaatgactggctctgaaggcttgagttgcatgattaaagattaattaatcttgaaataattatcttgtttactcgcttctgcatttgtggctagctcgttctatattgtattgtaccttactgtaccattaattctttaataatgattacttcattgttgtgagctaccttaatactccctctgtttcttataaggtgttttaactttgatcaaagtcaaactgtttgaccaaatttattaaaaaaagtaatatttttaacccatgataaatttattataaaaatatattttattattttttttataaaactaatttgttaatgtaaatattactatacttgtctataaacttagttaaatttgaagtagtttaactttgaccaaagtcaaaatatcttgtaacctaaaatggagggagtattgtttttcacgagatagctttcatatggcttgaaaaacgctctcacgacctatatatatttgatgttgatttattcacacatgtttaacacatataaagcggatcggaattttttgtattttttggaaaattcactggggggagagctttcccacctgaattcattaaaagggagcaaagggcagttttacaaagtccagagcattacatattgagagagcggagggaggaagaaaagagatctttccaggtcgaaattacatgtctgtcttctactttgatttccccccccccccaagagggaggcgtcctcgatacattgctgcagcaaacggcgcaaagagggagcctcgtgtctcaagacaaccccgtggtggtgattccacatgttccaaaagcatactccctccgtttcacaatgtaagtcattctaacatttcccatattcatattgatgttaatgaatctagatagatatatatgtatgtgggaaatactagaatgacttacattgtgaaacggaggaagtagcaagtagaacaccctaaagtgcttcaagggaacttgaggcggggtggggagagaagcaatctcagcaagcgtcgcaacattgaccggtatattcatcgcgccccagaaggccacagcgaaggggcactggaagcatatataggtggagggctgtttcatcagcaaagttgcaaagatcacaggttggagccggcactatggttttcttatgcaagctgcgttttgttgggagacgatctttagtcaagagccaggcaaaaaaactgaactttccagttggggcacttctccatctcgtcgtattctgcaacaagataaagatgccttgtttttaagatcccaggggcgcctttcttggtgcgaacatcttgctgatcagtcactgagcactgcatcaagaagctgctaagatggttgaagtgccctggagcactgcggatcggaaatttggaatcgacctggagcatagctagtcgtaataacaaaaaagattttttttctcggtccgtattatgctcggactagctagctgtatgcgtttatccgcgtaacaaaaaaaataataatctgagatttccactagaacacaacgaatagagatcacgaaaataaacattatatatatatatatatatatatatatatatatatatatatatatatatatattctttttgtcaaatttataatagcatgaatcaaattaatctctctgttttgaacaaccaactgatagagacaatcagatacaccatttcatacaaagtctgaaattaattaatcacaattcacaggtactgtacggattcggggtcgtcgtagtcccagtccccgaagatgacacggctcatgtcgatcttggtccactcctcctccatcgccgcctggatcgccgccgtctcagcgaagtagctctcgccgaccatgtagcagccgtcgttctcgacggcgcggcgaacctcctcctggaacgcctcgaactcgtcgcccagctcggcgtcctccacttccccctcgcgctcctccggcgagaggctctccatgtactcggggctccgccgtgggttcctcttcagtgtcaggatggaagcgacgtagttgtcaggcatccgcaccttcttcttcttcgcagcagcagcgcatggcttcttctgctagtcggcgacgacatacttggctgctccggcgatgacctgagcagcagcaggaggaggcgccgccgccgtcgctgccgagccggtgatcgccttcttctcctcctcttctgccatggtgtggatgtcgcgctcttgatccagcttactcgcgcgctccaccgccggcggtgctcgtcgtcgttaccctcgccggccgccgcgatgcgctcggtgattggcggcggcggtgggcggcgtcccgagctttatggggacaaatcccaattgatgagagatccgactcggattctgatctgatcttgctccggcctcaaaactaattgggccgggcctgcaggcctaacatattcccaaacgcagcatttttggtgggcttccctttcctgccggcccatgcttgaaatgattaatcagattaggcccgtttagaagaagacagcccaccttgctgcgttgccaccgtacgtagttcgacgccgtctccgtcgccggacgtccgccgcctgccagtgtacgatcctttgtcaatgcatgcacgtggttttcatacttaattcgattagatggccttaatttcatctaaaactgattcgagctactgaattattttaccgatcgattagctagctaaactggtaatataacaaacctagaaaatgagcatatatagcacagctcattatatcatggggataaaggtcgtagctctagctagttatacgttcgtcgtctggtgcagagacagcagacgacttccagctataagctagtttgttttcagttctcacttcagacttcagagttgtacagagttcagactttcagaccagtcggcaattagtcccacgcatccctgcattattcatcaaattgtccagccagtcgtacgtatttatttatatatatatatatatatatcttgcgtggatatacaatataatcctgtaaagctgttatgtaatctcctcgggataccagcttcaattcccatctttcaattaataatgccttagatatgcccatgcataatgcttctctgtacatttcttcagaattaactctgtttttcttttttctgtagagacctatacgtacaggctacagctaaagagaaaatcaaatcaacaggaaattatgcaaagttgcttaattggaaatgagtaatactttgccagaatacatccactgccacatgcatgcatgcatgaaaatgagcgacaaactggggtattaatcagagagctgaatatactatgtgcgtgtggagtatagcgtataccgtgcgcgcgcatatcctccagtgggctaagctccaaactcatcatcaagctgcagataataatctactccctccgtttcaggttacaagacattttaactttggttaatgtcaaactgttttaaatttaactaagtttataaataaatataataatatttataacactaaaatagtttcatcaaattaataattaaatatattttttctagaaacttggttaaatttaaagcagtttgattttgaccaaagtcaaaacgtcttataccctaaaactgaggaagtatcagttaactatacgcctatacctgctaatgaaccattatatgtgatattctgaatatatgtatatgtactgatatatgtgtgatttcagatattgtagttagttatcagcaagttcggcgcttgatctgagatatttactcgtatatatataaggtatataaacaacgtgacaggccacttagctgaaatatataaaactgtaagaaaaacaatagtcgatagatcgatcgtgaagttgtgtgatatatatatattgcgcaaatatattaggcttagatactggacatgattgataaattgctgctctgcacgtacgcctatgcatggctgaaataattaatcaacaaccaatctagctagccatttccttcacggaaaaatccttgtcgcatctgatctctagcaaaacaagcggcccatgcccatgcatgcaaatccatccatggacacaaacccagtgcacatgcatcgtgcatgcaactagctgcagtgttcatctataaataccagacgcctcagccccaatccaaaacacaagctaattaaagcagccttagctagctaattaactctactagctaagctcgatcacttcatcacacttgagcaatggcttattccaagatcgctcccctcctcgccctgaccatcctcctcttcgccgccgctgcgcacggctgcgcgccatactgccccggaggggcgccgccggtcatcccgacgccgccggtggtggtgccgacgccgccgtcgcaccaccaccacggcggccacggccatgggcgctgcccgatcgacgccttgaagctgagggtgtgtgccaacgtgctcaacgggctcgtcggcgtcaagatcggagctggccccgacgactgctgcccgctgctgtccggcctagccgacctcgacgccgccgtctgcctctgcaccgccatcaaggccaacgttcttgggatcatcaacctcaacatccccgtcgatctcagcctcatcctcaacaactgcggcaagatctgtccctccgatttcacctgctaattaagctcagctgctcaagcttgcatacatggacaaatgcgcagaaacaatattcgtaattaagcttatctatttcattcgatgatggctagctagctagctgcatgcatgccgtggctatgtcatccagaataagatgtgttgttgttttactctgttcccttatatcaattttgtattgtgttgtattgtattcgaattgaatgagttaacgagttttgtaaaaccgatttgtgcttcatcaatgaaatatctgtggtgtaagattgttgtgacaacgattattaccagcaagatagtatagtagtactaatcatcattaacacattcgctttgtgcttcatgacaccatgaagcacaaaggcccatcctatacaaaataaatgcgattaggcggcccatggggccaaatccggctaacccaagcgatcgaaatttggatgggcctaacttctctccgcgcacatccgcgttaatgggccggggcgcgacgggatggcccatggctggctcgatccatcagcagccacgcgcgcatggtgatttctcgccggaacgccgccgccgtcgagcttgcgttcgtcgtccgtccaccgctgcagcctccgtccgattcttgcatgaatccgtacgacgtcttcttgtccagcaaaagatggagaatcactgcgccattgcgaccaacatgctagcagcgcgcacgcatatgcatgcaaaggagctttgaattaactaggagtagcattttctttcctccccaccgccatgaacatgaatgcttcttaggcactgttattttctctaacaaaaactggataaaagtggcgcgctttttaaactgctaaacggtgtgttttgtgtgaaaactttctatattaaagttgttctaaaatataagattgattcatttttcaagtttgtaataattaaaaactcaattaatcacatgttattaccacctcattttgcgtgaagcacttaatttttatcttcatctacatcttcaggagattcaaacactgtcttggtgtgactagataacggtataccattcaatcaatggaatattttacatgctgatgtcaccatgatattagcatgataccgtaggtaccaatactcacatgtattaggttatggcacctaagtagcattttaatgttagcagataccttaggtacgggtccgtccggtatcaagagtacccgacgtgatacccatataccagatctggtatctaggtaacatgatgacattaggatggtgtttacaaatgtaaactatatcggatagcattttatagtatttccgtagcatagtactctctctttcggaatgttagatattttggtgaaatttgactaaatttatagaaaaatataataacatccacaatagcaaattaattttattaaacctactattaaatatatttttataatatatttggttggtctaaaccatgttaattactacttttcttatataaatttgacttcagattaaaagctaaacatcttacgttctaaaacagagggattagataacactaaattatcatgattattacaacactgtggctgattttatccggtctatatatcctttaattttcagcctgtcggtgcgtgagaaccattttcgcatgcttgtattcgtgtttgtcttttggccgggcctcataatgttgactatatatgtatcgtgcatatgatacgtgtatataaattaaagaaaaaaaaaccctgaaaggctgcaatgcgtgtaaccgtatcgaaaagcttcaggcccggttgtcatgcccatgatttctgctttgtcgtccttctcacgtcgttgcagtttgcagattgtagagttagtatctacaagtcatctactcacacaagatgactctttaaagaactgttcattgttcaacactgtcacaataataatatatcatggacagtgtactccttttcagaactctcttttgttgtttagcaatcactggggcgaaaaaatagctggaataataatcaaactgtgcatatgtatatatattaattagtttgcttgcaatggagaacaaatgccttgtgtcaatgcgttgtacacaacacatcacgacatgcagaaaaagtgtgctgcaaaccagctgggtactggggctacacacacctatctattattcatcctgcaagctcacatatgctgcatgtactcgtcgatcgacatagatggtccggcacaaccaatggcagtgggtgttttcaacacctctcgatctgcagctgatctcaacagtttattttatatgatggtgtaaccatctaatataccatgttgctgataatttttaaccagagcaattaatcggagcatggccctagtgttgaacaatttgcactttcacagtcaggtgtaacattttgtacattcagcataatggtatgctctttgcgctttttcagcccttgtgtaacacagcaggatttcaaaaacacaaggataaaaaaacgtataaatagaatagcatgccacaacaaatcatacaggatttttttaaagaaatgttacaggaaatgaatccactgaatttttttttttaaaaaaaagtttggtaacaccataggagaagtaaaggaattaggagtcacgactcatgatgaagagaaaacatgagatttaggctcatgttaattttcctccaaaatttgttgaaatgagccattccatatgaatttcaaaggattttatatgagtcattcatttgttcgtaaggacaatataggaacatttttcaatgaattgtaatcctctataatttctacagttctcctttatcccaaaggaatctttacgtacgcacaggtaaaattgggactcccatgatcccatctttaccagaaggggcgagctagaggattgccgtgcgtaaatttgcacggtgctagctagctagattttgaaagtagatgaaccgatatataacactttgggtttcatactttcattagtccacatgaacatcgaaccctagcttagacacggcataaatcgatcgaggcatggacgcatgtatcagtatttgcatgattgctcgatcgagattatattaccctcttacacatgcatgcatgggggaataattcaacaacgtctgaatgtctgattcctcatggaaaattccttgtcacatctctttctctgagtactctaacgaacaactggccatgtatgcacatgcaccccagagacaacctagctacgtaccctgcatctgacacccccacatgcacgtaccattgcatctgcttacttcggattgataatacttacagtgaacaacacggtctcttaaaaaatagctttgattactatttctattataatatatatagaaatattaacaaatatataattttattagatcttaacaagcatttctccatattcatccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatccatggctgcttccaaggtcgctcccgtcctggccctgagcctcctcctcctcgccgtcgcggcgcacggctgcgagccccactgctccggcggcggcgcgccggcggtcgtcataccgacgccgacggtggtggtgccactgccgtcgttcggcggcgcccatggcggctacggcggctacggccatggccgctgcccgatcgacgcgctgaagctgcgggtgtgcgccaacgtgctcaacggcgcgctcggcgtgaacgtcggccatggcccctacgactgctgcccgctgctcgccggcctcgccgacgccgacgccgccgtctgcctctgcaccgccgtgaaggccaacgtgctcggcgtcaacctcaacgtccccgtcgagctcaagctcatcctcaacaagtgcggcaagacctgcccctccgacttcacctgctaattaattgagcatggaaagtgctcaaaccatttgcgcaaaattaatgcatatttatattatatttaattgagtttgttttcatgcaatggccattggtaagttgcatgatgcatgagtaagccggcctgaataagctattatccccccttgtgttagtttaattaatttgttgcatccgcattaatttgttgtaccattggaatcactcacttgtaatttgttgttgtataaccaatgcattgtgatcatcatcaattaatatattttcatttttaatatgatcgttctttctgatctatgaacacgtaagatcgatcgatcgatcaagctaatgaatctgacgaccatatcatggcgaagcatcaattctgaatttctgtttgtgaccacaaccgaatcgatccggagcgcaacaacagaagccgcgcgcagtgctcaaactggggctgtgggctgtggcccacatatgcagacatcgcgactaaagggcccggcccattcgttgcacggcccaaacacacatgaatctgctgcggggtcatcctcctttatctgaaccacacgatttcaatctaacggtgcaggacatgacggcacagaacggccccatctcacgtccttcctggaatccgccgccgtccgccggagctccgccgccatccgttcaccggcattgttacacagaccccttatcctactccaacttcttctcgatggcattccacccagcttgtgactcgcgactttgtgagtacatgataaaaaaaacttaaaattcagatagatattctgacatgaaaattgaatgatctcatcttttcgcttatgcttatacttgttagctaaaatttgaatttttaaccttaaatttgaagttgattttgaggtttttttcatcgaagtttatttttcaatcgactccactgctccagaagtgtgaagcacatgaaggtaaggttcagtcagtcatgggtgcatcacaactcacaagttcacacctcttacatcttgagatgcatcgatcacacggggcacagcaaaaatcagctagctagctcattggttcgggattaattgcatctcaagagttcagacttcagtcttcagaggcaatgaccgtccttccctctttggatcaatttcagatgaatattgagtgtggtccacaaattttggaccaaattaattaaaacgatcatttgggacttgggagcgcctttacaaaccaccgctagatcagaagcgaagaccacagattgaagatgaattaattcatttatttgtgtacaattaggttctacattgatcgagctgcataggtgcccgcaccaatcggacaaagccacacacatatatagtgatcccattaatttgcccatcgaatgatgacgcgacggcgccgaatctaataatgccctgaccctatggtctccggcacatacatgcctcgtcatatgagcttacttaattaagcaccgcaaacttgaaggtgaaggtgtacttcacatgaacattacagatcgatcgatgccacttcattcgtgcacggatatactgtatgcaccaatattgtcgaccacaagatcgtttaagagtacaggtagaatacccagatatatagcttagttaattattaagtccgtccaaaaatatactctctctgtttttctctctgttttaggttataagatttttgattttagtcaaaatcaaactgttttaaatttaatagataaatatagcaatatttatattatcaaattagttttattatattaataattaaatatattttataataattttatcttggattgaaaatattattatttttttctataaatttggttaaacttaaagcagtttgactttaaccaaagtcaaaaacatcttgtaacctgaaacggagagagtaacaacctaatttctatccagattcgtgatactaaaatgtatcagtatctagtattatgttgttatgtaattgccggaacaacaaatgccgggccgactcaagcaaatgcatgcctagctcactcactcagctcagctcaatcccctgctataaattcactagctagcttgtgcactgcacacaacacacacactgaactctcacataaacacttcaactcatcccttagctagagctatagctagtgtgtcaattagcaatggcggtggcgcacaagaacagtagtagaaacaagcttgcagtcgccgccattgtggcgctgatgagcctcctcgtgttcgccgcggcgccgtcggaggcatgcggcggccgctgcaacggcggcgcctgcagatcgcggtgcgccaaaccgacgccggcgccggcgcgccgcgccgccggcgccaagtgcccgttcgacgcgctgaagctggcggcgtgcgccgacgtgctgggcggcggcggcggaggaggagggctgctgaacctgggccatctgctggggaactcgtcgccgtcgtcctccggcgagcagtgctgcgggctcctcgccggcctcgccgacgtggacgccgccgtgtgcctctgcacggcgctgcgcgccaacgtgctcggcctcgtcggcgtcgagccgcacgtccagctcagcgtcctcgtcaaccgctgcagcaggaagctccccaatggcttccagtgctccagcaactagctaattaagctagctaatttgattatatctgaattaattagtgcttgatgagcagctcatgcagctattgttattgttcgcttatttgatttgttgttaattgctttcggtgtcgtgtgtgatcgtgtagcgcatgcttactactttgatgaccgatgttgagttaattaattcctgtgcttgagtgagtgacattacatctacatgtacctcggagttgatttgtgcttttgcgtgctaaagttcgttataaaaatcttgtgttgaatatatgttgctcgagtaatataccgtatatgtgattctgaatctgagctgaatatggaatagtcagtgtttaatctgcatgcatggagcaagattccgagaaacaaccggtgagtaaactagcgagaatctgaaaaggaatgagtttgccaacttttgaaattctgcaactacaaattatcagaatgcaagtcaaaatatggaatgtttagagcaaccggggattattctcaaagttaaagctgctataggcacccccaaaacagggccaagagctggtttggaaacaatgccagaatccataactcgtctcatttctacagcttaaagccaggttgcacctatagaacattgcccaacagatgaatggcgcaaaccgtggttcagactccagggcattctgtaagaagttacagggcaaatataggcacttgaaaattctaactttaaatcgtcaagagtcaattccttagcatgtgcaatagttgctcaaagacactcatcgcattattatagaacaaagccatgcttggcaggattcagcaaatcacaagattgtaacttataaaaatacagcgacaacaaagacaaccatcaggaacattggaattgtcctgtttttttctctgattaaagaaggcaagagaattcagtccatcacatcacttgaggaagtggggtcttcttctatggtctatcaccaagttcctctctcaaattgtcaaatgggtagacttttggagtctgcatgaagaaatataaaaaatcctcagtcaagttgttcataaaagcaaatcaaaagcagacaggcatcatttgtcgtgattaggatgaaccattatcttaacttgatccggtctatgctcagaaatagtatgcatatttctttgcccattggcgacaaaatatgcaacaggcttgctactgtaacaagtgttactttaatgactgatcgcacaatctaatagcattctggcaaatataaggagataaattgaaaatacagtattgccccctctcttttgtgaaccttcattcttcaattaagttacagacctggaacactgaagaggcaagttgcttaacatgtatagtaactctgctatctgctgacacttttaaggagcaaatcaactcttggggggatttcatctatggcagagaagcaacttagagaaagtaagagactgtgtagcctgtacggagtatcgaacacggataatatgtacaaataaaatcctacatgcttcaaagttcgcaacagtttagcctaccacaccatgtcaccatgatatctctatgaactatgaagctagaccaaacacctccctttttcccctaaaaaaaactcccttttcagaatcgaaattggataggtgctgagaaaggagactaataggtcagaaaattgaagggttaaagagttctacaaagaccacacaaagttattatcacagccccactccatgattcaactcaaactagtgcctagtatgatcacattgaggtaatatttagtgttacatatagaccaacagaacatgataatcaatactactacctccatttcacaatgtaagactttctaacattgtccatattcatatagatgttaatgaatttagacgcatatttgtgtttatattcattaacatctatatgaatatgggtaatgctagaaagtcttacattgtgaaacggagggagtacaattcaagtaatataaatcaaggcttttacatatgaggaaacacaatgaagttatatttacagaagatgctaaaatatagagtgcatggcctgatcaagaagtaaatttaggcatagtgagtaaaatgttccctaagaatatcacagattctataaaataacacctcatacaatatcctctcatccaaaaacatttgaaggcagctaataagggtgactaaattcagcttgctaacagagagtggcaatacgccatatatatttgtaactgtttgatacaagaggataagagcacatgactgattgcatttaggatttaaaatatacatccttcaaaaatgccatctattcatcatattttcttacagtacaactaggtctatgattgtttagtctagtgatgatttctttttatgaaaatggacaacaatgatctcaattccattaaatcattttcaaactcttttttttccctcttttgctgattctataaattggagggtaggaacaatataaaattactctttgctatatgactatatagctaggagcaatatagaattacttgtcagtatatactatatagtagcaaggaacagatcgaacccaaggagctattgttcaacagaaaacttcaatgtgcattgttaattcaataatataattaatgcagatgatcagcatactcccttagtggcctaatcctcatagaagttatctggaggcaaaatcttctaacttgagaatgactagatataacatttagacatattaactgtgccacctagagaatcatgtgagcaaaatggaaggaaaggaatttgcagaaacaacggcaggtcctaatgggcgaaataaaggtttaactatgacacagggattgaatcacagtggccatttcccatcttaatgttttccccatccctgcaatgttttcttggctatttggtctaaccttacagtattactttgttcactcctactgttgttgaaatgctagcaattctactgtttgtccatccaacagaaagtaaaatatcacaatgaagtatttggcactcacataggggatcttggaggccttgtcgttcaaggtggcagccaagccaagagtagcgaagaatccgagcccaccgcaaagccaggccagcgcctcgtactgaccaaatagcatcacatcaaatcaaaccagatgagacccccacgaatccatgtgattcagtgcatgagggttgggaatcagaccttgccgatgtgcggcgcgaggcggtcgatgcagggctccgggaagggcgtgccgttgtcccacaccagctcgtcgttcgtcggcagctgcaaattccccaaatccccccgcaaatcgaatcgattagatggagaaatcgcatcggcggagagagaaatcggaggagcacaaggtcgatgagagggggggggagaggtgtggcgagagacggcttacgggcttgtcggggacgatgtgcctgccgacggggaggcccatgccggcgcggtggcggagcgcggacaccgcggcgcgggcagcggcgccctggccgcccaggacgcgggatcccgccgcggtcagcctccctgccattcccacctcgctctcgctctcgcctctcggatctgcgcgtgcggttgtgggtgacgtcgtctcgtgtgcggttgtgctcgtcggcggcggcggcggagaggaggaagacgcaggagtgtaggtgggcttcagttcagccttcgcattgtgggcccgtgggccgagtggagaaggcaagtattgggtcaaccaaacggcctagtcgctgcatggcccaaacgcctcttttgggggttcggagaataaaaccacagcaatcatcacacgcgcatcagcgatatatattttttattttttttgttttttgttgccgttttggtttgatcggttgatccgaaaactggatatgagaaattgtcggacgaaatttgcactttctggctaggtgactgctgatggagtcacacgtacatattcagttcagttgttaaggctgtgtttagttcctaaaattgagaagaagtttaagaaaagttaatagttttaaaaaaaagttgagagtttatgtgagtagaaaaattttgtatttaatgcgatgtgatggaaagttggaagtttaggaaaagtttaatgtgaattaaacagggtctaaggtgatgagctgctagctactactcctaccttgcaaatgttgccaaaatgaactagctagggcatgaattatgggatcagcgatcagtataggtttcagaaagcgcacaaacatttccactcaacagtacagtacgcgcggttggacgagccataattaattcagatatacagtatgctgctccgtttggttaattccaggtcgccattattaaagtaggtcatgagataacagtccctccatctctgtcactaagagcacccacaatctatctaataaaacatgtacatctcagcaatagactagattaatagtaaaccacctcaatagtatgtctacatgggtatctatagctctctaatccattgtctcgtttttctctatagactatctctaggttagtagataattttgctctctctctttatttaatctctttcaagtaggaaaatatgctgacatggatctcttatagatagcctataaataaccattgtgggtgccctaacagctactccctccgtcccaaaaaaaaggcaaactctgggtttccgtgccaacgtttgactgtccgtcttatatgaaatttttttataattattatttttattgttgttagatgataaaacatgattaatactttatacgtgacttatctttttaattttttttataatttttttaaataaggcgaatgatcaaatgttagacacggaaactagggtttatcttttttttggacggatggagtaggagtattcaggtcatgactcatgagtgctatctgtctctacggtatttctgaagaaaaccacacggcaaatggcacaagtcaatcctacgtgctccactgtagaatctagtcctatagtcccatatactcttgacaagtactgttgcttattgtgatatcataatgcaattagtactttattacttattagtgagtactcctacgttcagaagcaacttattagttaactgactaactgcatatttaattaagcggctaagttgcgcgcggttctttacccatcaaattgcataatctgtaatgcggttccaagaacagcttgagtaaaatgagacagagatccagtctcactcgctcaccgaaaacatgaaaattcagaacgtacagtctgcaagaaatctcctcgcactcgccgacgtccgtgctatccgtacgtctccggcggcgacccctcctaggattgacacacagtgagaggggccgcgtggacccagtctctttttagcccaaatgtctccttggggattccacctccgacgaaccactgggcacttgcatttgttcggggtttagccttcatccgaaatctgaaaacgagtaattcggagatctcctctgacatccgagaattgatgcagatcatgcatcaccgtgtgtgtttagttcacgtcaaaattaaaaatttggttaaaatttgaacgatgtgatgaaaaagttagaagtttatgtgtgtagaaaagtttggatgtgatgaaaaagttaaaagtttgaagaaaaatgtcaggataagcaaggaagctgacgttaccaataggaggcgcgataaggactctgacgaaggcggaggagcagaagacggaggagcagaaggcgtctttgaaagagagaagcgccagagtattactaatcctagatatgttgggccggaatgggccgtgtaatagggtagagtgggctgagaccttgtggcacagctggagagagagagagagagattaaaaactactgtgtactgtctgaaacggcatcgatctggaactcggcggtcaaggcagcggcggcggctccgatcctgttggatcgtgagagaaatacaaagttccagctacctatcgtgttcttgagttcgtggtgaaatcgagtgctagggttctaacaatctggtatcagagccatctccaaccatatcctcttgactcggccgtagaatcacgaagcgcggattggaatctgctctcgagcagaatccgcaaaaagggaactcgcttcccttgctgcgtttgggttggctgagttcggagcggttgcgagtctttgatcctggagaaaccacggtacgttacgaagtaggctgcgcaaatcatggcgtaggaagggatgttggatttgctgcttaaaaccctggaggatattgagaagatgcggactgaggcggaagaaagaaacagagcagatctgaatgagttcatggcggcggtggaagcgaggttgcctcaagtagagaaacgagttggggatttgcattcgtcgctgggggatttgagtgctaaggtggaacaactggagagcgccatgcttcgtcaggccaaggcggagaaggcggtgggagacatcaaggaggaaccaacagctgcatcgccatcaccaactccatcgtttatccatggtatgagagatcctatgttgaattctatttcgccttttgtggtagaatcagcaggagtaccagaagggggtagtggaagtactggaattattgttggaagtgttccacccatgacatgtcctcagttcaatggggataatccacagatgtggaaggctaattgtgaagtgtatttcaatgtttacggcattcctcctgggcagtgggttaaggtggctacgctgaattttgttggcaacgcagcattttggttgcaatctgtgcgaaaccagttgattggcattacttggtttgatttatgtgaaagagtctgtgctcgatttactcgagataggcatgaagctatggtgagacaatatatacacatcaggcaaaccaattcagtttcagaatatgtagagcgattcgactgtctaatgcatcggctgttggcatatgaccagactgtgcctgcattgtactttgtcacaaaatttgttgatggccttaaggatgaggtgaggagatctgttatgatgatgaggccccaagatatggatgtggcctgttctctggctttgttacaggaagaagctatggaaggaagtagacccacaccttataagaggactgaaggcagcaattatgtcaagacatccagcaagctcacagccccaactctgtctatgacaagagaaccaaaccaaatcaacactgaagaaaggagaactgctgattctaacagaccaaaggaagataggctggcagcattaaaggcgtataggaggtcgaaaggcttatgtttcacttgtggggagagatgggggagagaccataagtgtgcaactgcagtacaattgcatgttgttcaagagttgttggaagttttacagggggattcaggggaggactcacctactgaaagttcaccagaaagggaagatatcattgttatggccatatctcagcaagcgttaaatggaactgagtcacgcaactccatcagacttagggggtggatacaagggactgaactattgatgttaattgattcgggaagctcccactcttttattgatgagaaaattgggaaatctatgtctggggtaaaattgttgactaaacccttgaaagtccaaattgctgatggaggagagttagtgtgctctcaggtaattcctaactgtagttggtggacacaggggcacaactttagtaatgatttcaagcttatcccactgggaggttatgacataattcttggaatggattggttagagcagtatagccccatgaaaatttattgggttaacaaatgggtggagtttcagtaccaaaatcagtggctcagagtattgggaatcagcagtagcactactagctatgcagaaatatctgtggaacaattgatgagtttggccaagatgggctctattatgtacatggtgaaaatcactgaccaccaaaacacagaagagcagtcctatccagatagcattaagcagattctcttggaatatcatgatgtctttgatgaaccatctgaactaccaccagaaaggtactgtgatcatcagattcccttgatagaaggtgccaaaccagtaagtcttaggccctacaagtataaccccgaactcaaagatgaaattgaacgtcaggtgaaggagatgttagactcaggggtaattcaaccaagtcagagtgcttggtcttcccctgctcttttggtgaggaagaaggatggtacctggcgcctttgtgtagattacagacacctgaatgccttaactgtcaagagcaagtacccagtgcctataatagaagaacttcttgatgaattgtcagggtccaaatggttcactaaactggaccttcgagcaggatatcatcaaattaggatgaaacctggagaggaacataagactgcattccagacacacttaggtcattatgaatacaaggtcatgtcctttggattaattggggcacctgctagttttcaaggggccatgaatgacacattgtcttcagtgctcaggaagtgtgctttggtattttttgacgacatcctgatatacagtcctgaccttcagtcacactgccagcacttaacacaagttttacaactccttagaagagatcactggcaagtcaaaatcagtaagtgtagttttgctcagcaacaagtatcatatttgggacatgtaattggggttcatggtgtgtctacagaacctagaaaaattttggatgttcagaattgggcagtacccactactgtcaagaagctcaggggatttctggggctggctggttattaccggaagtttgttaaggattttggtttgatctgtaaacctcttactcagttgttaaggaagggagtccctttcaaatggactgctgcaacagaagttgcatttcagcagatcaagcaagctctcattactgctcctgtcttagcattaccaactttaattttcctttcattgtggagacggatgctagtgatggaggcataggggcagtgttatctcaagaaggtcatccaattgcttacttgagtaaagctctaggaccaagatctaaagggttgtcaacttatgagaaggagtgcatggcaatactcttggcagtagaacactggagatcttatctacagcaccaagaattcatgattctcactgatcaccacagtttgactcatctgtctgatcaacggcttcatacaccttggcagcaaaaggcatttactaagctcctggggctccagtacagaattgtctatagaaagggcagtgctaattcagctgctgatgccctgtctagaaaagaccttggtgacagtgctcagattctggctgtatcttcttgttctccctcttggctccaagaggtaatacagggctatgagcaggacaagttctcttcccagctcttagctgaattgtctttgaatccgaaggctagggagcattatactctgcagcaaggcctcattaggtacaagggtcgaatatgggtgggtaataacacagatctgcagctgaaattgatcaaggaattacatgataatcctgctgggggccactctggttttcctgtcacttataggaggattaaacatctgtttgcttggttgggaatgaagcagcaaattcagcaacaactgaagcaatgtcagatctgtcaacaggccaaacctgagagggttaaatacccaggtctattgcaacctcttcctgttccaaagggtgcttggcaagtgatcagcatggatttcatagaaggattacccacttctgacaagtataactgcattctagtggtggtagacaaattctctaaatatgcccatttcttaccattgacccatccatttactgcattctctgtggccactgtctttatgaagaatgtttacaagctccatggtatgcctcaagtcattatctctgacagagatagggtattcacaagtcaactctgggaacatttattcaccaagtctggtactaagcttcacatgagctcttcttaccaccctcaaacagacggtcaaactgagcgggtgaatcggtgcttggaaatttttctgaggtgctttatacatgtaactccaactaagtgggccaattggttatatctcgctgagttttggtacaacacttcctatcactcttctgtgcataaaacaccttttgaggtcatttataggtaccagccgactcactttggcatctctatgcatgactgtgaaataccagatttggatttgtggttgaaggatagggatctcatcaatcagctaattcaacaacatttacatcaagctgagcaacaaatgaaagcttatgccgacaagaatcgtactttcagggagttccaggagggagactgggtttacttgaaactccaaccatatgtgcagtcttcagtagcacgcagagcaaaccataaactatctttcaagtactttggaccttttcaagtgttgcagcgggtgggattagttgcttataaactggctttacctccctcttgccacattcacctagttatccatgtctctcagctcaaggttgctcgtggctataatcctcatgttctgtctaccgaaccatttcagtggaaccattggcagagtccgcagcagttcctagacaggcgcattactaagaaaggcactggcttgggggcaagccggtttccaaggaagggagaatgtcaggataagcaaggaagctgacgttaccaagaggaggcgcgacaaggactctgacgaagtacaggatgaaggcggaggagcagaaggcgtctttgaaagagagaagcaccagcgtattactaatcctagatatgttgggccggaaggggccatgtaataggctagagtgggctgagaccttgtggtatggctgaagagagagagagagagagagagagagagagagagagagagagagagagagagagagagagattaaaaactactgtgtactgtctgaaacggcatcgatctggaactcggcggtgaaggcagcggcggctccgatcctgttggatcgtgagagaaatacaaagttccagctacctatcgtgttcttgagttcgtggtgaaatcgagtgctagggttctaacaaaaaagtttggaactaaagccactatttggttgattcgaggccgccattatccaagtcggtcacataataacaagagcaccctgagtcattgatgtctatatatatcagcatcagagtcatttaccgttgaatatctcccaaaatgtgatatcattcatcagatactgcgatatcgtcactcaattgcttagtggtacattcgaagcgagctaactcaactactctcttcctcctaaatatatgacgctgttgactcttggtataaagtttggacatttatcttatccataaaaaaatgtataaatatgttgtgatttgttttatcatccaagaaactacagtctaaaccttttttttacatatttatactagatttttaataagacgaatagtcaagtgttatgcaaaaagtcaacggtgtcatacatattgaaatgaaaattctacttaaccgaactatcactgcataattaagaaagccaggttgcagtgtaatgcagtccaacaacaagcctgaaatcattctgctctctagtctgtaatgcagtcgaagaacaagccgtgaacattcagctaggagaagtggaaaacctgacagataatcagtcttactgaacagggaagctgctgattctgataatatctgaacaacctttgcgcgaaatcggcgctgcctcgtcgcagctaccggcgactccccgcgctccataatccgtcgctcgtcgtcgccatcgccggcggcaacttttcttaggattgatggagagagacgggccagcgattggcccaaactcctcttgggattggcccctccgccactggtattatctgcaaaaaaaaaattcatgaatgacttatgtgcaaatcaataaatcatgccgaatattaggagaaaaaaagtttaatctgcatcagatccgtacaatccaatcacaagtactgctctttgttgaaattgaaattaaatccctagtaaacattgaaacccaagtttaaagcttcagaagaacacgacgtttaatttcaactaaggccttgtttagtttcaaactttttctttaaactttcaattctttcatcacatcaaaacttttctacacgtataaactttcaacttttccgccacgtcgttccaatttcaaccaaactttcaattttagcgtaaactaaacacaccttaaccacacctgctaatcgactggttccatgtcggaagagacagaattaatgcagaccatgcagcactgttttgtttaattccaggtcgctattttcgaagtcggtgagattacaacactgacgtctctttcagcatcagccctactgccataagtcaaccctatcagtacatactctccactgtagattcgagccagctaccattgaatttctccatacactgtcgttgcttactgtggtatcatcacgcaatttttcagtgcattcgaagcgagcagttaactgaactatcgctgcgtaattatgcagccaagtttgagcgttactgcagtaaaaaaaaaaacaaaaacaaggtttggagggagagttgtcccttgaaacattttttaagaagagattgtaaacctattgagaatcaaacatggaattataaattgaaatcacacacttcttatcaccgtattatcaaggacatcttataaccgcagtcgaagaacaagcctatctcgttctcccctgtaatgcatgctgtgcagatcaagaacaactgaacaagtcgtcaacttttagctaggaaaacgaaacacagattaagtcttattaaatctgattctgatttctcgttctcccctgtaaattaaatctgattctgatttctgaacagtctttgcatcaaatcggtgctggcttcgtcgcagctaccgcgtgtggtgggccagtgactgggccatttactgacgaaacggcccattctccttttggcccaaacgcctcttgacaggttcggaccccccgctcgcgcggcaaccggaaatcatgaacgacttgtgtgcaaatcataccgaaagattagggaaataatttaatttgcatcatggggtagtgtaattctcgttctcctcaaaaaattcgtaatcagaagtactgctcttaatttgtagaaattgagattagtcgctaatcacttgtcagcattgagattaaagcctttttctgaagaacacgatttctccctccacttaataaccacacctgctaatcgattggtttcatgtcgctattgtctaagtcggcgagataacaattctcccatctccatcaccgtcatctctagtctctaccacctatatcaacagtatctactctctctctctctctctctctctctctctctctctctggacaccgtaatcggcaccatgttcatgccaaatctagccaaaaatctcttgacagatacgtctgctgcttaattactccgataccatatcatcacgcaatttgtttgtttagtaccttgcaagcgagctttacttaactgaacatgaacatatataaactaaccccagctgaatgataatcaaataatttaatcgctcccaagttgcagttgttaacccatccatcgcacgagattaaacatagtaccgacatcagatgcagatgtttccacaagcatccacatcaaatatcatggtgccggagggtcctacatacgattggcacaaatcgagactgcaaaaatcataaaatttgtctcctgttgagggtcgccttctctgctgctgtcccaatttgcagcccagatccaatcagtttttagttttggtttccgagcaattagctcatgccatggaggtgtgaactctcgatggtgattagactaattgcagttctcaaagaagaaaaaaagattagactaaattaatttaattgctgctgcaatcagactactggcagctgcaccgacagggccatgtacgattaatcgagcggttagctaactgccccatggggggaagaacagggattaatcaatcgataatccgttttcttttttcggtctctgttaatcaatcatcagtctgtgtttgggattgcgaaataaagtattcaggggctcacatggcattcattgttcgatgtgtcatgtctcctctagctcctccaatctctgcaaaaaaaaatatagtatacttcaaacaaagcatccgtttttaaatcagctgaacaatcagtttcagtgctgcaaattaaaattcagaatgagcaacaatctcctactacagaattcagattgctcaagcgagaacgacatgtctgaatcctcgtttggtttatctgtcgcagctaaaatctaaattcttaaagttaattttaaagctgattttcctttcattattgtagtttaaacaacgctttttaaatcactaataacatacatatataaaagttttactcgtaagttatttttaagttggttcgtggctgttactgagattaacacggcctgtcaggctgtcagcatggtaatctaggtatgatagaagtaagttgagttcatcgatctgcagttggatatctgcgtcagttttgttgattggtgtggcgttgttagggccgcacaatgagagatttgaccgggacaaagggcagctaagatagatagggaggcaggcagagagtagacgtcgcacgctttgatcaaatcctggcttagaagcacctcaaaattgagacgtctcgtccgaataaaatggacgagaaccagatgccattttcctgtttcttgtggtcacctccatgcatgcatcaaatctttttgtttctttcatcccaaaaaaagagatctctcttcttcttctttttttataggaaactatattggtttgtagacaatggaagtttttattgatctcgattgtcaaaaatctacaattgtaactataacactgttgttttttttaagaaagcagtaattgatatggctgattaatttgagaattgtgtatgtgttttcattgttcttttagctataccaatgatatgggtatgttagttgcaattggcgtctaaaacaattctagctagctaagtagttcgaagaattaacacacaagcgataaattattgtgtgacgaaagactaagacgaagcatgtttaggtcaacgagtagtagcagcatgcagcatcctaatcgtagggtgacgaatcaagctgctatccgtgcacattcctgtggcgttgatcagtgagaggagcactgtcttgaggcattgaaccacgttttaatttgcaaatccaaattaggcgtgataatctgatggccctgttgatttagattgttgagctgattaatgttgcgggattacaacttaattttaagtatgaattaaatagttttaaaataaacataataaatagcttaaaacaaaccgtctaagttgaccagtaatacagtaaaagaaatgctttttgagaaatatatttttcgaagttagcaatgagcaaataatccctttaatatcccgtgaataagctgaaaagaacaaggccgatcgtctcatctaaaggctggattgattgctaacttgctactaatgattttccaaagcactgtaactgtgctttcatgtgtacttctcccatgggccatggttaggctgactaaacatagtggtaacattcgatttcaatatttatcttgggtcctagttaaatcctcaccaactctttcacatgtacacagtagtccaatgccccactaatgactgtgcacatgacagtttttacagtatcttgtagtagatcaacacaacaccaaacaattttactgacatcatcaaaaggaacagttttactgaaactgagaaagtactactactactaaccgcttactagtaattaacaaagtcttgaagattacactctctctgatagtctgatgagagaattaaatacagctatgaaagattgcaccttttgtcgataaaagcaaatggtgccttggcacgctgtcaagcaaagaaaattcagggagaggaaggcttcagattgaaatgttgctagccggcaagaagcagcatggggcctaataactgaagaaatggtgcattgattgattggagatcgaagaactctgaagcaagcagtgagctgctgcactgcagcagccgcttgagatcttcagagaagttcagagagttcattcaactggtggatcgtcagggtcaaaacccaaaagccgatcgaggcaggcaacaaatgatgacgcattttggatgagctgcagcagcagcagcacagctccagctttacactttactccatccttttggttgccaattgattatactcgtcgcctttgtgagagttgcagtcgtgaacatgctcatcgagatgcaagctcgcacgaacaggatgtagcatgtatagcagcaatggatgtaaaaaaaaaaaggctcatgatgcagaatgaactgcaatggagtgtactacacatgatgacacttttattaagtgtctattatgctttctgatgagctgatgaaatttggtagtatggccatggaactgcattgatggcactggaagaacagtggatggaacttcacatggaagcgaattgaagtagtggtgtttcatttttagttctttctcttttcacatcttattactgctgtcgatgtgtagtgcttccattctaggagcagtagagtttcggcaaaatggcagtaaaattctcatgagtggcagcgtgggattctgaaagagaccggtcattttgttgccggtacaaagtgaaaaatgtactggagtactagtgaaacaacaaaatggcgagtcgagcttgaaatgaacagaagtttctggcaagcaaaacaacaatgaacaaagcagcaacagcagtagtagcagcagtgcacatgaattgcaaacagtattatgtctgaagaaattcagatatctcctttttactactaccactactcccctgcatcatcaggaatttttgcacagctagcctttcgtccctgttgtgttgccaccaaaatgctttgatagatacagtagccccaaagccgtgctccctttaagacaagtttttatgcagcattgttcagggagagagaaagtgatgttgctaaggcctgtttagatccatcttaacaaattttacactatgtcacatcgaacgtttgaacacctgcatgaagattaaatatagactaaaaataactaattacacaaattacgactactttgcgagacgaattttttaagcctaattgctccatgattcgataatgttgtgctgcagtaaacatgtactaatgatggattaattaggcttaatatattcatctcgcggtttactgacggatactataattagttcttttatttagtgcccgaacattccccatgaaacactctatataataaccgacgtgacacactgaaactttacaccactggatttaaacactcagctcattaaaaaaaattacattaaaaaaaagagagagaaaaagagagaggaggaagaagaagaggaaggcaagtactgagcgagaaggccactttattgcctttttcatgttgcacgctatcatttcgagatcaagacgctgccctcaacgaataaaatactctcccctcccccacacacc

SEQ ID NO: 58489 - DNA, 29301 bp, Oryza sativa
tgtgtgtgtgtgtgtgtgtgtgagttttttatatatataaagaaaaaaaaagagtgtgtgtgtgagagagatatatatatatatatatatatatatatatatatatatatatatatatatatatatatatatatatatatatcattctataaacattaagttaaaattcaaattttacaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaagattgtccacgatagaaattgcactgtagtttatattaactgaatgaaaataaattttctgctttgtcattatcatcaacgatggaagtgcatgcacggttacctttagcattagcggcccataataatgcaacttctctcttttaagtttttatttttcaagaggacatcctcttatttattgcacgcaacctaaatagtatagttattaaaaatttagaaaaaaaaagttttgatgaagcaaattagtatgaaacatatcactccacaaatataaaagtccaaattcaactttcacaagttgtaataaaaacaacaaatataattgtgaattcacgttaactaatttcaacttaatttgtacttttttcttataacttataaaagtcgaattgatcttgcatgtttgtgtcgtgatatattttatattaatatatcttaattatcattttttttattttttaataattatttacgtgatatgtaagaaaggcaagaatgttccatcaaagatgaaaatccatctccctagctttgacatacctatatatggtcatgatacaaagacacaagctgcaccttcatatttcagggggaaaaaaaagcgcaaatcgcatttttgtacgagaaacaagagcatatgaattggtataacaactcgtgtcaatgttcaaaaaaaaaaaactcgtgtcgacgtgtcgtgtggttgggcccgactacgactcaaaagacccatgcctgagccatggcggccgtgtaacagattataatagcaaatagctcgagttattttcgtggttttctcctgccgagcggtactgctcccggtaaaacgaaacgaagatgcatggcgatcccgtctacaccgaattgaagtctccaagccagtaggaagagagaagatgaatcaacagtcacagcagatgccggggagatgcatcatatcgccctctagcgagtagcgagacgcccaggcggctcgagttccgcaagcatccgcaaacgcggcctccgcaacaacactggcggggtgagccgcctcatgatacgcagctgcttcggcgtgtggtcggtcgtccacggccgctacatccggcggacacactatctccgctacatctggagttgaggacggcttgagcatggagtgcattgtgggcgtcgacatccagagcagggagtggcggcgcgggtagttggagaagaagccgggacgaggccgacagatagtcgggagagaagcgcccgcaatctccgggagcattggcggtgaagtcggggccgcagccaaagtggtttctgcgccgcgggagtgtcagacgcagccgtcgctggcagatgtttggagagagcatcacgcacggcggtcgatcgtgaggccgggagggggttggtacgaagcgcgaacaccatcgcccaccgccgtggcgactgcgttgaccggcgcgtcgtcgtgggatgggggaggagccggcggttgacatggtcagggttctaggagcggaagcggtggatcgaggagtctgataccttgtgagacgataggactcaacgcgataatcgaattgatactgatgaaccttcctgaattaagtcagccgatttatagaaatataaccggagagatgatttagagaaacgggagatcaggtgtggctaaaaggaaacacgatatacatgccaaatatacatgatcgatacgctaacatctatatatacgtattcgtcggtgttggtggtggaggctaggttttgcttgcaccttctcttcctctctacgccggcgcctacatccacccaccacgaatggcaaccaagggaggacgcggcggcaggggaggccagccgggcgagctcggccaaccgggcgagcccgggcaaccgggccggggcggcggcagggcaggacgaggcggcaggggaggacgcggcggcggcggcggcaggagaggacgcggcgggaggggaggaggacagccgggcgagcccggccaaccgggccagttcggcggccccggcggccgcggcggacccgcgctcggccctcacggcgacgacggcggcaccggcggcaccggcggctttctcggcgtcggaggcgacggaggccgcggcggcgacggcggcccaggaggcagcggaggccgcggcggcgacggaggtcaaggcggacctggccaacggggcggggacggcgggcccggcggggcaggcgggcccggcgggcacggcggcgacggtggggacggcgggccgagtggttccccgttgcgtaaacggcggcgtggtgggcggagcagaggctatctgcttagggaggaggaggaggaggaggagcttgatcagatatgaagatactttggatagtacaacaactgtcgatgccgctgtagttgcactccatctatatttgaatttagttagtagaagtactgttcgctctagtgttctatgtggtctaagagttttaaactcgtttatgctatgatttgtttttccatggaagcagcatcttgaaattttagaaattatgttggacgaacacatctgacagacgagttgagggggtggtttaacagctttgttgatcgcctgcgcttgagctactactgctgcacaatgcacatgtggcaatggagaaggtggagttgcacgtgagaggaggcggacggcgcgggtggagcggtacggcgatgctgctgcgcgcgccatctagctacaagctaggcggtctcgccggcggcgcggaagacaaacaggtgcaagcgcggcgcgcatgcagggcggacggatgaagcgtgcgctcatcttcgcattgccggccatggtgacggccgtacgtacgtgcttggccttacccttctcaagaacatgttcgtctcagctcggagtcgtatagcgcgcgtatggcgaaacctgtgcatgtgtgccttttgtacgtacgttgcatgggtctaagtgcctccgtttcatttgtatgtaggagaaacgaactttatactagtattaaccgttcatttttatgtatgagaaatgaactttatactagtattaaccgttcattgattccaaatatagcagcatatagagcatcaccaatacattagcaataatctatctctaaaatttgatttttgggttttctaaactaaaagtaattagcaataatctatctctaaaatttgatttttgggttttctaaactaaaagtaggaagtattccttaaaaactaaaagtgggccctttcactttttccttccgctcacgcacaaaaaatcacggtcacttgctcccaaaaataagttttgatcacccgcttccaaaataagttttcgcgcgggaaggagaggacaagcgcgggcaaggagtgagaaacggcgaacgaggagacactctctctcccttaaatccacatagcaaaatactccctccatcccaaaatgtttgacgcagttgatttttttaaacatgtttgaccattcgtcttattcaaaaaatttaagtaattattaattattttcctatcatttgattcattgttaaatatattttaatgtatatatatagttttacatattttacaaaagttttagaatgagacgaacagtcaaacatgttttaaaaagacaacggcatcaaacatttagggaaggagggagtacatagggatgggaactccaaaactatctcaaatacacgtagccaaatatatggaaatgggaactccaaaactagtgtagagcttttgggatttgttggatccgatttttttcgctaaaaaacctcaaaatcaattttggaaatgaaataggatgactgccggtgatgctcacatccttatcttttatctttacctattataaaagtttaagatgtttttgccaagtattttcgtacgtcgtcctagtataatgggcgcgtagtccgattccctccccgtacgcgaaacggacaacttgtttaccgtatagcttgattccgaggttgatacgatgtgattttgctctaattcttagaaagaacgaagatagaagaagataaggatcaaaactcttcaattaattttggattatctctgtggatgcggactgatttcacagaggtggcggtgttgggaaggtgcagagtcggacggaggtaggggacgacactgtagcactgggacccacgcgatagtgagaggaggacaagggatgctaattagactttgtggttgcttgatgggtcggatgcacgcttgcaggctgaggtggaagggaggagaagtgaggttaacgggctgagccggctacgggctaatgaaagaatgggctgaaaatggccctgggagaaaggagggttttcatttagattttcatttaaataaatgctaaaatgatttttgtattattaaaattagtaatggagctttgaaaataccgaaaaaatttcacatagtataattaatcatggaaaattgaataaaaattaaatctagccatagtttatttgggaaattttattttccacatttaccttgatttttacgagcctttcttttctttaacatcgtatacatgcatagttgcgattttataatttaattaattacataatgtaagggcctattcactttgatgccaaaaaaaaccttaccaaattttggcattaccaaaattttggcatagttgccaaaattttagcaacttgccaacattttggcatgattttttatatagttaccaaaatttagcatcaaactaaatgtagccacttttttggcaactttaccaaaatttggtaaggttgaaaatggcatcaaagtgaacatgccctaaatctttcccaacctttccttaaagttctcatgttttttccgttgcaatgcacgagcatttttttctagttcagagaaaaatacggaattactatacttcggtttgaattcaaactgagcttcgattgcagactagaggtcagaagaataacatcatctatctcatgttttctaaaacgtaaaaactagtggtacctatacatatgtatccataaaaaaagtatgtgcaagcgcacctacaatgtaaggagaaaccatctttgatcggtcgaccaaatttcacaatagtcctggttacaataaaaaccgaaactaaaaattatctttagtcctggttcaaaaggttagagctattttttttatctttagtcctggttgggaacaccaaccgggactaaagatcatttctagtcccggttcaaagaacaacagactatgtcacaccttctctattatctttagtcccggttagtctatttcttgtcctggttggtaacatcaaccgggaaaaaagatcggcatacgcggcggagaggacgagacatgtgcaagatcgaggaggaggaggcgggatcagttaataagttctatctcctccctcaccttatctcttcctcctcttcaccccatctcttcctcttcctcctcgtctcctcattctcttcctcccctctcctcccattcacaggcggcggtggctgcgccctcgcgcggcggcggccgcgcggaggcggaggcggcctcgtgcagcggcgaccgggcggcggcaagcagtggaggccggtgctactgcgtggattttttttcttttttccttaatgtgtgattcgatctgtattgaatgtgtgattcgatctgtgttgttattgtgaatgatttggggatgactattgagtgaatgatttggagatgaactattgtgtgaatgatttgggatgaaactattgcttgtgaatgatttgggatgaactattgctgtgaatgatttgggatgaactatattgctgtgaatgtttgatctaaaatgatttccgcaaataacaaaaaaacaatgaaaaagaaagagagaaaaaaaacctccagccgagaccacattgggactaaagatcgatctttagtccccgagtatttgaaccgggactaaaaatagcgatatttagtctcgaattcttactcccggttggaaaaccaggactataaaggggttaccaaccgggagtaaaaaagatttctccaccagtggtatatatataacacatttgatctactatggtagtggcgtgcaaaagattgtccaagatagaaattgcactgtagtatggtctatattaactgaaggaaaagaaatttcctgctttgtcaattgtcattgtcatcgatgatggaagtgcagcacggttaaagcatagcagcaaatagtaaagcagcttctctcttttgacatgggaaagtgttattatttctggtggcgatatcctcttatagtcttatttattgcatgtcatctaaatttatatatctatatacctaacaaaaaaaatacataaggtttccggttatttgttttcgttagtcatcccacttgcgtgcactaaaatctgttttaatccgcttagccacgtcaggcctttttcaatctactccaaaaccagagtttagatagtattttccatgtctgcctacttggctaaggaaggatgttttcacgttgcccaccacccgtattattacttggaataaatctactttgtcctcatctcttgctgctaattgtatcgcaccctcaaccgtaaaacgggtataacacctccctcatcttcaaaaaccggtacaaatcaagttttttcatggtttggagaatggtttttactgacgtggcaggtgggatccatatgtagggactcctcttccccctctctctttcttcctctctcttctcgttttaatctctctcaatgacgttatgtctgagcacgaagactcaccaccatgagtcggcgtccgtggctcggcggtggtggcaatagcctaccgtagcgtcgaccacgcgtcgtcgtagcaggcggggacgaggtgctccggcacgaggcggttgtcgacagccgcaactcgctcatcatggaaaaccgctcgatcgagcgccgcgccattgcctcagcgtctttgtctccactgtcaagacgacggccaccgtgaaggaagcctcgtgcccaccgctagctgccgcacaagtggagaaggcgtgaccatgaaggagctggtgaggagatctacggtgggcggtatagatggccaaatgggccgcccagtccggcatgacccaggcatggtcgggcctaggccgagttcagttggaccggcacgactcgacctacacggcctggccatgccattccagcccacgggctacatacacggcccaggcacgacccaataagactcaggccatgccagcccgtcccgaagacacgatagcccatcgtgcttctccatacaataagtctatttgtcctccctcaactcttatggcgatctatagtggacggtgaccacgacggcactaacgatgggaggacacttgggccagaatggctgtacgttgcgcgaacattcctgcaacgaccattctgcaggatgcatgccatgacgtacggtaactgatccgttgctccaattaggtacgatgagccccctacctgacatccctgcaactaactggacggtgccacgacaacgtcgtggtcgctagccagctcgaagcacgtcgacttcgccttctgcgacataataattccgtggagcttcgtcaaccgctaccgccgccgcctgctctatgttcgacgtggtctccgccgcgatatggcagtgttgcacccgagctagccatccacggccacggcggaggtgtcaccgccgctcccgcgcccccgttcgtgttcacggccaacgtgcggaaccatgtcggagctaaggacgggtactatggcaaccgcatcacgcggcaggtggtggcctccacggccggcacgcggtggcgagcggcgacatcgtcgacgacctggctaggctcatcaacgacgatgccaaggagcggatgccggggctcctcccgaacaagcagcagcatctgatgttgctggcgcgcgctgtacgtgtcgagctagggaggcatcgtgctgtgtgccgtgcctgccatgctcgagaatggacagtgtgaacgcggtcgcgtggtgcgtcacggatgaacaccacgatggtgttccgctccgaactggacatactccagtgatatggagtactccctccgtccaaaaaaatgttcaacgtttcaccgtctgtcttatttaaaaaaattataaaaaaattaaaaaaataagtcacgcataaagtattaatcatattttatcatctaataacaatgaaaatattaattataaaaaaatttcatataagacggacactcaaacgtttgttttttttaggacgaagggagtactcttgaagatgtactcaataataaatacgggccgaattgtttccggaccaatactaggtcccccatctagccctaacatgtagggcccacgtagatcccacttgtcacatcagttaaaactggactcgagacatcgataatcaccgcttttacaagttgaacataagggacctaaagtgaacttgcatatttctcgggccgaaattatacagcccgattagggcccattaatacagccccaattcagtctctgggaaggccatcccaattcccaaaccctagccgccggcggccgcaccacacatccccgacccaccgccgttgccgcagccgcagctcgatcgcgagcgagaggggctagcggaaaccccagcagcgtgagggctaagcttcgcggcggattggagatgacgcagaagcagagccagttcaaggggcaggggaagaagaagaccatccctcccaaccgccatggcaaggcgccccacgtccgcaaaggtacccccgccgcaaagatctaccggcgcctccgtccgtccttccgtgccgttctctggtgctcttcgatgcttccctgtcgccctgcgtgttttgattggtcgctcgattcttgcagggaagagggccgtgaagccgaccaagttcaccaaggacatggacgccgataaggtagactcggtttactgaatgcttgctctattcatcaatcagcacctgctttctccctttcggacataagatgttatttggggcagcatttggagattgggggtctagccttctctgagctctgaagtaggcaagaaacaaacatgaattaaactagtgatacatgcaaaccaaatatgttctgtttttgagtgatataagatggaaagttgtgtgttcgttaatgtgctccaaaataacatagcaatattcttttactactccaaaagagagttacatgcctattgattacggattctctactagtaccaataagatcaaagttaatgattttgtcggaactaatatccagtgatagttcttttcaacataggttacatatgtagtaatatgtttcttcataagttgaggagccatggaaataataattgagaggtgtatggacatatggttagtatggttagaggggtaaaggtaaaggctaaattgctttgattagcagctgggatttgtcttttagcgcctgatttgtgttgcatttcaatatgggtgcccatattaggctaatacatgtaaatctcatgtggttgacttcaacattgttctggtgaggcccttttagggtaactgggtgctgaggtcatgctccatgattcatggcctatggctgggaactgtacaaaatgcaaaaactgatgttaatattaccgtataaatatatgaatttatgataagtttgactccagaggcaattgcagagagagtccgacagcattgctgattttttggctggctgttgctgaatatgtccgctaatgccattactgtcgttccatttacagtggttgatctgtttgtattggttgtttgggtgcttgccaatcatctaccgtatgttaaacctagggatggatttaaaatctatttttactggttgacagacacagcatcagtattcagtagtcctatagatatgccaagctgtagtttaatccatggtttttctgccagtacttgcaatgataggtctgtttagtatgatattaacagttttctatggctcggtaatatggtaactaaactggcatagctgtagcctgtagtcaacatgttatggccattgataagttacatcatacttgggactacgatacattctttgtagactatagttttctagctcggtatgtttttgtaatattccgaattgtgaggaatgctgcctcagttttctattccactttcttgttataacaagattggtaactcaattgcatgaccgtgtagttgttgttgatgttctacggtttgatctgaaaaaccagttttacattgcttcttgttgtattttgatttacaggataagttgtgtttgtgaactatgtagatgtttgggaaatatttggcaatgttttaccttgacttgcggtgtggtttttgcacgggcaatcgtgtccgaagttatcgaggatcaaattttattagactattttggtgttgcagatttcagtaggtttggcattctctatgatactaataaacgaccacttttggcgccatgtctgtttgtcaaatggtgacattagagtttggaataattgaaagcagactagaccttctgatcttattgttattaactttgtgattacgtttttttcttatttgagatatttaagatatttagtaaccagtgaactcatttgatgttctcttcttcccaggaactcacaaaattcatcaaccagtgcaacgagaagaaggctgcaagtcttgccagcaaagaaggcggcgacctcagtatactcaaggcggacgttgatccctccaattcaaactaggaatctgtggctacctctgcctacggctatgtgctatagaagatgagtgtgtggaatggatattatgttacattgcatacttgcattctagtatttccctgcagaaatgtagtaattctgtatttctctgaagaaggttatgcttactgctaaatgtttacaatcaatcaacggttaatactgtaaagttctcttctcatacatacaaataattaaggcgaaagcaatagacccatgcgacgtacgcgaggcacacgcacgggtttcgccacgcgccgtacaactccgaagatgcaagtagtgaagatgcatcctgtgagcaatggtcaggcttgtagagttgcatataccatttggggcttttgggatgcgtgtgtgcgagagagataatagcatatgtttattgagaagtaagagatggtcgaacatgtgaatggacgtgctccagacccacgatttaagtcaaagggcttaaattctttctgttgtgtgctacagtaagattatgtaatcatatggttagcaaaaaaatgtcaaccatcaccgtaggatcaaacatgcagtataaggatcgtacgggtcattttgctagtacgtactccctccgtttcaaattgtaagactttctagtattgctcatatatttagaagttaatgaatctagatacatatatatgcctagattcattaatatctatataaatatgggcaatgctagaaagtcttacattgtaaaacagagaaagtacgtacaaatgaaatggagaagcggaagcaacaaaccctcgaagtatgcgagccacacgcacaggttccgccacgcgttgtacacttgtacgaatccgacacgagcatgtccctgaggagggtgagcccaagcacaaccgtctccttggacgagcgcgtgcctcaccaacctcttcctccgcaggcgctgatccgtcgttgatgtaccgccgggagcttccagccctagcccggaccgttgcccctcgaacattgcctgcaaagagagccgaaagaaagaattgacacaatccgattttagaaacatgcaaaacgagagattttgcaatgcaaagtgaataaaacaggcaaaataaagaggcaataccagtagcaggcgctgatgaagctggagggagcaatggtgttggtgcacggggcaatagagccataggtggcaccgggagccacacgctggtggaagtgccaccacgaggtcctggagggggaggagatcaccggaagggaggaagaaatcagcggaagggtgtaggatgttggtgaataatgtcacgagaacggctgcggtgaaagccacgccgctagccacaacaaggaactagcatgctggcggaggcgcttcatagttggggtcgagggggagggcgaggtcatcgtcgtcgtcctcctccttgtcctgctcgtggtcatcgtcagcgacggccgggatatgctctgcgccggcgacctcgagttgctcctccgagggatcctctgacgacatagagctatagtaaagtgcattgggacctactgtgctccttgttgacgacggttaaataccaaatttaagccttcgatacctgcataaatttaaaaatataaaacatccaacatagtggtagggtttatttctaacaattttcataagtgttggtgtatatttgaatgaaggtgataaactaccaaagtgaaaagaaatatacataaggaagagagaattacgttcatatccaagactatggagtctcgggcccacaaactcatcgaaataccagaaaataggcccaaccatcataccaatgggctaaggactcctttgccaaggcccaggagaaaggcctaggccagggaggccaaccagggttcggccgaaccccaacccagctagcccagaaacttcacaagctagtagttatcacccaaggcagttgtgactgtttctacctgaagaaaccatcaaatgacacttggcacaaggaggtgaagcaagaaggaatatgctcattggatgcttgagcatctccacatttccaaggcacttcttggcctataaatacctctctcctccttcattcacaacacaccaagcataagctgaattataagaggctctattgtatcttttactccctccatcccaaaatataaggctcaaccactcataacacaaagaccaagaaaatatttaatcatattcttggtttggatcacctcgatgcatgaaagcaaggtgattgagaggtttgatggtataggatttaaaacaaatcaattctattgaaccaagaggtgctagttaatctatgcatgcatgcacatcttatattatgagacatggaagaaaagtggttgtgtcttatattttgggatggagggcgtatgtacattagaatatggagagggtaagggagaaagagttggaggaattagaatagggagagagtaagagataaagagtcggatgaattttggagttttctatattttccttttatcttttgtatcttgtcaactaatctgctttaatagataatatctttatcgagtaattgagatttactttgtaaggattatcttttagttcagctgcgcaggaatatgttccttttacctttttttatcttgtcaattaatctgctttaatagataatatctttatcgagtaattgagatttactttgtaaggattatcttttagttccactgcgcaggaagatgtgccccagcccgaaccgctgcccctcaaattcttcctgccccagcccaaaccgctgcccctaaaattcgagatttattaaggctaatctatttgttccactgcggaggaagacgtaccgccaccgccaccgcgaggaagtccggttgatgtgccgcgcgagcctccagccccagcccgaaccgctgtccctcagatagcttggttactgctgtaatgtgaattgctttctccaggatgtgagattgtcaattgctttgtgtgtgtgtgtatatatatatatatatatatatatatatataatgtcatttttctcttttttttagctaatttcatttaaacaaacagtcagttttgaatgtgtgtattttatctctaagcacttcttggttatccctgaatgtgaattgctttcttcagaatgtgagcgaaaattcttaggatcggtcaatcgggggagggggaaaatcggtcgctccccctccccacgcgcgcacccccgctgggcccaccaatctgtccctccccttattccataaaaaatgtttcacctagtgtatctacaatgtttcactatatatagagatctaatgttacagtggattaaaatattcttttgcaacaaatcaccaacatattttgtaaaccctctatgtcaccaacatattttggaaaccctctatgaaaggaatttatttcattttttgttccaccaaaaatgtttcacctagtgtacttataatgtttcactatgtatggattaaatgttgcagtgaattgaaacattctctcgctatttgctgaaacattgtttttatataaggtgaaacatcgtccgatttaaacgattgaaatattgttgatttacttagtaaaacaatttcgatatacttggtagaatatcgtgcaacatttaaaaataattcaataataagctaaaaaaattcgtcggaatatatccatatgtgtcttgttttaaagatttaattgcaacgaatttaatggtgcaatcgaatcatgatttggataagtaatttaagagaaaaaaaatagtttaaagtggttttacacatatgcgtgacgctgacatcatgctgacgtcagcaccgatttgaccccctcccgggcacccaactgggagtcgcgtccggacttgtgaattgcttgtgagaatgtatacatgtcattttctctttttttagccaatttcatttaaacaaataaacagttttgaatgtggtgtgcattttatctctaagcacttcggtccccccggtacaattggttaattctcagttcttgaaagccatagctataaactagtatcaagaactctcatccattttcgaagattcctcgacgcccttgaaagtaacacgcagcttcctcagagaggatactttcttcccgttgttttctgccattccagttacatgcacagtcgtgcgtgcagctcctttgagtagctcaaacattgggacacccaggtttggtcgcgtcatctgctctaggacttcaggtgcctgcatgtagaggttatcgccttcgtgtgttacgctagccctcgacattagcagcttggggtgctcttcaagcatcttgatgaactgtttatcaggggaagtgttagaaatctacaagatacttaggattatacacgaaatgtaacaggtatgcagaatatgggcaaaaaaaaatgtttgtctttgcttgtccaaaacaggaaaaggaattcaacagtttagaaaagcacgatgtgaatgcaagcatagcatgctgtttaaactttgtaaacaacaactttagatgacaatggtttggagtctccatataagtgattgccatatgatggctgtattaatgcatatgtagacaggtcacaggtgagctagataatgattactataacagctctacctcagaggttcagactgccattaacagctgaagtacgtcacatactagtgtgattatgtggctaagctagcaaagtgagtctagcaaggaaacgtgttcatgacatcagaaattctcaacatagttacaaggtattgagtgtattactgacctctgagagggtagtcgatgtcccaagttcaataagggtaccaggtccacatacaaggcagtctttctctcttgcaaattcgcttacattaatgtgtgttccatcaaggccgttatacctgcagatagtcaaagaaaaataatgcacttcaaacagaaccatgttaagtgtttctaacctggtcaagaaatcaatcgcttcagatgtgcttgttaattatagttaaacaatcttggggataaataaatattccaagtcgaaaccaaaatttaaaataagactcagaaaagtagtgaactcacgtgagataattcgacacagttttgctgcacccagagataagcttaagagcttccaacgcacatgcagcagaaacaattgcatttgttgaagcaatggctgggatgatattcttgacaacaccctgtaattcatgaaaatacacagtggtacatatgtcacatcccatcaaattaacaaccatgactttccaataattacacggcatatcaactaatggtaagatgatcttagtcatccactcaaatcaagaagcagaaatggctggcataaatttcgatgaaaactgacaaaatggaccacaaccaaaattaataccccatttagcacaaggaccaaatattgaacatgcttttatttatttgtagtaagatcgaatcaccatgagagtcaacttgttgtgcagagagaatgctattcacatactgttgagtctaacattttctttaaccaatgttggatcgtttatcatctcagtcaatcttaaagaatttcccaaaaaaaaggttgaagttggtgtgattataggactcatgcattattaccagagtacaagattcgcattaaatcactagcagagaaggcacaagattagagagacacctgggtaaacgaatatgtaactccagaaataccaaaaagttctgctctctttaaagcctgtattacaatgaggaaaaagattagagagaaaccagagataaaataaattccatgtcatgaagtaaagcaaacctctgagtaaatccactgcatatgttctgcatcatcagcatcaaaaggtttcccaggatgaacctacaagagtgactttaattattgggggggggggggggggggggaggagttcaaagagcaattatacagaaactagaacagtacctcattccatttgatcaaatgagcatattcaatgcaatgagctgcagttctcggagtctcagcaagtgtacataagggaaatttgacctggggagggaaaagccatatgttgcattcaaaacaaggtgttgtcccaggtatgatgactctagcatgacctttgaaaccttcagtcccaccatcgaccataggtttaagcgtctcagggattggcttgtcatctgagtcatactctgcaattgcaattacatattagcactatagcactgcactgaatatactgagtttggtacagtacatagtgaataacaatatacctctgtttgggcatcaccattgtctcctagatgcaattcagatcactaatttattttggaaaacccattaatctcttaaagtatactattgtgaaaatattttttgatacaaatctacatgtatgattttcatatgttcaatctaaatacttgagacaatattgatacccaaagttctaaaaactttactacatgcatgtccaaaacgaaatgtatttgagaccgaagggagtagtaagctatggacaattgagaatcagaaatataagcaaacttcatagacaatgatgagtaaaaattatctgcgcactaatttggatttatataaccatgacttttgtctgcacagtatcatatttacaaggttactccaattcgtcacgaatggtttttcatcggttttaatcctgaagctatctgtggcatgtgtgtaggttatcacatcactttataatttaatgtcaaaagttttatactgaaagaggagagatgaagatgttgtagaactcaagacgtatgctagattaaatgtctgtttccaattcccatgcaggagaaaagataaagaaagaacggctaaggaaatatgtacctaagaaaccacacgccacggaattgatatagcttcgagcttcaattgaatctagaccaagaacaattatcgagaattgactgtagaactctatctctttatcttcaatcctacagaaatgtggaacaatgttcactccactaactcgctccataaccctctttgcagcaacttcagccttggacttcccaacatcttgaaccctgtaagagagtacatgtagcacttatcgagatgaataagataataataaaaaacacaaatacaaacatgaaacgtcaaaacagacaaacaaacgtgaatgctgcaccacactgaaacttgaacttggctatgagagaagccaaaacatgggactttttttttttgctttccattcaggtattggctttgaaaactcgaaataggctttctgtagttatctaccattaccgtcccttttattaggaaatatgcgtgcgggttgtcaccatcgcttaacttaactttatctaaggcttattctactccgtgaactcagagctggtaagcaactgaattaacaaagggaaaaccacctcaattgcattcaactgaacaaataggcataacactcttaatcctattcgcccattctccgtggatattatgcactcccagtgaatgtaaatgaatcttttcagtcgacgctcataggtgcccggctcttggcatttgaacacggcatcgaaacctgacaatctatccctatgtttttccctcacggcgcaacaatctgatggcatcgcacaacagtgggggggagggggggcacaattaggtgggcgtgtggaaggaaggagagtaaaaaaaacctgaagaggaactggcggttgaggttggagacgtcgatggtgtccatgtcgatgacgtggatgttcttgaatccggagagcgccaggtccttgaggagctcgcaccccagcccgcccgcgcccaccaccagcacctccacgaggctccccagcgagtcccgcagctgcgacgcacagggcacaacgatcttcatctcaggacaaacgcaagaaacacacacagacaaagagagagaggtggctgaccccggggctggggttgaagtcggcgtggacgaggttgccggggcgggagaggagcatgtccagatccctccaccgctcgggctccgtcggcgggtcctcgtcgggggaggacatctcgccggccctgcttggacggtgggaggggaagaatcgctggtagaagagaccctagtagaaagagagattgctgatgcggcggaggagaagaggagggggaggagaggaagggagaaaagaaaacccaggggctttggcgtggacggctaggatgcgtggtgcgtccgatcggacggcagcaaccgaggtttccactttccaggctgatcgagttggcatcttatcacgcgtacaagggactcagttgcgcctttggggcaatagagcgcatttttagatttttaacacggagtctgagatactattttgatcaacgatatttataaaagtaaaatgttttaaataaaaaaaattatatattatgatagtttgtttaataataaatctagtaacatcaattttacattattaatcttttttttattttttttacaattaatagtcaaagtatagcatatgatagagttaatttaactttttaaaatttgctattataatttgtttatttggatcaacactattataattcgcgtatgatttgaaacatatcataaacctatgtatttttacttgtattggatataaatatccacatcttccttcaacatcctccttgtatcctttttaagttggagaccaggcaacgccacggcgtctagcggcacgacttgcttgacgcacaccaacctgagaaggattgcacgtcacattgacttagagaccatcctctggtgatagatgaagaagaaagaaaagactcaatctaacaaaatgtgtccggtagggatgaacatgatgatagcttatttgatttcagagccggctctgggctccggcaagaagtgcgatggcctagggcccaggaaaagtagaggcccagaccttggtatgtattagttataccatatggacgtatacaagtttctgattgaatcgctgcccgcataagcgccacttatacgcgaccgtccgagttccaaacttctgttttctcgtctcctctcctctaccggtggcagtctccgccaatccgcctccagcgccctctacggcgcctccgcaagtccgccgcacgccgggccgccgccgatccctgcagcattcagcccttcacagctttgtctgttcgccatcgaccggccgacacaacatgaatatctgcctcaacttccagagtgtctgcgggtttcaatttatatgtactatcgtgctgccgtgctgcaaccatattgtccattgaattgaactactgaagtaactaattagtcattagtaaatactaaagatcagtttcctctgtacgtttaggtttgcaatgttacaagaaagattaaatggcttggctatgtgcatgcattgagaagaatgtcttggacaatattgatatcgataccgtattaatgattttgcatcaagaaatacccgaacgagtattttttttaagagatgcaaatggatgtatgtcatcttttcttttgtcaagtattattaatgaagtccctggagcttgatccttagtcaagaatccttagtcaataatttaaggtaaccatagtaattctattttactgctctttttgtatttttagcaacatatatagaggatattatcaatatttattttcagcatgattagcggatgaatgctttaaaagtatactttaaaaatccaaagtgcatatgtgtatatatagagagagcgtatgcctaagggcccatgtcatggagttgatctagggccctaaaaaatgtagagccggccctgtttgatttatgcaagcttcgaatgggggggagacgccacgcgtatgctcagcgattctgacttaggaccatctaggcattaaaataactccataacaatgtcaaaagacgccatcattgttattgccatcggctgctatggtggttgttgcatgatgttgagttgttcgcggatgggaatctatccttgctctgaccccatccgatggtgatggaaacggagtagaaagaaagcaggttgccttcatcacttccttccctctaggatcgattagatgtagcaaagcatgtacgatggacaactaatgaaaaatattcattttcactccgtcttgcatgtcttggtcttgtggcgtttattgttgccgtctgagcgaacatatcatttctctcaacgatgtgttcttctcccgtttctgactgcttatccttaatattacattgtgtacaaagcaaaaaaaatataataagaaaatagatcatgcgtagagcaaaaggagttgatcaaatacaataaccagagtatacatcacctttcgtgtggattaactcccaattaagatggtttgtctattgtattcttccatggaagaatgcagtatcagtagtaggtctgaaagcttattgggataaattagctaaagagagggtgtagtgtgtatggcgacgtccttttatagaaaatgagggtgcacacaacatagcattaggtgacaagtgccccaatagagctcatcaacggaattgctgctacgcctcaccgaggcaatgctcggtaagtcccaagctccctagagcccatccatttcgtcgtgctaaagtcaacctaaatagagccccacctctaccggtgctccacctcgctagcccccaacctccattggcacttcccttagctgcgccgctccaaagtgttagcccatcgtgccgagctatccttccacatacagtgctggagaatatgaacaggaaaaatcgagaaatagaagggaaagaagaaagaaaataaatgcaattatatataaaaaaagcaaacaaaatggctaagcaataacatatatctcataaccgtgaaattataacggatgtgttcaaatttattttaagatcggaaaaaaattagtggcatatggatcggattatttttttttcttacagaactgacatgtgacgattgaccaacactggcacagggacggtccagatgaacccacgtcctagccgtcaacggcgtaggcctcttcgttccgcctccgcttatccgctctcggaggccgcatccactcacccagcttcgctcgctcgctcactctgccccccggactgcctcagccatggaggcggccgccgccttctcccctccccgcgtctcccccgacgcccgcgccatgttagctaccctccccgcttggcctatcccccaacttccgcctcgccgcccgcccccgcgctctttccgcttccgcccccaccaccgcggcggtggcggccaccaagcagcggttcttggcgccgccccgcccggaccccgcggcgccagaaggctgcggcggcggcggcgccagggacgtcgtcgcgatggtacgggctttgcctttcacctgctacacactacctggctgcgtggactgaaatggcgtctcatttggttgggatgcttgttgcgttgcaggtggtgccgttcctgagggggaccgcgtggcagcagccgccgccggacctggcctcgttcctgtacaagaacaggatcgtctacctcgggatgtgcctcgtgccgtcggtgacggagctcatgctcgccgagttcctctacctccagtacgacgacgccgagaagcccatctacctctacatcaactccaccggcacaaccaaggtttgctgcatttgattcaattttggttatacgatttccactaggcttggttgattagtgaacgggcacgcgcgtctcaatctagggtagcttgtggatcatgaaggtctctgccccccacaattttcaatgatctgttcagattcttttactttgccaaatgattcagataatgtgcagtttatacatctttgaagtgattagcaagtgaggcaggaactcaaaagtttttattgggctagaaaatgcaattccggtttatgcctatcaccttttccagtagcacatcatcttaacagtctacaatgttttcttcaatcagaattattgttgttctgttttcagcataaaattttctgatatatttctctcccttcttacttagaatggcgagaaattgggctatgagacagaagcttttgcaatatatgatgctatgaggtgatttcctacacatgcaccactttctctcaaagctattgatcttcctgcttcctctccaaatgattttcctcttgtttcttgatgctgttctctaatgtcaactttcatactagtagttccttatgagcagctcttttactgtataggaagttcgaatcaaattggtctataaccttagccagatggagaaattcagtggactgcactatatggtggaaagcacgatccaagatataaagacacacaggatatacctcacatggaactcaaagacacataaatatgtctcatatgattctccctcataaaattctagttctatccgtgttatcagaagggtggatctatgtctagtgtaacagtgtgcactgtaccagaggctatatttttggtggcctgagtcagacaactctttagggaaacaaccaaatacagctgtgtattgctcaggctcactgcaggccaggccaatctccaccagtgtagcaaccaaacacaccctatgtgacccagaatagaggaatcagctccctgctgctcagcgcaagaccgcagtaatctctccccaacatgagccacagccaccagcccaccagttagctatttccatctgaccgccatcttttgtatttaccatttgaaatactggtgatcaaatactacaatacttgaccaactactataataccttattcccaatttgtgttgacatatagtgattatatcctactaccagcttcaaatactgtaaatttatacaagcagtagactcaaggtttcatttaccaggaattttttttcgtgctacacataatttagttgcagaatagaataaaatctgtttagcttatggtctccaactctccattagttctttccattcaccttttaacttctactagttgtacttgggttactagtctttggaagattgtagtggttatagccgttgccaatacatgctgttattgtcatccaaaaattcattcttcaatgtctgtacttgttgttttacgaaatatgctcatgcaacctagcgattgtagtaaaatttctggaattctgtctcatgttttcactaaatacaggtatgtcaaagttccaattttcaccttgtgtgttggcaatgcatggggagaagctgctttactcttggctgctggtgctaaaggtaaccgtgctgcgcttccatcgtcgacgataatgataaagcaggtcattttcttttccatcaattaatagagagcagtttagtttctaccttggacaagtctatgtctatcacacaccactaataagacactgtagcagaatgtgtcacattcttgctcttcgattgtggtgcacacttggatatacttattttgtgaacatgcaattctgtacagtatcagtagtctttgcttccaagaaatacgaggataatgatcttattcttctgacctttaatgtgcagccaattggtcgctttcaaggacaggcgacagatgttgacatagcaagaaaagaaatccgaaatgtgaaaatagaaatggtattttttccaaggatagcctatcctattttttcctatccattctggaagaaagaactgataatttcagcttaatttcaaactaaatcaatatttaacatgttcatgtcttatcagtcataacaatttcgctagttcataactggtgcttttcaatcgaacattgccgcaagacaagaacgttagagttcttaacttacctgaattatcaggtaaacaaaattatacattgaatagctaaatgcatgtgctgtgctacacctaggcataaaagaaaatatgtcataataattcctaaaataaataaaatatgtttttgcatgaaatatgttatccgcttgtttgttactacctctgtcccaaaaatataagggattttgctcatgtaactcacgggccaaatcccttatattttggtaggataagggaatgctgaccttgatcatatatatgccaagtacttgcaacctatttattttggttctgtaattctaaaaaagtatcaggacggtaatttatgagaactgcagcgggaagaagtgaggtggcagtttcgctgtcaccaccaccaatgcagtcttttaagaggaagtatagattatctgttatccatattaacaatactacctaggcacatttataatcttaccagaagtgagcaatagaaaatttggcctcctgtcttagggagtgaatggcaactgaacaatagtttctgtcttcatataatcactgccaggatcccgatgtcctgaaaattaggtggatacagtgatttgaaagtgaagctctttgttatattttggggcagcatttgcgtgccttggaaatgataaaagacaatatacttattttagttatttgcagcaacccaccttaagaatggctacacacaatttatctgaagccaagatcttatagggatacaaacttcttgttggaacttggaactgatgttggtgaaaatttagttgcattgcattagatttgatacgaactaggtttcccttgcgttattttcagccatgctacattcatattttgcactagctacccatgaactgaaggggcaggcagtctatttcagtaggctgtttacaattcaacctataatgtactgtatgaattcacttttatgtcagattaagctgctgtcaaggcatatcggtaaatcagtagaagagattgctcaggacatcaaacggcccaaatatttcagtccaagtgaagctgtggattatgggatcattgacaaggtaaaatttctagaatgatcgcaaaaaaaaaaaaaaaaacctgaaatgccgagcctaatttgacggtgttcttccacacacaggtgctgtacaatgagaaaagccaagaagacggtggtgtcgtatcggagctcaaaagatcaaatttgatatagtattacgctagatacaatctccctgtaagttggtaataggtcagacacacgacatgctttgtagtgccatggagtagctgccattcattagctggcctggttgtagaacatcgagctggattggcaatgcaaatatgcagtacacgctgatacttttttttttttttgatatgggctttttccaatctggtgcctgataacttgtacggtggcttggtgcgaaacttctattttttgtttagttttctgaatggcgattcaaatggttgctctggttgtttgcaatggtattgcttgaattgtgagcgccagtgactgtaagagctgattttggcctgttgagtgccaatattttgtatctggtctaaaaaatcgcgcaacactgacttcatctatcagggtttagaaattttgtgccgcactagtggatatgttttcggtaggaattttactagattcatgaatttaattctatttcagttgtgtttgtgcgtgtctgtactttatgtttattttcttttgagaaagtgcgtgtctttacgtaattagggaaatgttgtgctcgtctgaaataggtgtgagtgtatgttggtgtacgcgcatctgctttactaatgtttttttttaaaaaaaatgcaaatatgcagtgtaaatcataaatatagtgaaaacctgaaaaactaacatttgataaaaaaaaaggacatctaatatttgttcatttcactgagagaaacttttactaagtaataaaattttgctcaggataagttcatttttttaatctaatagtagtttttatagtatttttaggttttcagtatacatatatggttcggaaagaatataatcggagaaaaaggaaattgatgacggaaaaaaagcggggaaaacaggagatgccaggttcccttggaacggaaaatgttggaaaccatttgatctaccactggctcgcagaattagaccatcttttgcgattcgcacggcagcggccaagtttatattaacccctcccttggttgggccttcccttctcttccttcgctagaagccgcgctctgctcttccctccccctcccccgagaggccgagagacccgcctgcctgcctccccctcgccggcggcgcgcccgccccgtcgccctcgcccgccgcgccggcatccactgtgagtcgctttgttgatctcagccttgagcccttgacccttctttaccgtgggaacaaccgacttacaagctgcggggcgccccccctagttaagcgaggtttcggccttcgcgcgattttggccggcggcgcggggtataggggacccggacccgatgcgatgcgatgaggtgctgcggccctcggggattacgtgctgctagttagtagtagcttccttccaattccatcgaggcttttgggggcagtgagcattctgttggccagttcgttttgctcaccgtctgatgcttcaaatcaagttttgagtaatcgacttgtttgggtagtatcctggaattttatttttggttttagggaacatgtaaattctactgctcatgtggtactcttttgaggttgctatcataaccccaatctttagaggttgctgtcataacccccagctgactgcattcttatcagatgttcagtttgttgaaaatgacgtaattttgaaaggatgtttatttattttgatttttgagttagaaggctggaattttatatctttgctaaaattgctcgtataaggactcgatgagtaagtgcatactggtttatttagctgatgtaaattgtacagcttacaacattttaatttgtaggttccctctctttgagaggacttgcaaggagctgaatggagccgaaactagcattcccccaggatagtccaccacttgccatcctctgtgctgctaaggtcgcaggtgtttccctcaccctcgatccgaagctcgcctcgggttcagcacccacacttcaccttggttctgggtaagtggatactgatcagtctgtagcttctctctgagacgaaccactacttttttttccctttcttttaaggcttatactatgataatttgctccatcatcatgcctgcatcttgaatcgtgcttggaatggcaagttcggtgcataatattctattccatagtagggtttgacaaagcaaccttcagcattatttttttctttatgtcattctagtcttcatggaacatcaaaacaatatttttggtggccaaattattgctcctcttttccattagtatttatccttctcagtatttcccctttagagtttaaaaattctcactgaacatctgaacctttcatgattctgtgcagggattttatccacggtgttaacacaattcttcgttacattgctcgtgttgcatctgttaccagtttctatggtcaggatgctattcaggcagcatatgtatgttctggttgactatttgctatcgctggtgctactcagtgaatttattgattgtctgagtattcatagttcctgttattatgcatgtttaggttgatcaatggctcgactacgccccagtcattctttcaggatctgaatttgaagctgcttgctcatttctagatggatacctagcatcacgaacctttttggttagttatggcttgtcaattgctgacattgtagtatggtcaaatcttgcaggtaattgtctggtttcttttataatctatattttatcattctatatgtttatattacttactttggagtggcacccctttatttagggacaggccaacgatgggaaagtctaaggaggtccaagaaatatcaaaaccttgttcgctggttcaacagcatagcagactattcagacacactagatgaagttgtctctgcttatgttggaaaaagggggataggaaagtctcctgcaccaagcctgaaagagaaattacctgattcaa

SEQ ID NO: 58490 - DNA, 5557 bp, Oryza sativa
tacaaccgcctttatgcaaatagccacaaaccatccttgtatccccttgcacatctgcatcgttggtgtggcttgctgagtacggtggttgtactcagtcttgcttttattccctcttttcagaagtgtagtgcttctaagctgaagatggagttagaggaccaaggctcagaccccagttgagttttgcctgtggagtggagctgaagccccgctagaatcgcccttttccgctgctgtcgttctgtttcggtgtgaggactaagtgcctcttccgtaagtattttacgctttatttacgtttggaactatatattacttgtcgttttgtgtaccctggctggtcctggacagggatttaatacgcaaaatagtctggaaatttgggttaaatttctgggcgtgacaaagtggtatcagagccaactcgactgtaggttgagccaaatggtcaaaccctaagaacaagttttctaaaaaccctatttgtaaattgtctcctctcgcccttcggcatttctttgtcaaacggtttttcaaaattctcctcccagtctctccaattcttttagttgtcacacctagaggaccagccgtcaacttcatgtctgttcggaagtcaagtcaagtcaagcctcaagcttcatgcaaggagcgagaagatcagttcaaagtcatcgttccgcgaagatcaagtgaagttttctcggagatgacctaaacccaatccttcccaggagggtagtttcgttagcttctagatcgtgtgttgtttgcttgtgtgtaggggtatggtttgcatcactggtggggatgcgaccatactaggctgtttgcttaaacaacttgaatcataaaatccattcacaagagatcaataggcaagtggtttagtacctcatctctagtaacccctcccatttccccctctctctggtgcctgcagcagatggtctgcatgagggacaatttcatcggatcaagaccccgttagtttcatggggcaactcagtgcaattctaatagtattccacgtcagcctcttgaagatcagcctcaaccccaagtcatggctaatcaaactcagacagtggaagagttgttacaacagatgcgacgtcggtaccaaatataccagatgcaacaaatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagatccccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagtagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgataacgacaacgatgatgataatgatgacaatgatgatgcgacccttgacagtttcagggaaagagagttgaagttcaaagcatgtgctagatgtgggatagtcggacacactgctagtttatgcctccccacatgccgctgtggtgaatatacccattacttagatgcatgccctttaaggaaggtcacatgtttcttgtgtgaaggaacagatcatgtgcctaagaactgtcagttgaacgcggtcatagctaagaccaagaaagaacaagggacaatcgtgcaacccattcgtcaaccaatgacaatcgacaacagcggtcacaatccttctgctcttcctccaactccagctccagtggaagccaaccatggaagaagcaacgtcaccaaggatgttcataagtctctgcttgttccagtttcagttgccaaagtgcataatcagaagcctgcaccccgggaccaagcaggtcgattctgtcgcaactgtcgtaagccaggacatcgtttcagtgattgtcctcttccaagagcagcaatggcagttcgtcgtgattcacaagttaccagcactgcccatgacaccaatcgacacctgaatgtgcaacctccgccccaacggattatcgtcaagggcaccgtcaaaggtcgcattgttccaccggcaatcgtttcaagcctacagcaccaacgccagcagggtaagcaatgccaggagaacaacagctcgctacagctacaaagaggcagtacgctccttcgtcagcacccgcggcaagtgttgtcagcaccaggtcgcccaactgttgtcagttctagcaatgcacctcgtattgctccaatctggaggcccatcgacaaatcaccgctcggtaaccccacgggcaagaagatcctacccgttacagctgacaagacagttgcccctccaccatcgaagatcaacaagcagagcaacgttcccggtgagacttctggtagtaggaactaaagaaacaagtcagtcaggtttgaataatggaagcaatagcagttctagacaagacttctacttttcaagttcagtcgtgaaaagggcagttctaatcagcaacagtctacaattgtttgattttgtagtacttctcattatacatatatgtttatggcagccatgtaatgaaaaggaaatattgaataaaatatgagtcagccagttcctctccttttatgattcatcttcagcatgcaaaagcaaatcaaaatgggtatctgtcagtgtctcaagaaaccaagggtttctctcctaactcatcgcaattctattgagctccaaaacctgtttgcgagccaatagaggaatggttaaccaacggagtgaaaatggttagaccctcaacactcgacatgatgagatctctctaaaggcaacatcagtggtactcaaatgaaaacagggatggaatatttgaaagtgacatcatatagagactcttgggaaatctctaaccttggaagctgttacaggatggtaatcggcaattacgccttagtgttgtgaccatgaatttagaaggtgtttgcttagttcaaggcaaccaatataagttccaggaatcatctcaatgtttctcagaagttgaaaaaaaaaagaaattgttccatacatgagtctggaagatacgagagtttggtccagaaatagaaatgtgtagtcaacaaggtatatggcatagaatctcttttcaacaaatcatctttaccgaagatatggatgcgaagtggttatgatcaaagagcagaaactctcggcagcatcaaagtcagtttccgatagttgttcagattgcagtattttccggaaagctgttgcaggatctatagtccgtcaacccaggaagagttagcaaaggatggtcgaagaagtgaaatgtcatgccatggaaaggacctcttgagttggatctgttgggtgatcagtgcttgtttcaaggaatgttaactatgcaatctgtttaggcatatgacaccaaaaatcaagtcagaagcaagaaagttgtaccagcagttagaactggttggggaagtagtcaagagttagtaagatcaggagctaaatgagaatttctttatgaggaatctcccatcagcaactgaggattaagttccaaatcttgctgggatgaaagtgcgtcgtcattgctctattttgatgaatcggtgaagtttcagttttcaaagtgagggcctttgtaagtaagagaagtgttggttatttttcaaggacaatagtccaattgttcctagtcaggagaaagtaagactactccctgtaaggggggtaggtctcggagatgagttttggctcacttcgtcgctgttttagtgaaggttcaacccagtgcagcaatccgggtagcacttgaagaagcctgttgcaaggtatcagaagagctaagccgatctcagggcatccgatgaggccagttcaacagcttagcttagagaagcaacagtgaggacagttgcagttcagacgaaagacaggtcaagcaggtttcctggaattacgtgtcactcgagtcagaacccgttcaagcggacgtaggatcaatgagttacaaaggtcagatgcaagtttcaggaacaacttcatcctcttcgagtcagcatggtgaattgtcaggttaccaaaattaccaacctcaacaattcagtccaagataagtaagttccttaagcatccacagccctgtctgggtcagttgaagtagaaccagtcggtccagtcttgcaaagcaaaggaacagaaaagttgaatcaatcagttcagtcgtgcaagtttggacaatcagtcaatcagtcagttcgagacagaaagggggcagtgcagtatgccgatccgtcagatcagtcaaaccgcccgccagctccagctttctttctagccatcccagaatctcgggacgagattcctgtaaggggggtagatttgtaacgccccgattttcgttcgggattaaaaaaatcatttaataatgcattttctagaaattaaataaaagttaaaccaatttaatcaagtggaattatggaggaaattaaaatttcctttaaaaatcattggccgggaatattctgtaatattctttgtgccctaatgtactctctagaattttccgtgaattttcggagctcaagaaataattttaaaagcacaaagttcattttaaccaattgaaaaaaagaaaacaaataaaatcccctcccctcccttttgggcttggcccaagccttcccctcctctcccgtgggccgcgcgcttcctccctctctcggccggcccgcgccttgcgaaagtctgctttacgtcccccgatttccctcctctctctccatccggccgacaggtgggaccgtggaccccacctgtcagctcctcctcctacctctcgccggccaaccccaaccgccattgccggccacgtcccgccaaatccggcgccctcccgctcgcgccttcgcgcccaaaccaagtaaaatcgattcctcaccacctcctccaccaaatccctcacttttccccaatttttggcgccaaatcgagcccccacttcgcccacgatgtcgcccacgtcgccggccgttgccgcctcaaatctgccacgtccggccacgatttctcctccccaatcctataaaaacgatccccggagcattgtctctcgtttcccctcctcacccgagcccgccgcgctctctctcgccctccccacgccgctcgccgtcgacttccagccacgcgccgccgcgttgcgccgccaccaccgtcagcctcgttgtcccgagctccatc

SEQ ID NO: 58491 - DNA, 44539 bp, Oryza sativa
atttgggaatgaaattttgggagagtggcatttgggcactggcatttggcaaatagtaaattctcccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaaccatggcccaccacgtcgctcccctcctcctcctcctcacgctcgccgccgtcgccgccgccgcgtcggaggaggcggcggcggcggatacggaggcggctgcggccgtggaggccggcctgctggtgcggcgcgaggcgcagctcgcgcggctcgaggagctcaccgagtcgctcgccaagtccgtccaggcgctggagtccgcgctcgccagatccgtggagcccgatccgccgccgccggcagccgccgcggcggcgcccggcgaccggagggcgccgcagggggtggccgtgacgaagcggaggccctactggtccgagcggttccacttcgccgcggccgcgcggctcggggacggggcctacgccgccgcggcgaccgcgctgccctacgaggacgcggatgggctcaccaagtacttcgccgtcggcgactcccgcggccgcgtcttcgtgttctccgccgccggggacgcgctgctcgagctggagcccggggtgtccggcgagccgccggtcaccgccctgctcgcgtacctctcgccgcgccgcacggattgtttcctcttcgccggccacgccgacggctccatcgccgcccaccgcctcatcgagtcgtccccgcacggcgatgactggctcaccctcgccgccgcgtcgtcccgcctcctcgtccgcggcctcgacgccgcccccgtgctccacctcgaggcccaccacgccggccgcgcgcgctacgtgctgtcctgcgactccggcggccgcatccgcgtcttcaccgagaacggcacgctctacggcaccgccatcgcctcgtcgacgcctctcgcctttgtgaagcagcgactcctcttcctcaccgaggccggcgccgcgtcgctcgacctccgatcaatgtctgtccgcgagacaccatgcgagggcctcgctgaagctctcaatggctccctcccaaaggcctactccttcgatccttccgagcgcttcaaggcctatggtttcactgatgccggcgatctcgtgcacgtcctgctgctcggtgacattgccagcctgaaatgcagggtccgggcaatcaagaaggctgagatcgacaaccccgtggcgatacagacgatcaaaggctacctcttggtagccagccaagataagatccttgtgtacaacacatcaactcagtactatgggagggttggggctccccgcctgctattcgccacatcaatcaaggatatcaagtctgtgtttgcgggttctggtggcgtgatgcctgcttcaccagctgggaagccgcttgttgccgcggacagggagaagctcgtgatcttgggactcggagatggttacattgctatatacaggtccaacttcccggtgtacaaaccggagagcaatgctgtggtgtggagtggtccagcgctgctcttcctcctgttcttgattggcatttggcaagtctatgtaaagaagaaggattcgttgggctggactccggaggagacatttaacacctcagtcacagctcctacagggagcattttgaatcattcgaccagtgaccgtgccttcgctgatagctcaacaagaactggtgagcgaggctatgttgatggcacaacaagagccagtgatagaagctatgtggatgccaccacaagagcgacagaccgagcctatgctgaggctaccaggggtgtggacctacggggtggggcgttgagaggtgctccaagaaggtatgtgtcccctactagatatacaggggccgcaggaattccatatcgacctgtttcaacagagcctgtgcttcgaaccacaccggagctgaagtatcgaggcccaggtatggagccccctggttttcccaagaaaagagacacattgttctcaagcaaccagacagtagtagatgatcatgttgattgactgtttaattagcggtgtagacaacacgctaaattttgaaggggttttgaaaatcctgcaccaatgtgggcagcgatccacatgtgtgttgttgtaagatgtaactcaaaaatgttgtatttgcatgagtacattacagccattgatatgatgctgcagatggtgaaataactttgaaatttatgggttacattatagctatgaaagaagggattgttgagctgttttcgtatgacttccatcttcaacgatgtaggaaaattggacaagtttacaataatttttaacaatgataggctggtaggatgtactatggaattgctttaattatacagtggcgtgttgagcatcagaaaaattcagcaagttgcatttgcaataattttagccatagacactacaatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttagaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgctcggtctgcagactgcaactacaggattcaccggttcagccattttctgcaggacagcaaaaggccttgcattcctttgttcactgaagtactgtttagcaaaagaccagcgctgtcagcagccggatcaacatctgtcacaaccggaatatgacaaccctagagtttcagaagttgaaagcgggtggagcattcaactctttttaggtaggtaggttcagactttcagtagcaaatcgtttcgtaggcgagcaggatcagctgcctgggccttgcatcctggaagtaacttcatgcttctaattgtagagcaatgctcctgtcgttatgctaaaacaagttcagattcgttttggttaacattaacttccacttcctcccttgtagtgggtattattccgttctatttcagtgggcagtaattcattgctaggcccttgcattatcaaacaagatttcaccaaaaaaatgtagacctgatatatcatcgaaaataaaccggatagcagcagaactgaaactctgggatgacaacataatttgagcacaaatgacccactatcattgcctctaaaatgcagaaaccggaggcagtgaaacagcacaaatttgaacttgagcaacaacttactgaaacaaaaagatatgaatataggaaaacaatgtaattctttactgcccagtggaaatttttcaccgaggaacagaattcatcaaatgtgagtataatgtaagctccaatgtttgctcacaggtgaagtgaaaaatgcaaaacgtatcctgactgtgcatcttattacaatctcaaggcctagaaaacaaacttcatattcatggtaaaatcacgacactgaaccagtttctctcgtctaagtggacttaacgatgaagttttggcggctgatggggttcatgatgactggtggtccagcggtgcgaggccagacctggaacttggtgtcagtggcttgccaccactccttgtcagagacagtctttggaatggaacctgcgtccaatgaatgaagcaaattaaggtccaatcttccgggaggttaagcacatgcctgtaagattaaactcacctccaaatgccttcttgtcagaaacaaatgtgtcacacaggtaagcaatggcaaaagaaggatccaaccaaggacccagcaatgtatccggccgtcatttttgctgcacaatcatgaaatggcatacagattatcaagtctgatagaaaatgaatgttacagattattcatatgaagagaagcatgagtgaacatcacagtctagaaaaacaagtcccctgctaactgtagttgttctcaaactataaataagcagctttcttgttcattggtataaacacaacagacagacaaaaggaaataagctccagcgtacatatagtcaagcgcaattgtgtagaaatgcagatagtcaaatatgattccaagatatacaacttaatctccagctagtttaacaagttagattagtgcaagatcaaatggcggtcctcttgaaacaagtgatatgataaataatactggacttattgtggaagagtaaatgtgcagtacgactcaaaccacagcctacatataccttaacagaatcagttatagataatagagtagacacatcatttattctactgataatactccactatctcacagccaaaatgcaggagcaaactagacccaagggggcttattgctaactgtcgaagttgtcaaaactataaatcagctgctttcttgttctttggtacgatggaataagttccagtcttccagcacatacatagtcatccacagttagaaaatataactatcacgcctcaagcgcaaatgtgtagaactgtagataaggaatatgcgattccaaaatatacaactgaatctccagctagttcaacagattagattcgtgcaagatcaaacagttgtcctcaaacaagcaatatgtgattcactggacttattgtggtagaataaatgtaattaaaaccacaaccatcatatatactttaataaaaatcagctgaagatatagacaccttgtttatttattctcctgacaaatgccctactctctcacagtctcacatagcaacatctagacccaaggggattattggttgaagcaacgggttaaaatgaaagggttggcttgggtgggagtggatggttcatccaatcgaaaccagtggtagtatcgatggggccattcttcaactataatggtgtcaaagtatatgttcacaacagcaattttctattcgtaatgtgtattaatagtgggattagcaaaaagtcatttgcctccgcccctgctccaattaatcatagtatttggttaagaggatcacagagtagactccgcgatcgatcgatcgatcatccctgaggaatcggtagcttgtaatcgatcaaacacgaccacttcaaatctcgacgattcatgcacaaattcatcagagaagatgaaactgggacccccaaaacgcaggcgagctcgctgcgcaaacacggcaggacccacgaacgaacgagttaggaagcccagcttatacgtagagaagtccgacggagaggcgcagcaccatggaggagatgaacggagagagcagatccgcgagagatctgggagccctaggtctaggggggcgggggtcggcgagcacgtaccttggttcggatcggattccgccgccgccgccgccggagagagaagagaagagaggagaggagacgcgttcctggaaaggaggagacggtggcttcttggcttctctctcgtgcgggttaatgatcgattcctatatgggcctcgtgggctttttttgaaggcccatagcatgtttatgcaaaatggcccctggattaaaaaaattgcaaatatccaaaaggaggaaggggcagaagtcagaactcacaagcaaaattctgtgtataataaacctgcagctagctgcagactgttgattaattgaaccaaactgaacatatatatatgttcacagcaaattaagcagaatgatatatatatatataatatgagatgataaataatacggtgacactgccaatgttgcaagatcgatcgatcgatattacgtacattacatatggctggcacataaaacaaacttgctatacattcgatcagcgtaggactgaaacggcaacatcaacgaactacgtaccgatccatcgatcgatcaacattgcatagtactctctcgtccgtttctaaatatttgacgcctttgatttttttaaatatgtttaactgatcgtcttatttaaaaaaattaaataattattaattattttttatacatttgatttattgttaaatataattttatgtatatatatattattttataaaagtttttaaataagacaaacggttaaatatgtttaaaaaaatcgaacgcgtcgaatatttagaaccagaggaactataaattattcatggtgcagtgcatgtagatgtagctaacctatatatatattccctccgttccaaaatatttgacgccgttgactttttttaaacatatttgaccattcgtcttattaaaaaaaattaagtaattattaatttttttctattatttgatttattgttaaatatactttaatgtatacatatagttttacatatttcacaaatttttttaaataagacgaacggtcaaacatgtttaaaatggttaacggcgttaaatatttaggggatgagggagtatatagctagcctattctagatgatactgattaataagcgcgacaaagccggcgaggtagaagacgatgagcggtatgtcgagaacgacgtagtgggcgaccagcatgtgcttgtagccggacgcggcgcagaccccgccggcggcggcgaccacgacggggaccagctcggagaggacggcggcggtgtacgcgccggcgaagtgcgccaccagggcaaagaaccccgacaggaaccgcgccccgttcgcagccgcccgcgccgccgtcgccgccaccgcctgcgccgtcgccgacagcagcaccagcgccgccccggcgcgcatgaacgtggcgccgccgctgccgccgccgtaggcggcgcagggcccctgcgacgacgacgcgtcggcggtggtgatggcgaggacgaagagggcgaacgccaccgccgcccagcccatcaccgcgtgcgcccacgccatgccgctcaccgacatcgtcatcctcaacactagcgaagctgggcagctagctagctagtgagtatatagtggttagtgaagtggagatcgcgatgcagcatgcatgagaacaaattaagtgcaagggctacatatatagtgcaaagggctaaagcacaagtcaattcacttgttggtggcataggaaatatgatgtgaacgaaacattacaggggcgtagctagctaggtggcacctatttaattatagtatatgttctagttaatataataaaaattgtatagtggaccacctatttaattgacatattacatacaaatggaccacctttactcaaaattatagctacaccactaaaacagattctagctacaccactaaaatataagggtattccaaaatcaagaaaagaccatgtcgcaacttctcaccaaaatacatgacaaaatcaagctatgaagcatgtggggggcaaaaaaaaaaaaacattgccaaaatacatgacaaaatcaagctatagagcatgtgtggggcaaaaaacattgcgagaatatccgcttagattttaatttagtgtgtgtttctttttatgttttcttcctgtttcttttattttcctctctctttcacgtcccttgatagtatttagtcccttggtaatattgtaaatactttctattctcttaatataacttcagtttagcgtggctacgatttcaaaaaaacatatatataatgctgaggtgagcttgcattggcatgcatgctcgatgatcagaaagatgagatatggatcagcagcaactaataacttaccacagctgatcataatctctgcaaagttaattaaacacatgatcgatcgattcatcggtcttcgagattggtatagtaggaaagattacttgatgaggctggccggctggcttttgagatgagcagagctagcacacatgtgaagtcgatcgtacttttttccccatttgcattgcattgcctgctacgaatcctaatcccgtttctcttaattacgtacgcgtccaatctctcttattaatttggctctgctcgatcgatctgctcttcgtcttttgcttaatttgttaatttgctcttgaggccatcgcacacatcatgagtgactacttgcttctatctttgtatacatctttcttctttgtctatctaggaggagtaggatttcctcatcacctcccacaccattaattgattgccaagaacgtatggctactttcttcgccggtaagcttaatgtccttgtcataatcatgcatatttcggcttgtttgcacctaatttcctcttctccattgattactactcttacttaggcctcgtttagttcgcgaaaattttttttgagtgtcacatcggatgtttgatcggatatcggaagaggttttctgacacgaatgaaaaaactaatttcaaaattcacctggaaaccgtgagacgaatcttttgagtctaattaatccgccattagcacatgtgggttaccgtagtactttatggctaattatggactaattaggctcaaaagattcgtctcgcgatttcccctctaactgtgcaattaatttttatttttatctatatttaatgctccattcatatgtccaaagattcgacgtgacgtttttttaaaaaaaattgagtaactaaaccggacctttttttttagataatggaaatgtgttacatctccggcctctgcccgtaggcacacagccaaaaaattcagacgtgaacagaaaagttaaaaaagacaagatgggacaaacccccaacttctgccgatgatatgatctactaaaataatattttttttcaaaatcacgtagattctatcacaaaattctgtaggtactacgccatccaaaatggaataaaagttccttggctactaattccaagcgtgtagcaccattgcgcatagtatcctgttgttcctgtgaaatcatcatacaccaagagtggagccaattggaacacatgaagataacctgcatgatgttagatatttttttatggttaaaaactatatcattacggcaacgccaaattgaccaacataaagcactagctccaaacaaaccggaccttaattagtctatttccatcgtcacaatatatgcatgtacaggatatatcatgtactccctccatctaaaaaaaagttaaccaaagaggggtcatacctcctctaggttgcctttttctgggacggaaggagcatgtaacttgggctccatgtgattcaattcctcgggcttggttcttgtttgatttcgatcgattaattaatttagtttcttggttattgcctctgctctgctccgttgcaacacagcttgtggtgttactacagtacattctgatagctccatccatcgacttgaaatttccagaggaaactcgcttgctaggtatcaccaacaagcacaacgatgtgattggatcctatacagataaataatttagagtaaatcacgtggccaatatctagatttgttcgtgtgtgtcatttagatcctgaactcttaaaatttatttttagttttttaaacttattaaagtgtgtcattctggtttcaaataggcacaactcctccaagatcaattggcgtggcatgtcacacggatattttagtcgtaaaatttatttttccttctcctttcttttcctcttcttttcttttttgccatacttacatgaaggaataagaaaagagagaggagatgaaaaagaaaaataaaaagagtcaatatttacgtggcatgccacataagtgtcacgtagaatcttagaaggatcatggcaacctcggaccggaatgacacattttatcatgttcgtagatctgaaaatgtattttaagagttcggaaatcgaaataatatatacggatgagtttacgaaccaacgaaccaaacactttgcgcaataatttaagaaaaaccatttagattttaccaatggagtggttacatgcatggctgatgggaaagaagggagcaacagatgaacagtacgtagaagttgggagtgtaccgggcaggacgtccaatctttttatttcaactacccacacaagatggtgcggaatttcatattgatataacagaaaaaaaaatcacaacactacaatcctataactaggaagaagaagaaaaaaagatcaccccaccacaagctagaggctccaacacataccttgagaagcactagcaccgaattggctgccgatgtgcgcgactgatcgccgctacccctacacggggaaaccaatttttcggttcaaaacattttcaatatctggtaaacattttaatgtactcgtcactgtaaaaaaacacttagaatttaggcttatttagattatctcaattacatatgattattgtagaaaaaaacacaatgaacgttattacttattggaaccaagatcatgcgaatgggcactggaaaatgaaacatatataaaaccttgtggtcgttgtctgatggagtatttttcttgtacttttttgaggaagccgatgcttcaacaacgctgagcccaagaaagtgtaaagtgtagaacaaatgtatggactgcatttcggaattcaccagtagaatcaagaatggattaattttgcaggatgatattgaccgcaatcaatctcaggagcattttctggcctaaataaaccatatcaagttcgttccatatttggagctagtgtttataattagctagcatatcattatggtttcttgatcagaactccacttagagcaacttcaacagactctttatttagctctccaaggtaaaatttagttaacacagagaaaaaacgagctccaatagcctctctatccggatggcttccggatggccaaattgctcctccggctagctaaatgtagccaacctcctccactggctaaaggtgggtcccaccaccactcccatccccatccaacatctctccctgccggcgacgaactgagggcatatgccggccatgagcgccccccgccaatgtcgtcgtctaggccaccgtccgccgtggcagtcgtcgtcgtcgccgtcgcgcctcacgcacgagccgtcgcagccatcgccgctgctgcgcagggagccaccgccgcctccgcctcgcgcgctggagccgtcgccactgccgctggatcgatgggtcgatgctgccacgcgggagaaaagaaatgggaagagaaagagaaagagaaagaggaggaagaggaagggaatggagatgggaggatgacatgtgggtttctttgtgattttggagatgtaaatagagagactgttggagcatacatctagtttgactacccaaatcagttggagagttggctaaatagatatttgaagagtctaatttaaagatgctgttggagatgctcttaattcagaaggaaaaaacaggtgaactaccagaaaagctttgccagcaaagtcatgacgtatacaactataagccatcttcagcgtactctaacagaactccatttatgccaattgaagaaatcgttgcaagttaaccgcagtttgagctaactattatgttataatcttttgagttgcggttgataagctgtggaaaataaacgaagcaaccaaaagtaatataacagataaatagcaattgaaaatttatatccatgttattagtgattgaaaagctagtcgatcgctagaaaataaactgacaaaaaaaactcaacataaaataaagttttaaaatctaaaatttggtcgcgattgatcagctaacgagagcagaagatggaaaatttgttgtccgaagaaaaaagaacaaacacagacggaaattaggcctgtttagatcccacccaaaaactttaaaccttgtcacattaaatatagagtatcaaatatagacaaaataaactaattacatagattacgtgtaaattgtgagatgaattttttaaacctaattagtccataatttgacaatgttgtgctacagtaaacatttgctaaagtttggggtgtaaagttttggcgtgtcacatcgagtatgccagcacatatttgaagtattaaacgtagactaataacaaaacaaattatagattccacctctaaactgtgagacgaatttattaagtctaattaattcgtcattagcaaatatttacaatagtaccgcattccgcgataacaacgcgaaaccgagcggtctggcggaatgaaacagcggtctcgctcaagcaatagcaatactagtgtcatgccgatttaattagcaattaattatcttgattagtgattaattaattcctaatccagatacttaatcactaattattattatttaattgttaattaagtaattaattactaatcaaacggagcccattggacagtgtcgttgattgcttgggcgaggtcgctcttccatccattatgcgagactgcgtggtctcgcgctttcaccgcactcgataccgctcgcgatgtcattttcgcgtaacggttttgcgagaccgacaatatgttttttgcaaaaaattttacgtctcgaatattcccgagaaaaaattgaatgaaatgtatattttcaaatttaattatgctttggtatgtcgaggacgacgtagtgagcgatcgacgagcatggacgcggcgaagacgaccccgccggcggccggcggcgaccacggcggggaccagctcggagaggccggcgacggtgtacactccggcgcagtgcgccaccgccgacagcaccagcagcgccgccgaggcgcgcatgtacgtcaggagcattttctagcgcctaactgtcactgcacattgaagaaaaaaatggcatgaaaaagtttgttcgatacttggaactagtgttaattacagtaccattttaatatggctcgtagataattcagaacgaaaaagtaggtaatttaattatcagtaaagctttgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggagatggagaggaaggtggtggtggtgtgcgcggtggtcggcttcctcggcgtcctctcggcggcgctcggcttcgcggcggagggcacacgcgtcaaggtgcgcagctacgtctctcgccgccgccgccgaggttcccggcggcggtttcttgaactgccttgttactactactactttctggatgaactcgctcgcgttacttttatagatctcggtgtgtctgctaagttgagcttttgtttggatctcgctgtttcccatcggggatttctgacctggtgggagtagatgcgtgtagcttatccgtggttgttcgctaggaaaatgcgctgtggcagaagtgaatctttgagcctttttatgcttttggttgattttcgctagagctagtgctgcgatcatgttaggtgtagagtggatgtttagttcaatctgattcgactagtgcgtgtaaaattatatggttgaatcagaatctgtccaagttatttccttttctggcaatgttcatcttgtttgtcaggatatagcactattagtctactatatatggtgaagctttacttattagaaatctttaaactcgttattctactgttcttttactcttgacaatgcggctagaacagcttaatcattgtgaaactcattacaaaccctagtgcctgtaagcacattgcagatattttcctctttgaggcttgaggatagactaattttgcactgaaatgcatgtaaaatcatgccgcgatgtaggaatataaggtggtacatgtttatagctttacataatgcaaatgcaaacctcaaaagtgtcaaggatcttatgctacgcagaaagttcttctgactgcaagtgaaactttactatagaataacttaaaaaacaaacagactggacatattaactgtggggctgtttggcagcgcttgctgcagctgcgctgcacggacggttagaagaaatatgagttcggttcctttagtagctggctgtggtgcagccgcagccagggcttctgaacaggccctgtagtattaactgtttcactatgtatgatcttagattttacatatagattcttgcaataacagtcataccatcgctaaagcaatatataattatcatgtcccttactctttttagagtgctagattgtaataattggctgtagctcttctgagcaaaggccgggatgttctattccattatctaaaaaaaataattatcatgtcccagttataatgcacattgcttaactcatgcaggtttcagatgtgcaaacttcttctccaggtcaatgcatatacccaagaagcccagccttagccctagggttaatatctgcggttgctcttatggtcgcccagtctattataaatacagtggctggttgcatctgttgtaagaggcatccagttccctcagacactaactggagcgtagctctgatctcattcatcgtgtcttggtaaaactctacccttgatgtttattgtgttattttacctttttcctctatcttgacgggtttcaacttatcttaccgatctaagagaattctgaatattattatgttatgttgaacctaacttagccttgacagtttgttaaacagtttttatggaaacaagggatcttggttgccaaatgcgttggagttcttgactctgtcattttggcactacaaaggttccttgcagttgatgccttatttcagtagtctttattaaaacatgtgtgtttttctgtgagatagcgtactagcattaggctgctgtttgttttattctttgcaaggaattcatatgagtggttcacatgatggctaaatagaataacttttgcatagatttcaagtgcaattagtaatgtgaagtgcaattctacctttttcttggaacatctttggggggttagctgtgctttattctaaggtagggttcagatcagaatgttgtggcttattttgcggaagtcctgattcctgaatgctatattttagcaaaatactctgctatttgttatttgccataacgtcgtcctggatattgttacattctgcagggccactttcataatcgcgttccttctcctactgaccggagctgcacttaacgatcaacggggtgaggagaacatgtactttggcagcttctgctacgttgtcaagccaggggtcttttctggaggggcagtgctctcacttgccagcgtggcactggcaatagtttactacgttgccctatcatcggcgaaaagtccaccaaattggggtccccagcagaaccaaggcatcgccatgggccaacctgtgatccctccacagagcagcgaaccggtgtttgtccacgaggacacctacaatcggcagcaattcccataaatcatgatctgtgcaagctgtttcgagggccattctgatacattatgtttggtttgtataggcctccaggttagaacagtagcagtaacaattgttgttaggtagagtcatgttttttgctttcttcttccccctctttcttgagcgctactgtcgcacgttctgcttcatcacagcggatattcgattttacatgaaccgggcaatgttgaagaaagcttgagtttcttgctatttgcaaattctgaaggttttacatgataattggatcatggatgtggaattacaatctgtcttacacctgtgggaacttgatgagcagtcattcagcacacagtggatgctagctgctccctgaaccgagcaatggtgtcgtggacgatggcgttggggcgcaccgtggcatcgaccacggtgatcccctccgcctcatcgatctgcagcaggtcgagctggctctggagcaagctcgccggcatgaagtgctccccttccattgatctcctcctgatcctgtcagcaatcacctctgctgatgcctccaggcacacaaacttcaccctgcagctggagtagctccctgaacctgacctgaagctgcagtctccttccctgaggatctccctgtacttctgctgcaatgccgagcagctgacggcgacgtcctcgccatgatccagccgctccctgacagcgtcgcggagggcctccagccacgggatgcggtcgccgtcggtgagagggatgcccttgctcatcttggctgttgtcagggacagggaagagcagagaagttcagaaacgaaaaagggaaatgtaggttggttggttgtgagatgatgaattcttcagagaagtatattgatcttgatcatgccagacctttgtttgcctgagaatggtagtcgtctgcttcgatgaagctgcagcctaaggtttcagcaagcagtgctgctactgtcctgcgaattcacaatgaaatgctaaattcataagaaaatgtgataaattttgctgaggacaaaaaaaaaagaagtaaattcaagatttaaagctgaacagtactattacaaaatctgaatgtaggtttgaaagtcacatcctaaaaccaactcttcagcaaatgcagaggttttctccgaggaaaagacacagcaacatccatttgacatcacaatgttgaattgttgacaaaatgcatatcagtgtactgataatgtctctttctgcttgcttctacttaatgtgcctaaaattgaccaacttgaccataatattaagcatgaactgagctgaggacttgaggttggtctaaaacaacacaatcagtttgaatacttgacagggtaatcagaaagaaagaagtaataatcttacgatttaccgcagccactgactcccatgatcacgattgccaaacctgcaaccccagatgttgaacaaagatgaattagcagacacccaagctctgctgattacgattagtacttgtaatgataatcccattccaagcaattccttgaattaagctttaacacttcaaaaagaaaacatcaattcagaaatcaacacagcacctattctgtcagaccaaaatcacaggtatggtcgcaatacatgtttgggatccatcacttcagttcgcaagaacaagaacatggtgaacatgcacatgaataacaggaaatctgaaccaattcggtgcagcgaaattgcgagaagaaactaaacagatcaaaagagttaaaaacgaaacaagcacgcactgatcctggtcactgacctggtcggtgcgtgagatcggaggcagccatagatgagcttggtggttcgtctcgatctgttcctacgacaaggagtacgacaagagcgtactaaacctgcgaataaacgaggaagaagacgacagcggcggcggcaacaactctacttggcttgattgctcttcctttattttatatctcgagattgaagaacaaaatctatcattttttgggagaaatttatttagtctagtctagaaattttgacttgcatgaacactgcaatttggcatttttgacgtagtgagtactatggccatcctcataaaaataaggagaatttttcccgaatccaaacatagaaagacaagattgttttaggattggacggcgaagaaagagacttgaagcgaattgtcgtctgatgactaaaactaccaaagatgagacgtagacgaaagcgtcttcagttcaaagcaagaccacctgacgtttcacctttcagttcaccgtcactttagactgggacctggtgtttccaaagactcttttacagttcattcatgtccatgctgtcgcattgttgttgctgctgactcagagcttatcacacatccttatccaagaggaacatttgtagtatcaacagaaatcatctttcaaaggatattgttgttatacaggatcctcccaagaaaatgacaactttctatagagaaaaacaagttaggacgagagttggtgatgatggaaataccaacttctctcaagtcttggttgattggattcaagttgatgctttcatgttcctctagctcagcaaagaccttggtggtttctactgaacttgtttctggtctctgaatctttcagcattgcttctggtttctgaagcaaggaagaaaaaagctgttgctaccggtgagaacaaagatgttaagatgaactcaaaagatgggggcaaaaacagaatccgagatatacataatcacatacagtaccaaattcatctgatctagtaatgtagtcacgtaagaacatgcaaacagctaggtaactatggctactttctgaaaaaccctgaatcctgaagtgttttgcaatattctaagatgacaggagatttcttcaccatgtcccagatcttcgctgagctcctcaaccagtcacgctcggtgagattcttcgagaatgacctcgatggccttgataagatctgcacccacagtaatatccacaactaagtgaattgtgtccagagtaaacgtagtactctgaaaagaatcgtttattctgcctttacatcagaatcaggacaagagtcatcattgtgttcagggtcagttctgcaccatattatttttatttttccatataccatgatatgcatctatcgattaataaggatatgcagaactattccttttcgttacttgggaaaaaaagaatgcgaagtgctaattctgttaaaatatgaaagagctcaacctgctgagcgccaacaaccagttaggtaaagctgcaagcatacctgatcacgaagcatccctaacatggatggacatgtccgatactcaaaatttgttgagttatcaggtgttcttaatggaagaagatatatgtcctgctgattggagctcagatcctcaatcttcatgcttgaaggaactgaggagtcagaaacttgaggtgttgctccagagcttccaatgctaaaggaggaggacttgaagtgtttttcaagaaccctcttcagaaccatgagctttgaaggagaaaagtcttgttcccgcaatctgttcagttagaaaaccacaccattctaagattatcaaattaattggtataaaagattggattgtagaattaagtgcaaaagtgttgtgttcatatcacaacaactaacttcactgccaaaataccggaaacaacaaaaggatctctttgttcatcaaaaaagaaatgagcatatgataacataagaaaatgcaaacaagcatgaaactgagcagtgttcacctagcatgcacaaaacagagatcagctatgtaatcttcaatgcctgattggttatcatttttgttttccttgtcttgggtagttgaggaggtcaataatgatggatcaggtatgttgtgcttcagtaaatcaacctgcaaaaattgtattaaatcaccctttcaactttctgccattggcagaaactaaattcatcaacacagcataaccacaaattttcataagtacaatatactaatacggagtttcaggtctgagctctctaatacgctggaggatataaatgtgttcttaactattcactgtaagaaaatgtgatcaagtggtatggatgataaaaacaaaggcataaacaaatatagacagacaacttaccgtaagaatgaggtcccacatggacaggtcattaatcccctccgatacaaccaacaaaatattgcaaacagatgccaagaaaacaccaagctacagcaattccttgcagaacaacataaaacactgatcaactattcggtactgtcaagctcagttagcagtgggtacaacccagtgcgagaattgaagtatagcatttacctggattcccattaactcatgagccaggtctgctgataatggatcaccactgaggataggaattgcggatgaaccatctggcttcatcatatcaattagtacggagggactgaatactggctgcaagacaaaaggtgattgttttttagaacgttaccagcaatatgtttaacagctctggcatttggaacattgcatagcagaaactgagttaaataactcttatcacctgagtgtctagaagtataacccgttcattagagatcctgatatcaatgccagcagtacagtgcttagccattgctttgatttcctcagtttgtgtagcaaaaggaggaagcattcctacaggcaatactcaactaaatgagcttcggtttgatctaggtgtccacatggaacaaattgctagccaaattacaactcttcactacgctttttcagcaagccaaaagacacaaaagaggttaggggaaaattgatgtatggaagaaaaacagaagcttaaggacttaatagagtgcatattatcaacagcagagtgcatctacaaaataattctgacaagcgcatgttttgtttgacacatgaaagtaacaacaatgaattgaactgaaactattggaagactgaatgctgaaactattggaagaatggatgattgtaccaggtgagcttccatcatatccataaagctcgttcatgatggttgacttgcccacaccagttggaccaattactccaatcaccatgaaatcattgttctcagtcaaatactgaaaaatataggccccaaaagaaacatgaagatctcgatcaatcaccggtttgacatttcaagaactctagaagttatgttatacaaaaatactttcatcaaaatgtcacaaaatatctgaatgttttgagggatatatctacagatacttttaaataatcttgtcatcattcaaatccagtttcatgcacaaactgtaacttttgacgtgctagacaaaggtcgcattggcatatatcatattactgcaagatttaagctttatcatcagggatagtattagaatgcatctcaagagaacctaggaaaccatgaactaaactgtataagagctacgagcctacaactaacaactgcattgaacaatggattattgcattaaccagacacaaaaaaaaaaattgtcaactgaatctagttataggatctcacacaattttatcacaatgcttgcatcgaaccagtaagtaaaccctgaacagcaaaaggaaatgaaagaaacaagaagcatatcctcgtagcaaagccacttgaggacgcacgcaccgggaggatcttgtcggtgtggacctcccacgcgtcggagacgaggctgagcgagccaggctgcgtggcctgccgcgagcggcccgcgcctcctccgccgccgccgtcgtcgtcggcgccggaggacgaggggggcggaagcgggggcttggcgagaaggatcttgggagggggaggcggaggcgggtgcgaggaggaggaggacgagccccggtctccgacgccggcgagcggcggcgctccggcggccatcgcgcgcggcgtgctgctgctgctgtgggcgtctctagttgaggaggaagccgtcgcttaattaatcggaataagttcacttgaggtcccttaacttgtcagcgaaatccggttttgtgtgggcccaactgtcagacgcggtgctaggaggcccggcccaggtaagcgtactctttgggccatcctactgggccggatttttttttctatactcttctgtttataccgtggtagaccaagaaataaacagagaaatttttactacggtcatgaatatcccgtccgttcctccggagcattttatgttttgcaagtacttaaaattaatttttattcttttttaaagttattttattagttaaattttgaattttgattacgtggattctcctcctcagcagcccattggctgaaaacgcttgatttccatgtatgagaatcggtctcataggaatgtttattttgggtataaaatttgaatacttaaaaatgcttagtatttaacatttcgataaagattcactcggtctttcaaattttggtcataataatttctaaaatgctcttgtagcacagtaataacactgttaacagtagtagtgcaggttcagccatgttgctccacgtaggagtatgttggtgtagtagggtgctgggaccgagacagctcatcgttcccctacctctctgctgcattctggaaccctctctctctcttcctgtgacccacaacactccaaccagacaggcagaaagcaagcaaaaggataggaaggagccaagaacaccaagaacttgttggagctgagacagcagcaccaagcaagaaaccggatccaatccatccatccatccataggtaatgatcgtcccttattaccttccctacttctttgaaatcttactgtcttcaattgctcttttgcccgtgaagttgtagcagttcgcagtttgtctgtttcttgggaagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaatggctggcaagtacatcgccgctggtcttgttggttcctttgccatctcatatgtttgtgatcattttatcgctgagaagaagatatttggaggtatggaatctgatcccaagtacccgtttgtaaattgacagcacgcttaacatacaccgttggcaaatctgtctgtataaagaatatgtgcaaaacaatcatcttacttcttgatcaggcaccacaccacataccgtgtccgacaaggaatggtggcaagcaactgacaagaagtttcaagcctggcctcgcactgctgggccaccggttgtcatgaaccccatcagtcgccagaacttcatcgtcaaggatctcgagtcctaaggtagcactaatcgcgcaatatgcgccgttgcacccctcaatcaaaacaagagcccatttgaagccacgtttcatctttcatttgaggtgctgatgctaaagctcctttgcttgttcagattgtagtgggagcatatatgctgaaggttgcgccgtgactaagatggcgatggctgtggctacaaactacctacctatgccgtactcccgaaccagtacgtgagtacttggtctcaataaaacagaactattttgcctagtgcagcctgaacagaacctgaagcatatctgctttagacattgtcatcttggtgattgttcttatgcagtaacaacctctactttgtgcttgtgctattgtgagtgaatggaactatctgtctgtcacactggaatatgtgccttgtctactgatgcaagagattttaggccacttgtgtcaactccagaatccaggtggcctctctaatctcagtgtaggtagcaacagacagcatctcgccgttttcgtgaggcttcttcagtgattctgaagcttatgtgttttcttgcacacaaaagtagatcagctagcagaaacgtgttgctagtttggtcaagatttatgtgcgaaacatttgacactgctgccagtatttgtcagatgaaaacgctgagatctcctctatcttgggagattttgcacgcctgatttaactctgggtcgttttcgttttcgcatcagcatttcatcaaatacccatctgggaattttcccgagctttgagctgctttagaacaaggttcagatgctgatcatcagcagttcaggatgtgatctgaagcacggacagaaattaagaaacgaagtcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaatggccgctcgagcactgtctgctgctgccgccgccgccggtcgccggatggccggacagactggcttccctcttcttgcctcctgcaggtaactggctataactgaaagaatgggagctctgtttcatgtatttctcctgttttttttttttttttgcttcttcattggattgtttctgctatggtttatcagtgtccagtacgtcagtttagtgtaggccgtgaatcgtgatgagctgatggcgacgccagtatcttgccttcgatcttctctttgtactatttttttttcctctttggtttgcaaccctcaatcgatgataaacatgccacctttttatgtggaactctgaatgaacgttcatttgggctgatgaactctgataaactctgatggagaaagaaatgagccaagcaagttcaagttcctttggagatgtttctctcttctgtttttttactgttcattttccagacagatcctgatccttctagctgttatttagttactgctccatctctaaatcatttgggctgtgtttatggtttagctgttgattgagctgtcatgttctttttagatggattgagagtgttgttgtcttgtagagtagatgccatattttgagagaaaaagaatgttcattttctgatgaaagtctgtgtgagcaggagaggagatcaagctcatcagaattactcgattagcgcacaggcccagccggaggaggagcagaaggccatccacgacggcggcggcgccgccggagcgcaggtggaggcggcgctgaaccgcaagaacgtggaggtgcacccggaggaggagacggtggaggacgcgtgggtgcccgaccacgagaccggcgtctttgtccccgccgacgaggccgccgtctccggcaccgaaaaccacgaccactgcggagcggcggcggcggcggccggcggctcgccgtcggtgcttgaccaggcggtgttcgtccgcgaggaggacatggaggacgtcgagaggccggccgtcgacatggccgctgccaatcacaagcccaaatgagcatcaactcagcagtagcagcaataaccaataaagccaaataatgccttctgaaatctcatgtacaactagtactagaaaatttccagtgaaaatcttgcgtcgttggttgtatgaatcttgttatctacagtgatcaatcggataatctgttctttgatgaatcttgttgtggttttatcggatggaatttgctgggattgctttgaattcgtgcacgacgccgtcgatctcgatgaggctgcagccggggaccttgtcgatctcgttcctcctcatctgccccctcaccttcaccgcctcaccgtgccggccattcgacgcgtacgtgttcgacatgagcacgtagtcgccggcgtccgcgtcggccacgcgccgtcgcatcacccgctcggcgcgctcgacgtcgccgtgcgcgcggcatgcggcgagcagcgagctccagatgagcgcgtcggagtgtactggcattgccgcgatgagctcctctgccttgtctagtctcccggcgcggccgagcatgtcgacgacgcagccgtagtgctcgatgcgaggttccggcatggcgttgagttgctggagcccctcctcgacaagtccggcgtgacagcacgccgtgaggacgccgaggagggtcacctcgttcggcgtcacgccggctcgttgcatgccggcgaatagagacagggcgtcctcgccgcggccgtgcattgcgagccccaggatcatggatgtgtaggtgtacacgtctcgccgcgccatgccgtcgaacacctccgtggcctggtcgaccgcgccgcacttggcgtacatgtcaagcagcgcgttgccgacgacgccgtcggcgctgtgccccatcctccccatgtatgcgtgcaaccacctgccggtgtccagcgcgccgagctgcgcgcacgcgccgagggcggcgacgaacgtcgcgtcgtccgggcgcaccgccgcggcctgcatctcctggaacagcgcgagcgcctcctcgagctcaccggcgcgcgcgaacgcggacatcatcgtgttccaggagacgacgttcttcttcacgggcatcctcctgaaccaccggtgcgccgccgccgcgtcgccgcacttggcgtacatgtcaaccagcgcgttccacgcgacgacatccatagcaaccttcctctccgcgacgcgccggtgcgcctcccgacccagcgcgaggtccccgatctgcgcgcacgccgagaacgccgcggcggcggcgacggcgtcgatggccacgcagcggtcatccgccatggcgaagaacagcaccacggcctcgtccaagaacccgtgcctcgcgtggccggtcaccatggccgtgcaagagacgacgtcccggccggcggggaacccgtcgacgagcgcccgcgcggaggcgagctcgccgcgagcgaggtagagctcgacgagcccgtcacggacggcgcggcggcggtcgaggccgagcttggccgcgtgggcgtgcacggccggcgcggcctcgccgtgctccgcggccaaggccttgatgagagcccggaggcctcgggcgtcgtgaggggcgccggaatccacggagacggtgccgttcttgtagccgccatgggagcgatgaggcggtggcctcctcggcttgctgctgctcgccggaggaagctgctgctgcggcggcgacggcggcggtaatggataaggcgccatggccggtgcccggtgatgaggtgagaatgagtttgggtgggtcaaaaagtcaaaacataagtactgacaggtggggacggatacaggttgggacttatgtgccgcataagaaactaaggcccataaaccaaccggcccaatacatatgggcctcacgtgagaagaaatccatgagctacgagccgactaacatgggtcggactcaggacttcatcaagattcagatgaacaacatcgcgtttgatttcatcttgattttcagataaacagcgtcatgctgaatttttaccttcatcatccatctgatcctggaaagcctcagggccatcgaaatcatcttcatgtatccaggaatacaaaagcatgtgcctctggacatgcatattttcagcaagctggaagagctgaaagcctgaaaatgctttttccctttggaagaaccaagctgtaaatgcatcgatcacatccaaaaaaacatcgttgcacacatctcatgcataataaacatgttggaaggaaaatcaaattgaacgcacaagtaatactgcatttaacacggaacaggatgcaataccatttttccccttcacaacaaggtaaatattatttcttgtagagagataaaacaaggttcagacattcagagtaacaggcacaacagtttgcctccagaaaactaacccaaataacaaaacaaccattactattatttctaacagacgataattaaaacgaacatggcagttcaccaaaaacataaacatcctgcaagccatcccttgcagcctgttcagaattcagatgccatcatagatatagtagcttgagttgcaaaagcccttctgctctgcagcacttgaggagagaatttcagcagaagataaacccaaacaaagcttccttgtagcagctaatgatcgcaagagagtagcatcctgggcttcacccagttgggcagcaaccctctgcgattgccttgatttggcgccaaggatgacacacagtatgaatcatagccgatccctccccatctctgtgggttcttgcaagacaatggtggccgtggcctgaaagcctccctcttctcatcgaagaagaaggcccattccttcaactcttcctcttccatcttcacccacattgcaggctgggatgacaggtcaaggcagaaggcctcgccgatggaggcggcgagcaggatgagcatgtcatcacacaccaccagcgatggctcgcagaggtcaggctccgacatctcgacgctccagacaacttgtacttcttccaggctgagctggggttccagcttgacggtgtaaagctgctgatactcgagggcatagagctggcctttgaagggcacaaactgctcaagagctttagaattgggcgggcaactgcactgcgaccaatggtcgcttccaactcgccatgcgaacagggagtgcttggcctcgacaaggaaatgcgagttgtgataatcaaggggagctgtgagggcacaagagttgacaaaagtaaagaatgggcagggtggaggtgaaacactagtgccggtgaacacgtcgacgatggcgaaggttgtgtccttcagcgagggggcattgccagagaagatggcatggccataagaacagcattcataatccatccccgccagaaaatctggcggagtcacgcggtgtatgcagatggttggcttggctggatcaaagagctcccatactactggatcatcgccagaggaagcgcagctgcggatggcaagaggacggaagagggtggtgcgtaaggtagattttgcagacctgaaggcagcatgccaattggggcaggtggcaatgaaggcagcaaggtcactgggtgaactcaacagagcaaggacacactgcagtaggtcatctgggaggtctgcccatccttggagcactggcatggagttgggggtgttggagatcctcttgcaggtgttttccatgatagcaggctctgcaagtcaataatgaagtcaatgggagcaatcagaacaaagaagttctggttaaaggacaagcaacatagtccactaattcactacgtcatgtgggcgcatgaaaaaatgagtattagaaatcctagccactaagtgacaaataagaagtggagtacagtggtgctacaatattttgcaatgttatgaatgcagtatgtagttacaagactcgacaattgaattcattcacatttcaaataccattgaagaaaacggatagttaatgctttatttcattctataatatgcatgaatttagtatcgacacattgcatgtgtgtcatgttggtagcaatacatccttgacttttttatatcgtttataacttaaaatattacacacaacatataagtaataaaaacctgtatcgttataaaataactcgtgttttagccatcaacatacatactaagaaagtatggggtacccccttctaccttgcttgatcctcaaccacaataactggtcctttctttgttccaatcataccaaatatcatggtaaaaaaaaaacatatttgataggatgttagtatttactatgagaacctaaaacattgacaatttgtgatacaaaatagcctaatccaaagatcacacttttggtggagacgtattaagtattaactgctgaaaaacataactctataagtatcttcagtatttctaaaaaaaatcttcaataccaagacatcagtggaagttctcttatttgggatttgattaatagaaaattaatgaacaaaaattgcgtacatattattttgttgataatcaaatattgtctcaccaccacccgagtcagtatagattttgaagacttatgatgtactcatagtccttaagaattcccctatcctccaagatttgaacgtacatcttagaggagttagcagactaataaatagaaacaacgagacaacacaaaatgggtggacaaagtacgtggaagaagaagtttaccgatgaatgaagataacaacgatagtgagggcaacaaagaagccccaaaatggttgccgtcgatgttaatgaggacgtatcgagggtctgcaatggttacgactagcgagtagggaagacgaagcggcggcggaactagctaatgattagggtttggggggaacgaggcaaggggattcaatgggttttatatggtatgacatgttaagagataagatgcatatgtccctcctcggaaccagttcacatacacacacacctcctggtaccagtacacacatagacccttttcattattaatttggtagtaaaccctaggctttgctattccggaaatttctttggtaccagttcacacatagacccttttcattattagtttagtagtataccctaggatttgctattccggaaatttccttggtaccagttcacacatagacctttatcattattagtttggcagtgaaccctaggatttgctattctggaaatttccttggaaccagttcacacatagacccttttcattcgaaatttcgttttatctgtgggtaccggtagggagttcttccgatcgaaattttcaattcattcgaaatttcgttttatccgtgggtaccaatagggagttcttccgataaaaattttcaatatgatttgaatttagaaaaaaaaaatagccgtgtcagagtatagaactcctgtaatggggaagctaagtactccccctttgtgagttcggccgaggtgcaagttttgagatcgagtgtttgatcgcacggtaaagataaacacaagcacatatacaggtttaggccgcggtggactatggatgattggaggaattataaggtgacgtaggaggagaaactcaactccttgcttgctgaattctcggtggcatgaattctacttatatacatgaaggagagtccacaataccgttgcatgcatggagtggagcctactcctctaaacttgatatgcttagtcttgtaggtcttgacactcttcttaaaaccttgaagatgtagatattgtagatctcgataatcttcttgaaaccttgaatatgtagatcttgtaggtctcaaactctcaatactcttcttgaaaccttgaagatgtagatcttgtacatctctatactcttcttgaaaccttaagtgcttggtggggctcgcagtgccccaagcccccctacaccttgagctctccagggtaaagggaacccctgctcccacttctccgacaagcagaattcctaaaattttgccaacaccgcccctccccctaggtttatgctttttgaaatagtgaaccctagtacaccttgttaatgcttttttttttgtcacatcaccaacacaattggagatccacctaaagccttgtggtgtgataggagtcaccaaccaccttgaccttgagaatctccttgatatccccaacgagctgctcagcgaccttaaacttgtgctcaaatattcttccattccgctcttttcaaatgagccaacaaaccatcaggaagaaagaatcaaaagcgttcctatagcttggccgaaaaaagcttcgcgcttgctgcgaacactctgctagctgcaaaccgctgtggcccagtgggtcaaaagccgcattaggacaatggtattatttgtcatgcacagcagatcttgcaaataacgtcaggtttagtttagtttcaaggatttctgaaccagcacagttacaacaattggtttctactctgtatccgctaaaaacttatgggcagctgcttccaagcgtaaatgggggaaaaaacttttcgtgtgtcttgcaattcagagattgaatgttcaacatctgaaaatctaagcaaagagtggtcgatttggtcaagttctggtggctacaaaacaaccagatgtgtgtcatcaaacaagaaaggtgcagaagaacatctcaaaatgttaatcatatgttcctaaggacataagaaatctgcttttgataggtgcaacagctttttgttggtccatttggctaaacagaaacggggtaatttttgacaacaagatggtgacttctcctttgcaggttattgctttagtcacccagtggctatgcatctggtctatcctccacaaaccaggtctttaggatactattgtggtggtatcacgtcgtttggatcaagtggcacgggagttttttttaccctggagcatgggtggtgatctagtctacggcttgatagtcactaatttctttgttttgtgttgagggtctagttagatcatgttttgtagctgtgtgcatttcatgcagaggccgggagtgagctcagttagaatgtatcatcttggtgtatttgactgagttttaataaagcttccattatcgaaaaagaagaatatctcgaaattaagatgatcatgcattccacatagaaggcgatggtcgaaaaatcaatggaatagttcagagaaatcaccttttgctcaaccacatatcctgattgcaggtgcattcccttcgtccatgtgagcaattgagcatatatcgacacgacatggccgttttctgtcgaaataatgatctgagagcaatctagtagtgagaaacataaagcacgcaaccgatgaacgcactgatcttcagcaaagtgtatagttgaagagcttttcacaactgattcacaaacatactgaaatcaactcaactggatatattgcagaacagtatatgttgagttgggataatacctcccctcattgaagaagaagaagaaggtgcatttctccagtttgggattccttctacaccttcactcgcgttgcaggttcagctgataaagaacggcggaaggatcccgcgagattcttcgacgaggacccggccacactgccgaggaagaaagatcttgcgccatggctgacgcatccaagaaccagtggtgcctgactgcctggaatggccggtggtcaccatcccatcccataatgcccctgtgctcaacaaacagcgcactcgcggcggagcgcctcggcggctcggcgccctcaggatgccgtagtggacggacggccgcggtggccggcgaggcggcggagctttggctgtggggttgagaagcggcgggtggacaggtgggggccagaggcagggcggttgacctagtgcgagggattcggaaacgaaggtggtacaagcggacggaggtgccccatggcgtccctgaggctgagggtggtggccgtcgccggccaggacgccgtcgccggtgaacgcggaagcccggaatctcggcccggtccaagccaaaaaaatatatgggccgtacgtacgccggagtcacataaatgggccgcacgtaggcggcactagaggtgaaaactgttggaattgttagcatatcttcagaaatgatgctagatcgatcgataattaaccatatttactatttaaattactcagtattgatatttatatgatgaaaaataaattagaaaaaacaaaaattataaataataaaaaacagcacggtcggaaacagtgttaagtcgaacgggaattttcatgaccgttttcaccccgcaccactcttccgtccgcgctgctgtctccatttcccaactccgcgcgctggttgttcacaattgctaactatttatttatgaaagacataccggaaattctcgatagatcgagcgtcatttctgtataagcggtgagacgtcatggtactgtttttcgattccattcatgtataaaatttgaattttctatttatttttaagcatcatatttttatgcacgctaaatattggtaaatgtggttaatttcatatcaaccaagaatctctttttttaaaaaagatgctcaacatgaatcttttttctaccgatctggaccattctgctagccgatgtacaagtaggttgctgatgcgacgacggcatggatgcagcatcacatcacaaagcttgagacgaatcatggtgcaaaatcccactcagcaaattaatggaatagttctcttacattggatgtgaggatcctctcaaattccccacaggcactgatttttctcaattatacttctgaacaagcacaaaaaattggaattgggttgcagctagcgatcatcgattcttgagaaactaatctcaagacgtgaaagaatcaagttgctagaagcggacggaggtgccccacgtctggacgtcgcggagggtggaggccagccagtcgaggccgccgtggaggccgtcgccggtgagcgctgaggctccctgacagtgccacctccggttcttgagctcctcgtacgcccccagccgctggcacacctccgacgagctcatcgcccctttctgcatcatgcatccacatgtcaattgttgtataactaatcgccattggcaaattgttcattgattcgtcaagcttttagcaattaccaggtcctgcttgttggcgaggaggaggatgacgctgttgagcatgagggggtcgcggatgatggcctggaactcctccttggctactcctatcctttccctgtccatcgaatcaaccacgtagatctgcaactccccacacattcagtttcagacattcagatttcagaagcaaagcaatgatcgatcgagagagagattcagaagatgagatttaaccagggcgtcggcgtttctgaagtattgtctccagagaggtcggagcttgtcctggcctcccacgtcccacaccgtgaaggccacgttcttgtactccaccttctccacgttgaaccctgatggaattcgttcatttcacaggatgaaagaatgtatgtctgtcaatgcaggtccaggaatggattatgtcatgcccatttcggcgatgaaataaatgacaatgaacacgatgtatcactaccgattgtgggtatggaggacagaacttcgccaatgtgcagcctgtacagaatcgtcgtcttcccagcagcatccagcccaagcatcagaacctgattaagcatccatcagaagagaaaaaaattctgaacctggttaagcatcagaaaggatgaaaaactgagaatggtgaacgatttcagaatgctgacatgatgttaccttcatctcctttgtgcagaagctgtcgaacagcttcctcagggactgccccatgcctgaatatgatatatgattatgatctatctaccattagttctttcctcttgattaatctctgcttcttcttcttcttcttcttctgattcaggctgccttttattgctttgagaataggaggtagttctcatcgtgcaaatcagcagatgacaccccattactccgattgtttttgcaatgcgcgcgttgccgtttgacttgcacctaccgacgaactgaataataataataatacttgctttgtgttgctgggatgctggtcgatctggagatgatggaaccaccagacagccacaaccgacagtgtttaatctaatttatttattgccggattctacaacattacaacgtaccctgtttcaactagacatagtaaacttttgtttggatctaagcatggtgattgatcatacctcttagtgaaaccttggaataaattacactccatgccggtcgaactattagtatttttaccttcatcctgtacaaaaatgcaattgactcttcgtaatcatctgtttatgaagtataaactacactgtgaataaatgattaacggttaatttaaaattgatatattacataatcaagcaaggtcgttgtagtatagtggtgagtattcccgcctgtcacgcgggtgacccgggttcgatccccggcaacggcgattttactcctttttttaatttgggccatattagattggagcccatatcgatcagcccacgggccgaaccgctatatggcgcccatgttgcccatattagattggggcccatactcctatcggcccacggcccgaagagccttatagcgcccacgacaaagcgttgggtcgtcgcttgctgcttctagacagttctacaacggtcgaggctgctccgtgctctcctccgctctgctttcattctactccccggaaaaatgtcctattcactttggtgcccctgagtccgagatgcttgctgattctccctctttttgtttccacagtttggctttattttgttgcttttgtgttgttatgaaaaggatctactatacttctttttctttccacagtttggctttactttcctgcacattgagtaggattaaaagaagagctagtaatgatgcaatacatgtttatgtacattatcacattgggtttattcaaaagagctaactgctgcagcgctgcagcaatagctatagtggctatattagtcagccagcaatgggctacaaccaacacaaaccatatgcatatgtaaaagtattgtatttaattttattcaaaatgcagcctagcctaaatcgctgccactgaacggttggatgtgcaacacagtctagacaactgctattaagagctaccgaacaatcattaaggccctgttcggctgcacatgcttcaactgtggtacagccaattcgaatagtactatgtgtctgtagctgcagcagcaagggctgcattgtagtgcagccgagcagaacctaagtgattttgtacctatatacttttataacttttgctctatagtttttcatcgagagtataaaaccttaatagtagttccatgtacggtattgaccaagtttaaagatctagtagaagaattcttaatttaaccatactatgaaatgaaaaccaaccactgggtgtacatgttacataattgaagcttcatactacgagattttgtacttctacacctttacggtttaatacgttctatagtttttcgttgaaaaatatttaaactttattagttttgtgtacgtatgacagagttttaagatcttatagaataactcttgttttaaataaaccccaaaccaaacgttgagtgcacatgttacatatatagtcaaaaacaaaaacaataaattgaatacgatttacaagtaaacatagtgtatagaaagttactagctcagctgtgtgttgctgcggctgcaaagcaatgacaactacggtatcaacatgagcaccaccaatgctaggtaatgcagctgttgcgtttgtgtaaaagtagctagcagaacctagccatgtcgtgggagcttttggcaaccgtactgctatagcttctttcaaagtatcaaatttcttgtacggtctaaattatcacctgaactttaataattcatatttttagattttataaaataaactacaagacaaaagataggaaaaacaaactttcgaaattctcatcgtatgcttctcggaatttgagctgctacaaacattccattttttgcctataatcgattatcatttcagacttggaaaggtattataacggcccatcgtctctcctgcttatttaacaaccattatttttaaatcttatatacatatatgtgtttgtgtgttttttagcaactttattaacttttatgtttttttaattcaaatttaaattatggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggaagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaaaggaaaaggggaaagggccccaacccaaaaaaaccttaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaaagctgccaaggagttgtacttcaacaaggatggctcggctatcaagaagcttcaggtgagctccaaagttcttggacacatcttatcaaattttggtcactatgattcttagccttgaccaggcactcattagttatttctacatgtcagactggagtaaacaagcttgctgaccttgttggagttacactgggaccaaagggaaggaatgttgttttggagagcaagtatgggtcccctaggattgtcaatgatggtgttacagttgcaagagaggtatattacagtgtttattgcgtcagaacgcattgatttccctacaattggcttgtttgctgtatgctatactccaccaaaaaaaaaatgtttgtgttgatatgtaaaccagtatgcacatttgctcacaagtttcatgcgcaagtgtatttctgtttactatggctggttgcatttttgcacaccatgttctatcataattacctttgtgggttctaataaatgatcctctgccaagatgaactaaagtttgatagctggtcattgacttaactatagtgattgtgccccatttgttttagtcatgatataaagaatttttcaattttattttcttattgaacaagtcaactggaggtttctggattatctgtgtaacttagttccagaatttgagcagtattttcaagtaacgatctctgtactgcaggttaaactggaggatcctgttgaaaatattggagctaagttggttaggcaagcagcagcaaagaccaatgatttagctggagatggcacaactacttctgttgtgcttgctcaggggctgattgctgagggtgttaaggtatgctattagttgagacatgagacctctattacttgtatggtcaatctgttaagagtcgttaatttgtgaactaagtgaaaataattcatttgctctttttcaggtcgttgcagctggtgccaatcctgtgcaaattacacgtggtatcgagaaaactgcgaaagcactagttgaagagctaaagaaattgtcaaaggaggtaaaataatcgtcaggctctaatgctttcagaatgttttagttgtggttgtggcaacctggtgtttgttgcaacaatgcttagctagactgagtcaaatcagatgatttatctatgtagtatatgcttttttttgttctacttataaaaaacattttcttgctttaggttgaagacagtgagcttgcggatgttgctgcagtcagtgctggcaacaattatgaaatcggtaatatgatagcacaggctatgagcaaggttggcagtaagggtgtggttacccttgaagaagggagaagttctgagaataatctctatgttgtggagggaatgcagtttgaacgtggttatatctccccgtattttgtaactgacagcgagaaaatgtctgcagaatatgagaactgcaaggtagtttcagcatgagcacacatacccctgctgtatgctgctttaatctgtttcagtttcttattgcactatgtttcccctatttttcagct

SEQ ID NO: 58492 - DNA, 11689 bp, Oryza sativa
tcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgcgggatgccctgaaagaacttatcgtacttaccacaagccagcgtgggcaacggctcggcttgtagtgtagctttcctctagtcgacacatctaggcaagggtgggcgtgatggagcggggcgggccctgcgacggcctctgtcgctttcggattcacctaggcacgagcggggactacccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgagcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcagatctgcatcgttggtgtggcttgctgagtacaatggttgtactcagtcttgcttttattccctcttttcagaagtgtagtgcttctaagctgaagatggagttagaggaccaaggctcagaccccagttgagttttgcctgtggagtggagctgaagccccgctagaatcgcccttttccgctgctgtcgttctgtttcggtgtgaggactaaatgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacgatactacaaggagaggatactggctgatggaagacaacttgtatttcaagaagtctatcatgaggaatgtgcaaagcaaattaatggcaagtatcacacaaacttcacaagtcgacaagtttatcacatgtttcacaagttgaaggctcagtggaaggtgattatggaggcaaagaatttgagcgggccgtgcaactttgatgatgttgagaaaaaaatcctatatgatgagactgaagttgttcgaatgactaatgttagtgttctaactattctttccttgcaaataactatcgtgtttacactatatggatgtctatgtttctgacatttttcttgtcatgtgtaggccaaagataaaatggctaaattcattaacgtccccatacgttggtatgatgaaatggagtttattttttaagacaagcatgcaacgggggaatttaatgttctgtaaacaccatatgaccattcaatgactgaagatgatgattttattggtgataaaaatggcagtcctggtgatgttgactcttcatgaaattatgactcagattatcttccagatcaagagaacaatactggaagtagctcatcttctaggcttgtaaaaggtagaaaaactgataaaggtaaaagagtcagagctgatgataatgtggtttatgagataacaggggctatggataatatgtctgaaaccatgcgtttcacacatatgacacatccaaatgaatccctattcaagataattgatgagatgacggaatactctgtcatggttcgacttgagctgcagacttatctcgcgaccatgagaatatagctgccatattgaagggtaggccactggattctattaaggaatatgtggtccaatcgataatacaaaactatccggctgctatgtaatttctttgctaagatgcttgaatattactatgtattcaagctaaatagtttaagaatgacacgtgcagtttagatattatttaaataattgatatgctttggtttgaacttgaaataaaatagttcaaaaacatatttgattgtttcaaggaattcttttagcatatagctttgccctttttactacttctatccgtaatatttttgtggccaagttaactgtggaagaatctgtagtgttcttgtgacaaagccatcagttaacaaaatttgatctgtgtgcaatattattttgctcaatatgaaaagaagcggcgcaaaatactctgaagaaccaaacggctagccactaattcttgccatagaaagcaaaccaaccaaacaaagggtatatgcatggcaagcccctggcaagctggcaacgagttggcttgcccttacccagctaggctaggtgggcaatggaaccaaacaaacccttaagtttctataggtggctaagctagctgccatcaaccgtaggccagcgaaaatacacaattttcacaactgggctttcattcaaccgctattgaaagttgattttcctaggcggctaggtcaagccgacccgctagctgctgcaagtttgttctaggccagtgagcaaatgtcctgacacgttcaagatgtcactccgcctgaggtcagctgtacaaatattaaatatacgtcacctccacacggagtgcagccgatgaatcgatcgtgcacgaacagttgatatcaaaccaaacaatgtcattccatatcatcgtccaacgccaagttgccaagtcgttgttctcatcgatatctgccgcccgcgtgcaaagcccgcagcaaaggcaactcgtacgggtaagccacccccgcgtacttgttcctctcatggtggcgctccaccgtcatcgtctccagctcgacggagaagagccacgtcttctccaccgacggcgtcaggagcacgtacgccgcgtccgccgcgacgatcatggcttcgttctgctcgaagtacctctcctcgtgccccggcaatccccgcgtcgcctccggcaaccgcaccagcttctccagcacccactcaacgccgctacccgccagctgcgtgaacaccttgaggtcgttgcctatcacgcggagaacacgcatggcgccgtcgccgccggcgatgatccggaacgtcgtcatgtggtagttctcccggatgatgtccgggaacgtcaccagcgagaactccgtggtggtctcgtcgaggacgagcatggcgccgtcgtcttcgtcgtcgtcgtcgtcgattccccagtagaagcagccaccggcgcgccccacgaagctcatggcgttgaaccttgctgtgagctggatgtcatccgcgacggcgctcttcggtagccgccacccgccgccatgtctgcctgacgagaacacgcaggcggattgcacgccaatgtgccgattgtttaaccagtagagatcgtagagcgcgcagaggaccctgaagttggacaggctgatgtcaccgccgccgtcatcgccgccgtcgagcaagaagacgccgatgcatcgatatccagtgaagtcggccggacaaaggataccctggtagcgccgcgtcaggggctcgcagacgatgaggtcagtgaagaagaagtcgccttctgctgcatagccgctgcgtgtgtgtgtcctcctcttcttggagaggagcagtaggccgccgcggctgtcggcgagctcccaggagaagtcgtcgctcgccgggagaaaatctagcgagaaccacaggcggccgtcgacgccggcgagcgatgacgaggacgggacgaagacggagctctcgccgccgggcagcgccggcgcgtagtaggcgtcgacggtgtggtagtacccggcgacgcggtggtggtgcgcgccgtggagcgcgcggaaggcgtcgaggaagcccgcggcagtgacgacgcggcgccaccgcttgcacgcgtacgccgcgcggacgaggcaggcggaggaggggccgaggcggaggaggatgtcctcgaggaggtggtcggggacgtcgtccacggacgtcgccgcggcggggacggccttcgccttcctcggcgcgctgccgcagttactagccttgtccgcgcgccggccgccgcggcgcgccatgggaaagaatcgaatcagccggtgtgtgaaattaacggtgatgtgaaattttgattgtgaggttggtgagcgcgcgatttgaagctgccaaccacgatcactgctggctattgacttggtcggcccatctctgagcgtggcgcgcccgccaagtctatagctgcctgcgcgtgggcaccaaatggtcaagttcagatgtacaaatatacacaattttcaatctgaaagtgtctagatttcaggtgtgatctccgatcacttgcctaaatagaaatttgaacaataagttatttaaacataaacatcaattgaacttatagttcataaaaaatataaaattacatgcaaaagtattcaaacataggtaagaaaaagaattagggtcaaaatgtgctaaaactgcatattacaaagctatacaattctagctggctgaaaatttataaatttacagacgcatgaagtcgttaatttaactagcttggtggcccgcgcaattgcgcggctagcagccatacaaaattatctattttttaatataattttacttaaaatttcttaaacagttatctcattgtcttaaaagtttgaaaaatcaaaccttattatctccgtatttctaattttatagtttttaaaagttatatcagttgttgtcccttgcttctttctcaccctttcttgctcgatctatcactatttctatttattttctttggaacctttacaaattggaccttgtaatttgttgagtttattgtcatgttgggtttcgtttttataatttctagaagtcccgtcaaacgcttccattatactcctctacgatctttccgtcgtctcctctctttattataattgaacataattatcgtttcggttcatttttttctttatagaagtcccgccaaaccgtcaacagttttgccattgtattcatctacggctcgcccgttgccttccctcttgtcattgagaagtcctgccaaccgccgtgaccgtgtcgcttaatggcctgccatcgtccatctttttaattgttattgggattatattcaggattttgttaatagtttctatatgtcccatcgatcgccaccattatactcctttgttaaaagcctcctgcatcttccctctttatcgtcatttgtcattattgtattctagatgaaattttcttttgaaagttccatatttttcgttctgatattttttttgtaaattatatttcggctttgccattggactactctacggttcgcctgttgcctccccacttctcattgagatttttgaatcgaacatgattatcattgtggtttatttttttacttttagaagtcctgccaaacgtcgtgaccgtgctgcttaacgacctgccatcgtccctccttttaattgtcattgggattatatttgggattttgttaatagtttttacatgtcccatcaactgccacacttcactcctttaaaagcctgctgcattttctcttttactgatatttgtcatcgttgtattacagatgaactttttttttgaaatttccatattttcattccgatattttttctttataaattatattcctagttgaactcttataattatttttctgtattcagaatttattttatttgttctgaatttcaattaatctcgtattgtgttatatattgattattcttataatattctttattttttattttctaattcagttgtttcgaaattacattcctacttgaactctcttttttttctaatttcagattttttttatttttaattcagaattttaattaatctcgtattgggtttttatatggactcttctttcaatattgtttagttttaattctgaatttcagttattatttaattgtattcttacttagacttttttttctaatttcagattttatttattttagtttcaaattttaattaatctcatattggattcttatatggactcttctttcaatattgtttatttttaattccgaattttagttattttataattttattcctacttaaactcttcttttattttttttaattttattttttattctgaattttaattaatctcgtattgggtacatatatggacttttcttttaatattgcttatttttaattccgatttctttaaaatttgttcctagttggattctttttccatttcttcgattattgtgagaatttctaactcctgcaaacgaacatggtgttttctttcaaagccgattagtctccccctgttgtatgcatgcggacatgtccgactcataatttgattgctccagtcacctcaagcatccacatgcacgaaaaaatgcatgttgtctgatgcctctaattactttgaattttaccgatataatttaagaaagaataggctagcctcaatcgtatctcttctaagatgttttctatttgcactctgcttattatctttccttttttactttgaatttcagtttatttctaaattatattcctacttaaacttttatttttcttatttttttctattaatgtgagtttttttagatctcataacgaacgacgtgtcttcttttaagcgtgtgaaaaatagaggacattgacgataaaaaaaaagaaaacttgaagaggtaaaaatctggcgatatcattgactttaattggatttcattcaccggtcataatgtgcccgctatttattttatcagttgttgtttgaatacgtgaatacgttatcggcagttgtgctgaacttctgttgattgctttaggatgttgggtaatcaccgtaggattttgttttgattctgttgattgcttttttatgctaggtattaatcagtataggattctgttttaaattccacatcaagctgtgtcatatatcctgctagtattctgtttcaaatttactcgtgtcagttgttagctgccgccgccatacatcaatccgatatctaacatgtaatctgccattgcaatctgataatgtctctgtttctattgcgccataggtgaaacggactattattttccaaaaactcatatggactccatctaaatctgaaccattaaaatttagactgatcacgatctaatggataatatttttctcttttctctgattaacgtgggaatttctaaccccaacgtggtgccttcttttaaagctgttttaataatataatagatagatagatttcttttgctgctaatgtagaaatttctaaggtttcatttattcttcaaaattcttgcaaactcgtacttttttacaaatcgggccactgcaacctagcacatatagagaggactataaagcaagtacatatgtacatatgtacatatgtattatacagcaaaagtgctcgtgcgttgcaccgagtgattacgtagtgtgtactatgaaaaaagtgttgtttggtttagacaactaatctgctaaaaaaatgtttgtttttagataaataatctgctctatatttgtggagtatatatgatgtttagtttggatgaattgtagcatgggagaaaatggatggacgaataatgcaattgtctttgcctaaaacgcgacggacggatgaaaatttgtatcataaacgaaattatttactttttatgtaggtaagtctaataaaacacgacacgagcattgagatggacaaagtaactacgaacgcctcgagcaccatgtcaaatcaaagatttgaatccaggttgactggttccaccacaagaaacctatctagttaaactatactcacttcgtaattgtgagaatatacgtgtgtattgttacctgaagaaaatttgtggagtttaacaaatcgtaaaaaataatcttattaattttgtgaaagtgagtattgtttttatttacaaattgtatttgaggttaaatattaataagtagacatgaaaaaatgaaaaaaaaataaaagaagattagacggagggaaaaaaagagcagacaagggaacaaaaataaaaaataaaaataaattgtatttgttaggatttagtttttatatttcttataaaaattaaaaagttgtaaaaaaaagcccattagactaaaaccgaacgaaaattaaaaacccgcccctataaatctctatatttgtcgggtatatggcatatgtgatgttcttttttcaaatacagagtgctcatttgttttaaaaaataaggctcgtcagattggatccttatccccgaaagagcaagcggagagcgagcggcgcgtcgatccttccgtcttctcgttttatcccacttgccttatttgccaaccaaataattatgtgtatgcatataatcaacatgtagtaagtatcaagattgttgtttgggttatgatcaataattaatttagcacatgaaaaaatataatcacttttagaaaatataaagaaaattagaatatgctatttcttttgtatagatgaagtaataaatagacaataaaaataaaagcaaagcagggaggaaaagatgagagaaaatttataaagcaaagcggtcaggagagggggaacaggaaaaaaaaaagaaaataaaagaaaaagaggcggataagcactcgctctctccgtctctcgtttcttcctcgctctctcagtcaccggccagaaaaaaaggacaaagcaagaggaaaagaagaactccgactgtatccctcctcatctgatctgatagcagtagccagccagccactgtccagaatttttttgagaattaatattatttttatggaaaatcacaaaagtagtggtcaaccggggaaaatcgcgaaagtaggtccctgtcaaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggatatccgtcgaactggcgcagttcgacagggtcgcgttctccatttatttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatcattcattcgaagggtatgctactgagtaattatccgaagaagtttatgaaatagtactgatagtactaagttaatcgtaaagtgtttctcaaatagtacggacagaacagaaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctagggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgcgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatatgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaggcctgacgactggaggtctcgcctctagtctttgcagcatggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtcgaggaaaacacctccatcgtgtaacactgcggtaccaacgaaggtaagctccataataactcccatcgtctggaggtgtctgaagtgccaagttatcagctgcatgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattagacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgatgtgtcgtcccgctaacccactgcggctgtaacaagtagtagttttcattagtcatataaggaaggtttgtgaactagtattcataatgataacataaacgaatttaacaaaaaaatacctcacggtgtgtccacaaggatcccatagtgggacgatcgtcgatgtcatcaacaccagacctgtacatctctcg

SEQ ID NO: 58493 - DNA, 5191 bp, Oryza sativa
ccgctgcacgatccactcctcctggtcattagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctattggcagccccaacaaataagacacatcctgcagagtgggcaccatctctccaactgtgaggtggaaagtgtgggtctcaggcctccatctatccacaagagcactcagaagcgccgcgtcaatgtggatccgttcggaccttgcacgtgaaggctcgaccaaccgtgcaaacgtcaacaacccagctgctctcagtctacaacatgacagagcgcaagttattaatatatgaaaatataaacaccttatattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccaggacacatatattatgatattacaagtgtagtgcagttcgaaatttaaattacaattccaatacaaatacatgacgatattaaaagtgcagtgtagttcaaaatgaaaattacaaggccattacaaatagattcgggtaataaaagtgcaagaaagttcaaattaaaattacagacgcactaaacataaattgaacgataacgatcttcaaagtagagagtccaccaaggataatagtgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatactgcgcgactagcgacgacccttagtatcaactaataaatttgagtcaggaacccaattggcttgccctggaggaggacgagtgaaatcgcacacggcacgccaaccacgcaattcatcacgccaagttgcctcccacgattcctttctaaagtagggagaaacaaaaatgtttccatcaacacccccttttgcggaagcagcaagaacatgggaacatggccgatgtaacaggtaaggcttgttgcaaatgcgtttgtaagcgtgatactctggccataacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccgtctgtatcgtacaacaacgaccatttctcccttggctcaaattctaccaactccgtgaagcacttcgtggcccttccacgcttcctgcgccgagtaatacttggtgcttcattaggaatgggttcaagtccctccggctcctcctctctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatcagctatgtaaatctggccatggcacggattgtgtgacatcttcttgaagcttctgtatcgctgatagcaaaccggcgtgtcggtcatacagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgctgttagaattgttcctctgtacttgcctgtcatgaaagtgccatcaacacagagcaaaggaatgcaatttctaaaggcctctatcatggacccaaatgaccagaaagcccgacgaagaacattctccccatattcattcacctcatcgagaatagccatgtgtgtacccgggtttcttgcctgcatcacctccaatagtgggtgaagattgtgataagaatcctcataagttccaaacctcatctccaatgctttctgttttgccctccaagccttgtcgtacgatatctcatatccgtattctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacatcatacgtcgtcctatttgaaaccttcaccctgaactcacgcttctggacaaatgcccacctcttcaccgcatcttgtaagtgacctttttcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccactttcatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgttcagtccgccaaatattttcatcttgtccaccttccaacggagtttcttccaccacggcatgacttgactcccccgattgatcaacacatgttgtcttctgcaccactattaccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagaatcgccataatacagacgaatgggcatatcacctgacatcctgataaaacatgacaaatagtctcacgtttaatcatttaatcattcgataattaccctattacaacttatactatattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgttgccaaccctttgctcccggccggcgcctcctcggcctcctctccggcctgctatcccctcccctcgctccctccggcgctcacggcgacgatgtggcgactctcggtggtggctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgtggcgccgggtggtgggccctgtcgaactccctccgttcgacaggtgagcgtgtcgaacgccagccgttcgactgggctttgtcgactgcccgtcgttcgataggtgccctatcgaattgcacccgttcgacagggacctactttcgcgattttccccggttggccactacttttgcgattttccataaaaataatattaattctcaaaaaaattccactgtccaccaccttccccatgcatcctcatgccgctgctcggtgtctctggcttgactttgatgaggcgctggatctggccggctggcgagctcctgcgttggtgtgctcgcgagagaaaatgttggatggagtgtgagatctcgggagggagcaggggaggaggaggaggaggaggaggatctatgtcaagcggattggggtggcctcacccctcctcgcctggatcgagccactgccatggccatctccatcgccggctcctctgccgccccggctccaccctccttcctccggcctccctccaccgccaccaagacgcaccgctgaggcgcaccgtgctaccgtcgtgtaccattgtcgcatcagccagcgaggaggctggggtcgccagatctggtggtttgcttttctctcgctctcctctctctcggtcctcttgttcgcttttctctcgctctcctctctctcggagccaaggcgacaggcggcggcgcaaaaagggaggcggcaggcgatgggtggtggcgacgggtggagacagtgc

SEQ ID NO: 58494 - DNA, 13098 bp, Oryza sativa
actccaccggatctggcggtggcgaggtccggccggtcgcccccacgccatacgggccgccgccttgctgccgcgcgcccgcgcccctcgccctcggccacgccacgctagcgccggagagtggagaagcggagtcggagggagacgcagaccggtagcgaatcctgtctcccatcctgtccctcctcaaacgttgttgtccagattggtccctgagcagacgcgcggtgcaagccgtcggcagcggcggcgtggggccgtggggtcagcgtcagcgctcgcctctcccctcgtcatctgcctctcgttggatggcgagctccatggcggcggcccctcggcgtgatggcgacggcgacagtgctcatcctcccttggctcgatggcgactacacttccccaacccccatcggcatgacagcggactacacttcgcgatgagaatgggggagcaacaacggcgctcgtccgttgcggtagtgactccggtgcattctccatccctaaagttttcaatcaaaatcaaaatattgttggagttctatatcttgaataaatattgaatgccttatctacctgattgaatcggactttttattcgcctttctttacggatttttttgttttttattgccttttttacggaattttttcaccgagtcaaattcaatcggactttccttatttttttttgggcgcgtgcacaagtgggacacttgattggacgccggacgaagggagcgatgtgacgacaggaaaaatatgaatatttataataggtatagatatagattattaaaacaaccttgaaataagacaccacgttctcgctgtggaggcgagaaattctcacattaatcggacaaaaagaaaagaaaagttcaagtagaatacagtttagaaatatctgaattcgaaatttaaaataatttaaaataagtaatattcaaaataaaaaataaaattttaggagaaaaaaaattaaaaataagtaatattcaaaataaaaaataaaattaattcctaaaatagaaaaataaaaataagtaatattcaaaataaaaaataaaattaattcctaaaatagaaaaataattataagagttcaaataggaatacactttatagataaaaaattatatataaagaagggagaagtaataagcctgtaaaacaataagatggtcaaccgttgttgggccatctaaaagttgtaaacaaaatcacaagtagaacccccaaggatgattaagagatggaactagacaggacgttgggtggaacgacagacaggacgtcaagcagcatagtcacgttgttggggcatctaaaaattgtaaacaaaatcacaagtagaacccccaaggacgattaagtggtggaaggacagataggatgttaagcagcatagtcacgacggttggcgggacttgtaaattgcaataacaatcatattttatttttaaaatctcaataacaataaacaggggagacaacaggtaggccatacaggagtataacggtgtgaagccgatggcggttggcgggacttctataaattaaaaataaatccttaaaattcaaaataaaaataaaataaatttcaaaaatagaaaaataattatacgagtacaagtatgaatatactttatgtcgatggggatacccgtagaccggatatagagggtattagggtacgctggtacgaggatctacgtagtacgacatcaagcaaacaggaaacaaggattatattggttcaggccccttggtagatgatagccctaattcagttgatatgagattatatgatcgaaaccacagatacaaagggaatagtggaactcgacgataccgacgagatcgtagtcgagttgatccgactagatctcccggtgacttggctccgataagctccggcttcgtaggctgtggtggatgtgttagctctaagattcgatgccttaggtcctcccgagggtcccttttatatcgcaggtcaactgtcttcaagtaggactcggagacgccggaccggacacgacataatgacgacccagttctgaccgagtaggactccttccatttatgtactccatgatgaattaccttaacgtatgccgaaaacttccatatacgcgcgagcataccatatcaatacgtggcgtatatcgaagggtagagggtataccttacccgtaaccctgacactttacaaataagaaaatatcgaaatgaaaaatatggaattttcaaaataaggtccacctagaactcaacgatgatagaaaacaataaataggagagaaacattaggcctgtaaagaagtaaattgttggcagttgatgcgacatctaaaaactataaacaaaactacaaatagaatctcaatgatgattaagaggagagacgatagacaagccgttaaacaacatagtcacgacagttggtggaacttctagaaagtaaaaagtaagtcacaatgacaatcatgttcggtttttaaaatctcaatgataataaaaatacatgagtatagtatggcgaagctggcggcggttgggcggatttaaagtaaaagatgaaccccaacaatagttatatttaatttttaaatcccaacaacaataaatatgggagacaacaggcggatcatggataaatacaatattgacatttgacaacactcctaaaaattataataagggaacctaacgagacaattgagtctaaaaattagaaggtgtattttttaaaggtttaaaggaagatatacaaaagctatgatagattgggtaaacaaataaaagggtgataaaagagtaagaggcaatgactggtgtaacttttaaataaaaatttaaaaaatttaaggatgataaggatcgatcttttaaggttataggacaatataatggctattaacaaattctaagtaatgtcaaataaagaaaaatagataattttatatgggtgctggccgtgcaattgtgcgggacatgcagctagtttaacactaaactgtatgtactacttgctgaaaaattcctacgaacatacgagcacttatgttaagtttaactgagcataccccacatatgtaatgcactacctcttaaccctaatcatagaaaaaaatgaacacccttgctaaagtataagacttagaaccccaataggcatgtttcgccaggaaaagtttagctaaccaaccaagttaatctatcagttcgctaactagctatttactgatagctttgaacatgctatccaaactatcaaacttcatatcccattaatttagctctgcatattatagggcagtcgagatgctctcgttcgttaacaagccagagagtgttgaccttgtagtaatcaaggcacagcctgtctaattcagtataattcgtttgcttggagggcgctccactccagttgttgctatacaattcgtacaatatactccctccatattttaatgtataacgccgttgcctttttaaccaacgtttgaccactcgtcttattcaaaaattttatacaaatataaaaatacttatgtcgtgcttaaagaacatttgatgataaatcaaatcacaataaaataaattataattacataaatttttttaataagacgaaaggtcaaacgtttgtaaaaaagtcaacggcgtcatacattaaaataaaataaaatacgagggagtaatttataataaccaatagctagcacaagaaacttatatataacaagtggtgctacattttacagagacatcgcaggctcgcagccaaaaaaaactagctgtacctccactgcttcccatggccaaggtcgttgttctcacatttgtatacgtggcaatggttaatgtgctactaaaattaataaacagatgaaggatcggagaaatctagatcaacttatttaaaacttcgtgggttacattgaaacggttgaatttcgatagaaattcttttcaatttccataaaattcattaaaactgatcggcggtacctgggccggttgaaagcctacttcccatggtctaggccattaatattctcgtgatactacccaactttctcgaattttttttatttttaatttttttattaaagtatttacaaaactaattttgtgtttcaaaaattgacaaaactagtcgcccgccgccctttgggagggcagtttttaaaatcaacctcccaaagggcgattttcgtgacgtggcagacgaccgttggctcatgccaaacggctggctatatgggacctgccattttgcaggcggccccttaccgcacttagggagggcggtttaacactgtgcggggggcagttcaatgacaatatacgcttcacatatataactatatcaatgataatgtttgtatcgattgttatagctaagacattgttggaggtataccgcgaagggccttcggtcgggcctgccgaaaccgaaaacttgggcgacaggttcaaactggaagcaagcggcgaaggtcgaagagggataccctaagggcgaaagcaatggctcaggaagtacgcgtgcttcgtcggacagggaccccgtcaggaggccacgcaggcgaagatggcgaggcaaaaagcctcggcctgaaggcatgggtttcgccaaggtaccaaaccccaccgtgaggaagcccagcgggccgttgcgaccctggggggattcgccaagatcaatgggccgagccatttagcctaattggggcccatacgtgtgaaggacactgtgtaccctaatcatgtccctatcataagggtaaccatgtaaattcccctgtaaaacctaaaccctagggggagagaacctgtaataacgttataaatagcccttctaggccatgtaatggggggatcctcaaaaaaatttttactaagcaatacaattgccttacttttccaacaactgttgagagaaccacgtctttcagtgtgacgcggttgtctattcgacaacagctggcgccgaccgtggggacctccgagcgaaaccactgagactgagcaaaaccactgatgccaccgaagaaggtcactaaggagaaagttgccaagcggaaggaaggcggaagtgaagtagagatggtagttgaatagggagcagatccttcggcctccgtgggtgaagccggagcagcactgccttcgacagggctgccacctctcccttcttcggcgcccaaaacttcgactgatgcggaagcggcgaaggcggtggcagcggcgaaggcccttcaggttagagacgtggtcttgtcctcccaagtactagggacgccctcagccacggccttcgcccaaccgatttcgacgtcagcagcgatcaccacctcacaagccaacaccgctctcgaagtacaagccgaagctgacatgggggccatgcgtcaaaacatggcaaaacttcaagacacgcttcgccagatgcaagagctgcaataagcatacgaagcagcaagacaagccaaggccaatgcccagcagttttatgctcagcgtcaagtcattccttcttatgtcgcgcaagcactggtgtacttcgccaggccagccctagccgctgccgttcacccaacacatcaagtgatccaagcaccggttcgcccggcggcgcctcaagcccagtacccgaagcctacttatacaccgcaagcaatgatggaagcagcttcgaccttgcaagctcaattccaagtttttctgcagcaacaacgtacaaagagcttcacctccggttcagaccgaggggagcccaagacaaggtgcattggcggggcttctggttggacagttcgcccagccaagtcaagttcgagggccttcgcctcaaggtccatcttcacaatttgacccaagcacaatggcccaagcactgacaacttttgcacaagctatacctccaggatacggatcagccccaccaccgaatcaaacatggaatcaaaccacgttcaacccaaccgcggcagcgcaggtcacttctccagaccagcagaaccaggcaatgatgttcaacatagcgcttcagtcgatgcccacagcacaacagcctgtggattccatggcttcaccgttcgcgctgccgtacccacatttgaattggcctgctcagcaaggggctatgatcaagccgaggaccgaaaagggcctgcccctcagctggggaatcaataatcatcccatcccaccccagttcaagtaccctccggtcccacggtatatcgggagaaacagatccgaaagagttcttgtccatctacgcatctgcaattgaagccgctcatggtgacgagaacaccaaggagaaggtaattcacctcacgctcgatggcatagccaggtcttggtatttcaatttgcatgttaatagcatttactcatgggagtaattgcgcgatgtttttgttcttaactttcgaggtacctatgcgaggagccgaaaacacaacaagaccttatgggcattcgccaaaggcaaggggaatcaacaagggagtgcatttgcctgttttcgcaagcgcgttgccaagtgcaagatataaccgaagcgtatgttatccatgccgctttggccagcttgctcgagggagaactcacaaggaaactcgcgcgtaaagaacccagaacacttgaacacctcttttgcataattgatggatatgctcgaggtgaagaagataccaagcggagggaagaaattcaagccgagtatgacaaggcagcaacagctgcagcagccgccgtccaaaccaacacccaagctcaggtccaagctcaagctgtaagttcagcaccagttcaagttcacccagcatctctggcgaaccaagtactgcaccccaggccgaaccaagcacccatgacatggaagaaattcaggactgagtgagctagcaaaacggtgatggcggtcgaagaggtacaagccctccgcaaggagttcgacacccagcaagcgggcgggcaacaacagccttttcacaagaaggtcaagaaagacttatgtcacgccctaaaaatcgactaaattaaaaatgcatattttaaatcatttttagaaattaatttaaaagcctacaagctaaaccctaattttctaggaaaattttcaacataaaaatgagctagataaaattttattaaatactatgcttgctcctttattttctagatttttctgggaattatttgagcaagggaagtatttttaataattgaaacaacatttcacaaattgttttatttcaaaaagtttaaaaaaatcccctcctaagccgttgggccgaattcggcccaactctctctctctctctcccgcgcggcccaagccggcccagctgccgccgccgctctctctctcgtgggacactgacaggtgggccccacctgtcaggtgtttcccctacctccggccggctgccctagccgagtccgagcacgagccgcctccttctcctctcaaattcgcctcaatccgaccccgattcctccgggtttttgaggggttttgttcctctcgttctcctctttcttttcccccaagaatcaaagagaatcgttgaggatttgatccgaatcgagttcgttttgattttatccctaaaaccgagttttaatctttcccgagtcgattgctctcgtttggagttcgatctcttcaatccaagcttatataaaggaccacctcgtcgttctctttcgtttgccccctctcccgagctttcccgtgcaccgtagcgccgtcgccgcgtcgttttagtcgccgccgccgccggccatctttcggccacgtcgcgccgccgcgtccgtcgtcgccgccgcttgccgccgccgccgttaggtgcgccgtggtgagaggaatctcggccgccccttccccttcgccgccgaccaccggagctccgccgacgccgtcaagccgagccgccgcgccgcctcttctcgtcgccggccgtcatcgtgcatcgtttgttgtcgtggtaagtaccatcgggttcgtctcgatgtcctcttcgcgttggtgtcctccaatcgcccggccgaagtccctagctccggcgagctcgcaaaccctaatcggccgtgggtgacgtcatgctgacgtcatcagggctgacgtcatcatccccttttctttttcctttttccaattttctaatagattaaaacttcggaaaatcataactaaataaccgtagatccgtttcaggtggtttaagtttctaaattcttctaaaatcaagatctacatgataaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgaacccgtttaaagctattattttatttcaactatgcattgttttcgaatgtcatcgggtggtgaacctttcccagttaattattggccgaagatgactttattttcctatgggttataatttgattagcatgaaccttatatattggattggttcagctaaatgctatatgtaagtttgcttagccatgcttagaaacattagctaactaaaggggttaattataaattatattatattattattcaattatggtgattcaatggtagctcacgatggtaaatcgtgtgatgataattaattggtaattaaaacctggctaaggtgggttgtgagcatatggttttgatggttgtgctcatgacaattaaggaccggttcgcgagctactgttgtgaaacatttatcgtgccaaccacaagccagcgtgggcaacggctttatcttttgtataacgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtacggtggtggtattgaggcacatggtgacatgatgtggggttgtgtcttgtgggtacagtggtacacctctgattagagtttaaactattcgaatagccgtacccgcggttatgggtgagttgagcaatgtttttcgtgattagtttcacactactcatcaatgttaataatgtgataaataatttgactcctggtttggaatggttaattcctggtttggaggtttaatttgttcaactggggttagttgttcaaatgtggttgggcctatgcaacatgggtgtgttgtatggtgttatttaatattgatcaattattcaactgtttttattattctcttatatatttattaaatgctgttttctgcaaatgagctatattatgccatcctttgttatcctgtgcacttgcatatttgctgtgtggcttgttgagtatgtcatacgctcattcttgcaatattcattcatcagaagaggagtatctcagtgaaggtgatgatctggaggattaggcttgttcttggttaagatgcctgtggagtggagtcgccatagctgttccgtagtttgttatcgttttatatttccgctgcgtagaatgttatttttgtttgagaggaactgtctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacaacttataatgcgcttttcacggacgctcttcgcacacgaccgagcagagtcgaaacattcggcagcaaggcaatgttcaagcacaaaggcattgtctcagcattgtctctacagctgacagcattccaagatacttttcacagccaatatccttcggaccagaagatgccaaaggagttcttttcccgcaccaagacccgttgatcgtttcggtagaaatggctagttttgaagttcggcgcatcctcatcgatggaggaagttcggccgatgtcatgtttgcgttggaggtataccgcgaagggccttcggccgggcctaccgaaaccgaaaacttggcgacaggttcaaaccggaagcaagcggtgaaggtcgaagagggataccctaagggcgaaagccatggctcgggaagtacgcgtgcttcgtcggacagggccccgtcaggaggccacgcaagcgaagatggcgaggcaaaaagcctcggcccgaaggtatggatttcgccaaggtaccaaaccccaccgtgaggaagcccaacgggctgttgcgcccctgcggggattcgccaagatcaatgggctgagccatttagcccaattggggccatacgtgtaaaggacattgtgtacccctaatcatgtccctatcataagggtaaccatgtaaattctcctgtaaagcctaaaccctagggggagagaacctgtaataaggttataaatagcccttctaggccatgtaatagggggatccccaaataattttttactaagcaatacaattgccttacttttccaacaactattgagagaaccacgcctttcggtgtgacgcataccttttcgccatagtacgtagtgggggccggcatgttccgacataacaaaagcacgagagtgactatgcgaacgatggcataaagctatgatcaataattcacaaagtttcgagcggacaaaatcacaaaacttttctatttacgtgagaaaaacctcataaaaaattacatcaccagttacatgttcgccctcaattaagttactaatcggcgaattaggttcatcgttgctactaatattatacacaacccttaaaggggacggtggccaaaagcaaactaagctgtaacggcgacgagcgatagcctcttggagaaacgacctcttaaagtttcgctagaaaattgcgctatcttcgcgatacgttacacgatacctgtcatagtctttcaaagttcgaccggggtgtgcacgcatccattcggcaacccgtataaccatgtagctgttgccttttattaacatttcatggtaaacaggccgaaaacgacacttggtcttcagcaatcctttaaccgccacgaacttctcgttcttgtttcgccaactttcaggtgggggccgaatgcccatttttcggccacgaatctcctgacaaagcacaaaagaacaagtgcaaaaggaaaaatgtggacgaaatcaatcccactttccaacaaaatcataaggttggcgaaagcattaacttttccattaataaaataaaaaagtcataatggctataagatgaaaacggctcaaagccgaacatgcaaagcgcctatatacatagtaggactaccaaaaagcctaaaaggacaaagaaaaaaaaggtgggagtcacacgagggcctcacacctcagggtggtcttggcctccattgcctttgccctcgtgtccggcgcccggttccgacggcccaaggtcccctccggtgttagtggtagtggcttcgtcctttgcaatcctctcgagattctcgcgaaggcgtgtcttcgcgcaatcccggccgccatcctcctagaaaccttttcggaaggcccttaaggccgttccggaacactgtgaattgtcaggacattcttctttcacgaggtcgggaaagatcccaatgtggtcacaaccgtgtgagtgtagctggctaaggatgaagcccgccgaaacacgcgcacaacagtcaccataagcacctgccacttcgacgactgagccggccgcttcctgcgtcctctcggagaagtcgaacgtcgtcccgtcgtcgcccggagcgccctccgcccgtgtcccgaggtcatacagagccagcttgagagtataacagacttgcttgggggactctgttgccggcgccaaagtcacagcagcagcttcggccgagataagacgggcctcaagggacttgatcttctcctcggccgcagcaagttggcgatctcgttctgcgtcccgctagttcgccgcctctaggtcggcgcggagagacttgttgtctcctgtaagagccttgttttccgcattcgccttttttatggtctccgccacaacacgtctttcgtcttccttgtggcaaagatcctcctcggtttttcggaggcgaagacggtacccgtccggcctctccaaggcagacttttccgcactcaagtgcgcggcgaggccctggacaaggggaaccaaatacattatggcgtgacataggtgaaatgagaaaattctgcagacagaaaattcatacccgcacaaacaagctctccacggccgtgcaactttcgccaaatttgttcagctcggtgaagaggccaaggccatcggacggtgcgataacttggcacaccccgtccatgaaaggagtgatctccggccacgtggcgaaatccacgggaacgaagtgcggggcagtaagcgtcacgtccgacaaagtcatttcgaccgccggagcttttccttcccgctgacgagcttgcgaaggaatcgcctcaacctattcgtccccggagacgttcgctccagcggccggagccgaggcacttccactcgttgcagcttcggcgtcactagcaagcgctggggacatgcgtctctgtcgcgaccgggaaaattgccttttcccgaacgcttgtgtattaatccccgtcccaggaaaagccggggtacaccacacaaacatgatataaaagacacatctttattatatcgataatatttacattattacaaaggcgcttcaggcctgacaatcaaaaataaacagcagcggactagcgagcctacggctccaccttcacaggcgctcaactggggtataagccaggactccacctaagacatcttctccaaagcttctcttactgaagaggggaaagattgagcaagaatgagtacaaccacagtactcagcaagccacaccg

SEQ ID NO: 58495 - DNA, 9167 bp, Oryza sativa
tgagggctccttttagaccaaggataatttaacaaaaattctccgggccacattcgaatttttcttgtacgtattttagtgtttgccaaattcttttcgaattttaattaattctattattccttttagcgaatgatttttaattcgggatgaatttatcaggacgtgacaaatccaccccccttacaggaatctcgtccccgagattcgaggaggctagcaagaggataggttgggcggtcttctcttcttgtctgactccttccgctccgtcttctataacaaacttgcctaacaaaacttctccactctggactgcttggctcgatctcctgttgcagatggaatcttctcttcacccgacttgtccctggttgaacctttagctgacttcgactgggttgcggcacttgaagatggtgcttcagttccagaacttcgcatagttcatatctttggcgtcaacctcatacaacttacccacttcatgtcatgcgtcaacactagcttgtcattactaggataccatgtttgtcatcataagaatatcatgcttgtcatttacttctaacttgcaccaactgcctcatattagctttcctagtctccggtgctagatacttcctctattcaatgtgagggtcggtaacttttgcctttgaattatgtttcccaaggtaaccaaattatcccacttgacatgctttgacgtcttcccaaatgactttactgctgaacttgttattgtctgatcattttcctgccaaatctgaagcttcgttgttaggtgtgattttaatctgacctctatagactatcttcgaacatttcacttggttcataactgggaatagttcccacgaacaggcagctcggatttactttcgttacattcagtttacttcccactattaccttcaggttgtcctcagttagcattcaacgtattcctttacacctttaaccttgatgtgttctttcccgatttctcttatcaatcacctttcgacctacttctttgcccggtaataaacacctttgctggtatcttctatcaatcaccttttaaactttgtcaaccaagtactctccactccgagagttgtggatgcttctggtgacaatgaggtcctttggcttgctgccttccagtgaaaccttgaagtgtttcgccaaaagctatactgactgtctttgcctttgatccgaaaaagacacatctgaaactcttagtccaacaaatgtttctttggttaatcgcttgattttcttttccatcatcaggttggttattaactcgaggttagaacatagttcctctggaatgagaccctaggtctcctttgacagtaaacaattatacgcatgatcccatatcagcatcttccaaaataatcctcatagaacttgtttttatcacacatgtctcccttattacatgaatacaaggcactaccttaaacaaaaaagggaagatgcttaacatcggtacattgtttctactatgggttaggattaacatgaggcctcacaggtacggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttactgagctgtccatctggggacgatcattttgacttggagttggaattggtggttggaaatccttgctaacattggcatcagtggtaccatagttgctatcaccattggagtctttctcagtgtcaaaattgctaaggttgtcattctgggttccaacattgatactatcgttgacatcttggtgaatgctactgacattgcacgctttattcgggtggtcactaatggggcaagaaccatggttgttggtggtatcatcatcattagtattgctagtgttgttgtctgcattgcgtccatcttcttcgggcaggaattcttgatgcacaacagaagatccggtgatctgaagtggctcagtgcgctgtctttggttaccacctggaaatactgggatgttgacaatccttctcttgcagttcgtcatccgattatgctcactttcaagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgcgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggtttcgtttatgcttttctcattcccattggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaccccactgatgcaaaccacgcgctacacacacaagcaaggaaacacacaactaacgactctaccctagagggcggcttaggttctgcaactggttctccaagatcttcactccttcttcacagctggcttcactgcttcctacacttcgctagcggatcctgcagtcttccggagcttcggcaaacaattggcgacatcttcttcttcgcaaagctgaccatctagtactagttgaaatttgaagaaggaagaaaaaagtaaaccattttgcaaatagcattaggggaaggagaaaaaggaactttcgccaatagttttatttataaaatatgtccttaggttttatccacttggcttatcctaccgtcgagatggctctgataccagcttgtcgcgaccaggaaaattgccttttcccgaacgcttgtgtattaatccccgtcccaggaaaagccggggtacaccacacaaacatgatataaaagacacatctttattatatcgataatatttacattattacaaaggcgcttcaggcctgacaatcaaaaataaacagcagcggactagcgagcctacggctccaccttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggggtacaaggggataataatataggggttaagttttgcagtaaacagcatttaaaagtcacttagttgcccaaagccattttataaagacgatcctagagctacacaaaattattaatcaaggccgtgaaccctcacgaacctgccttaacccaaggcctacgatgattcagaccgaactggcaacccgaccctaggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaggtgatatgagaattcccaaagtctaaagttataaaaccacctaatattgcctaattaatcagcgaagcatctacctaaattcatacttgtggaaccatgaatagagtgtccactagttggggttttgtttaatctagggtgaacaaggtaataatatcaataacaataatattaaggtcataacaaaggtaaataggcatggctaaataaaacagtgatcacgcgggaatttaaataaagcgttaatgcaataatttaaatcaaaataattttataaactgggattcaatatgttcaaggatgatgtgacttgccttgctcagagagaacggccttccgaaccttcggcgacgaccgcaaaccacgcttcgggaacctccggaatgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtgtaagcgctagcctggaaaagacaggaaggctgcgccgttgacatgcggaccccacatgtcaacctaaaggaccgcggtagaccgagtacacagagtcggtccatgggtcgacggaagcggatcccgtgtgtcaaccgaggcgagtggccgacaaacggactccactagacaccacacgggttgcacacgtggaaaccacgcggctaccgagcgggcacactaacacggacactacacggtcaccatccgcacacgtgaacgactaccgacaccggtacacgggtaccggggttgacgaccgcacaacgagcacggacgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacggggctgccgcggctcgcttgacgaacgcggacgacgaacgagaacggctcgacggagggacgaacgccacgacgaccgagaacgacgagaggacgacgacgacgacgaccggggccggcgaggagacgatgagggcagccggcggcagctgcacggagacggggacgacgtggaacgcaccgctgcgaatccgacgacggaggcggcaccgcgagacgacgagccggcgaggatgaacggtgaagacgacgacggacaccggcggtgttcggtcggaggggaggcgaggccgagaacgacgtcgcggctgcgatgccgaagatggtggaggtgtggccgaccggtgcacggcgtggagggagaggttcgcggcgatgtgcggcggcttccgggcgaaaccgaggggtggacgaggtggagggctacgccaccatgccgagggagggacggcagcgccggctgatgcacgggcccggtggaagggggctgccggaggagacgtcgacgaggaggaaggagaggccgacgcgggcgacggcgttccggcgaaattcgggcgacgccgtggccttgccgggaaagaggacggcactccgatgccgggagaggtggtggcgacgtcggccggcgcaccggggacgcggcagaggcgaccggaggcggaatcgtggcggcaacaccacggttgccggcggggaggcacttccggaggtctccgcgggagacagagggtaggccggcgaagaggaggcggctgcgatgctagaggaggcgacggcgcgaccggacggcgctccggcgaggagggagaggcggctggaggcggccggcggcacgggagggaggggacgacggcggggaggtggctagggaccacgggagagcccgggaggagactaaaacggtagaacgcaaagagggggttctattttataggatgggggagggagccgggcacgggaggagcggggaacggcggcggaaaagccggccggcggcaatggaaggcggccgggaatggcgcggccgtttccggcgattgggggcaccattcaaggggaaattaagggggaaagagagaggagggaaaggggattaattccccctaatcaatttgggaatcccatgcttgaatcgcgcggatttgagggaggaatggcgctagggttcgcacgggagggagagagaggaaggggccgggcggttggaaggggacgaccggcctggcgcgtgggccccacgcggtcaggcggcggcgtcagcgcgcgcacgcgcgcggcacgggcgggaggcgcggctcggcttgggccgggcgaagccgaggcgacccaggaggagaggagggagaggaggcccgggagagagaggggaggggagggagctgggccgggaggggaggaggcccaagaggaggagggagagaaggagagggagagaaagagagggaggagagggagacttcggccgcgggccgaggggagagagggaggactttgggccagacttggcccaaaggaggaaggagggttatttttaggtttttctttttaaataaactttgataattgtttttgttgcttaataattatttccggtgctctgaaaattcaagtaaaatttgagggctccttttagaccaaggataatttaacaaaaattctccgggccacattcgaatttttcttgtacgtattttagtgtttgccaaattcttttcgaattttaattaactctattattccttttagcgaatgatttttaattcgggatgaatttatcaggacgtgacagtctcccccgaggaggaatgcgccgcagaatcggcgaagtgggcatcccatcggacccctcactgtccgaaaagccacagccaacttgcacaaccttccccttcttcttcttcttcctggcaacagctcccggcttcgccgcagagctagaaatcgccagaagggcattcgctccagcaatgtcttgcgggcgcacgggcgaaacatgagagcccaccccagatttcaccctagctgggctaggagtataaccatgcgatccatcatcctcagatccggcctccctatcgtcttcttcctcctccccaccatcgctttcggccgcgtccttagcggcgcgacgagttcgcacctggccaccctttgcaaccgctcgtttgcacttcttcgacgtaccgacatcctcgtcgccggccctagaggggattgatcaacctggcagttcgccaacataaactcggttcacccggccatcggtctgacgctgaagcaggcgggcgaatttggctgtggttaggacgccaaccattttcgatgcctccgttttggcgtcctctaaggtgtgaactgaaaaagagaggaaaaggaaaacgatgaattaggccgaagtatatttccgcaaaaagaagtatacgacacggagcaaaagcaaaaactcacgttcggccccggtggggagaacaaggcggggaagcccgagaacctctttgtcctcattgacggaaaccccccagacacgagcaaggggggagatcggaagaaggcaaaactcctcggaaaggtcacgggtacttagccgccgtgcgaccttgcgaaggagtatgagccgggactcgagggttccatcgacctctaggtttggcttcacgacaatggagacggcggagcactggaagcggagctagttcgccttgttgtctttagtagggtaggggttggcgatgtagagtcacttttgcatctagttcctttcccatttgcccatcgatgcaggcaccggccaggcgtccgaacattccagccgcagcatgaagttcacgcaaccgaaaacggtttttcttggtccggctggcgtatgcacgtctttggtcgtggcacatgctgtaaataggacggcgaacagctcggcggtgggagagaacctgcaggttcggcacatcctagcgaagacagccagcttcgggattgctgacggactgagctagggaagcctaacctcgtatgtcgccagcacggacgccaggaaatcgtcacacgggagacgaagcccggcggcaaagaaggtggcgaagacgaccgttcgcccatcgcctggcgaagggacaacggcttcgcccccacatgtcccttggccctccgcgagagtgccggaggagaccaattcggccaagtcggcctctttgacaagcgatttgccaagaaagcatgaccacccctccccgaggctgctagggtcttcgccagtcgacccggccttggtgggcttacgaggagccatcaggtccgtggcgaaggaggaattgagaagcgaaagaaagtgagagtacagaggtggcgaagagctgaagtgcaaacaaatgcagagagcacggagcgt

SEQ ID NO: 58496 - DNA, 11998 bp, Oryza sativa
ggtcaaaaggggtcaattctggcaatgagtgaaaaatgatgagataataagcaaagttcacacttaaacaaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataatcgttgataaccactcatcatatagctctgaacaatattaggttagccatacggacttatgtaaacttgtacaaactggccttggatgtgtcaaggaagctgtgatgcaattatatctctttagtttgcttcttcgcacatactattgattttactacttcgaatcattacgacctgataacttcttatatgattggtcgagtgacatgttggctactttgatatacacagatattattttatacttcccattaataatattaggttgttattgttattagggtggccagtctatatgtatcagtgatcttgtttcttcttcatcttggagtattcttttgcacagagtaagtttaacaaaaatccttttctctgatgattatggcttgcaatctttttttatttgataagatacttgtttgtgtttcagatcggggatcttctcatgtgctatttgctgaggtgcacatcaatctttctgcctgttaaaaagaatgattattttcaggtctctggtgttccactcaatgtggttctgcgaaatcctatatttgcaagtactgttgcgagaaaacatcaaccccaaactacaaaagcaaaatgtcatacagtaagcatttatttccagattttatagtttttcgactattgagtacaagtctttgtccagtgaaccccgtacaaatatttgattcccaacttaatgctctgaagacacaagtcaacaatttatctcagtatgactaggtctaccatttaaacaagtctcaacattcataaatttattttttcatgtataactataggtgaaaatagttctcaaatacagaaggaaatgtttacctcatccaataatgtgatatcctgcgatgttttatgatattcttgagtaagcatatttttctaaagaacaatagttttgttgtgtgtgaaaacaataacaataacaataacaataagttatacataaaagcctttcagaggtggggaaaggtgtcttctttggtagaaaaaacaaaactatcttgattagcctgattagttatatgtgattttggaataaaagctagacggagaacagtgtctgggattgcagcggaaacatgacttatctgacttcgtgttgatttcattacttcataaatgttgagttccaacaaggccacaacttttctgcaagatttttaattaaataggcaaaacacagcagaattacgatgaaatgagtatatcgcaatttctggttttcatgaagttccaggaatacaaaactagtccaaagaattggcacataaatttaaatttcccggtaataccaaatatccacatggagacatttttgtttataaagtatttttatacttttgtcaattttgtcagagaaatcttcaaattgcatcgtctccataactcgtgctataagaaactagactgttacatattaaattgaaaagctgatgtgcacgagggtgtcccgatctttcgatgagaggataagtcgattggattgagtgacgttggcgatctgactacaactatccagggatgttgctccttagcaatcgttacaccaactccaaaggcagtcgtgaattgcatagtcagcctaaccacaagggtatttgttcctgcaagcactcgagaactagcaagaacaagatgaacaagcaactcaatttgcgaactaaagatgtaggattgaatcaacagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgagggtgttgatgtcctcatcaaaaacaaagtgactttatctgcttgatctggttgccttcacttcagaatgaggaaagtcaaaccaggcagtttttgtgaaactgacgaacaaagtgatgtcagaaggattatattacattagctgaccgacttgattgacccacataattgttcctagaatgggtgcctcagcaatcccctgcctcaattttcaaattctctctttccacgtgcccatattcctttaaatgtaactgtgtccccttaactactagcagctggaacctactctcataagaccatcagtgttatgtaaccacaatgcatgtctttcattgctatatcagaagcaagtgctaggtagtgaacatcccaacacatgtattggttcttttctttctttgttttttgtacaacaattgaataaagtaagttcctaattttttatattaatccttttgctatttctctccacaatatgagaaaagatatgccaaagtaataaaatattaatatgtaacaaactgctggttcaaacctatgaacggtggtgaactgtgatttgataacctgactgttttaacttttgagtactggagatattttttatagattttgcaagcttcattaattttggctgttgatttgtatctgattctagtcctataaaatgtcatcagttatattatttgatgagccacatgataattatattctttaataatacaagcacatgtagagtgttcagatgaattactccatcacaatatatagctacttctagtgctcaaatcttgtcgtcgcaaccaattacaacctcctcattcaatttctccacctaccttctccatctcaaccaatcacaacaatctcgtgtttcacctgtcttcttaatctcagtgaattttttttctagaagtgcttatattttgggaacggagggagtattaaataagctgacaagtcactacatgtctttgtgtcatcagtgctacctgtggaaaagtgcaaacatggcggaaaacttatctatttgtcatgacagttcaaattctggagttaattcttcgtttagcagcacttgcaaaattgttactcaacaaagctgtgaaacatgtggttccataagaagagcagaatccaaagatccaagtgaaggatgtaattgtccaaaatttccttctgatggtagatcaggagagtgttgcaactgctatacccacaacaccaggaaaagaaaaaggttatacagttggcagcgccgcagcaaaaagaaacaggtctgttctgtggatgagtcttcagcagaatggagtaaattaaatggcagtaatttcaatatgtctaatggtccatcggagaacctggctggaaaaatgaatgatcaagcacaatctgtcgagctcacagtagataatacttctttggcaaggagcaatgatgacagttcttcagaaatcaaagtaattaatgctactatcttgtcatcagaaaaatcaccttgttcagtgttcgacataaggggttcccagggtttatcttgtcattacagcctgtcagaagtccagtaccaatctacatgtccccaagttgggccctccagttacttacatctgaatgtcagcttcccagccttctattcttttttttacctcttgcttttaagcttgcatttcattcataatggacaaatatccatttatttaatatttttgtacttctgtagttagtttatttttttatcaatttaatttctttgagaacacaattccgtttagttattttgagaaaacatcttttaccgtttagaaaaactgttatttactgaaaatgtgccagaatcaatagtttggatgtataaatagtcaatgtatgggttggtgtacatatattttttaaaatatactccaacagtagtcctgtaaaccatacaactggaaatgtcatattctgtcttgaggataccattttaggactctaatcaagtcaacgtcttgaacaatatgcttgcattacttgttccttgatgaacttactgtaataaagccatgctgatgttctctagtaattatagtttctttggtttgtattgtttttagaaaaaaaattccttggcattgatctgatgcactattctcttttaggatactgttgtttattgggtatgaacttaaaactggaccctttgctggccctggcatgtgggtagaaattttcactcctttagtgtatatccacaaatcattcattcactttttcttgcacatataatgtttctcataatatgtttttcaatctattcttcctccagagtattcttgaaattcaaaagcacatttctgttgaatattttactgcacactatcatggaactttttaaatgttctagtcgtttcatctttatattttttcttgcagagttgttccatctgcttcaattgtataatatcaaatgcatccaaacatttatcattagattccttgatatcaagaaatggtattttctataacagaaggacaacctatagtgtcttccattgcaaacgtatccttttgctgcttcatgtaccctcaaaatctgtaacaagatttgcgaatgcaaagaagtgttacttgtcataatgatggggaaaaattgagtgaaacctgtgcatgagtgcttattttgtctttcctgttggggcctaaggtgaataggtgatgaggtgtttggagttctggaggaaaccagaagcagtttgtctaggaaagggaggattgtacgatgaggtgatgaggtgtatggagttctggaggaaaccagaaacagtttttgtctaggaaagggaggaaaccagaaacagtttttgtctaggaaagggaggaaaccaaatctataatgttttcttgcttgtttctgttacactagctaatgcgctttttaatagggatttaaatagtactagatctcctacattgcaattcgaatatggaatcttctgttgtgttactcagtagcttgttgctagatgtagattgcaatactgatttcctgtaattttggtagcaaaggacacatttggccatcatctttagataattttgtagtcccattcaattagctttaattaatgcaaagagttcttttcttttctttaacattccgtgtcattgtactgttctaaaattttactatttttatgtaggctaggacatttgattttattacaagtagttctatcaattcagtttttgaacaaagttcaatgggaaaaaaaatagaggattatgcaattggtccattaccactgttggattaacatctcctatgtatggagcgatctttacatggcatgttatagtcacatatcagatcccatgatgtgttgaaatctagcattgcctatgattacagtatgttgtctgagtgttccttaatccttactgctgttagacatattaagcaaaaggaaaaggccagatgctctatctcttgtaaagcacatatttggaatcaatagttgctgtgcaagcttattgaaatacaactgccacgaatctacaatcagaaagtctaattgcttgtgagtcattagatatggttcttcagcgtttcatatcattagttactcttgctgttggatgacacacttctcactaatatttacgattctgtccacatattgtaactgcaatgcacacatcaatgtgctgtagcaacacataaggtgttgtttaatactaatgatatattacagtcgatttcctagcattagggatgccgtatttggaagataattcatcaaccctgtgcagctctgtgccaaaacaatgtacttttgagtattgatccaaattgttttttaagaaaaaagtattgaatcatttttttttgtaaagagctcactgattcaaatttatgaaggagaaattatgttgcttgtccttcaattttttacttggtttaatttttcctctcccaaatgcaaaaccggacaaaaccaaccctcaaccctcaaaatctggcaaaattaatgcctctgccctatctaatacttcctccatgtcaaaatgtaagcatttttgaggttggcacgagtattaagaaagaggtgagaatgattggaggaagtgtgattggttgagaagagaaagtagatgaaagagaatgattgtgattggttgagaggagaatggtaggtggagaaataactttattttgggacaagatactgtgctaaaaataactacattttgggatggaggtagtcgtggttttgacttacatatggaggacccacttttcattgaggatttgatggttcaccattcttctgtccagtgtttgccatatgggcccaatgttaattctctatccctccgtagcatgtgtgcccaccacctatatgttggtaaaaactgttgaaagggagcagagggatgagttttagctgggtttggttatgcacttatgcatcttttttgtacggctggttcgtggttttgggggtccttttggtcccttctgtgtaatttccttttcttcttaatgaaatgaagtgcagtcctgtgttttcgagaaagagggacaaatcaaactgagaagaattgagggatggtaaacagtttattttttgtgaaaataattccaacctgactttactaccattattaccattagttagggtggtgcgtcagtacacaatttttttttggcatattttggtcaatttctagactgtcctaattaatcgtttctaggcaagtgaatgcaaatgcttctatgcatgtcttgaaatcatgtggtctttgcttaggaattagcttccatgtttttcacactcgtgcaggatcataggcttgtctttatattattcttttcgagttacaccctgcaaatgtgaagttttgacatttttactatttacggctttcactaccaggtgctgttggctgcccaaatcaattaaaaatctcataaggaattctaaacgttgccaatataagaaattatttctgaagcattgttctgtcaagtgtaaggtatgtttgagatagttcgacctcatttactgagtaatatcataaagataatccaatgtatcagctcatgagtcatgactattctgggtcatgtccttttggtaaattatcctactgatctttgcaacaagttgttaatgttaaacttcagtgcttatctgttgcttcccacattatacattttgtcaagtatagcaagccacattttttgtggcaatctaactgattatcacaccttttgtcaaggacattttattcaaccatataaaatgcctcatttcgttcaattgtatttaaatgcctcaaccctccacaagcaagtggaatgatagtacgttgtctatttataatctatcctatgccactgagtttatcccagttgaacaatttatcattgacattgtctctttctataatataccagcgactttatcaattgttctacaatacgccattgggttgggcctttccttcaaaaatactcaaaataccattagagacgtaaaaaggttaacaattaatttatctcactagaaattttttaaaaaatgatttttttatgtggcctccttacataatatagacgttttcgtataagtttcaagcattttgcatttctactttttgtaagatattacctccgtcccataaaaattgaaattctagttctaaggcttagtcccacaaaaaatgtatttctaatctcatgggacccaacaagtaatttaagaatgctaattatgtgggttaattgtctcaaaattccttttaatcaattttatatatggaatgtatgcatgtatggggttcattaaataaggttattgtggtcatttgtctatcctcctaatatgtcctaaattagctagaatttcaatttttatgggacagaggtagtataatttatctgttatgctgtataaaatattttttgttgtttcttttaatgtaaatcatctttcatgtgctacataagatattttcgtgctattatcttttgtgtaagcaaattctctcctataccacataaaaatatttttttacaaaataaaaataccaaaaaaatcttgaaacttataacaaacttctttgtaatgtaaggaggccacataaaaaaaatcattttttttaaacttctaatgagatgaatcaagtgttaaccttttatttttctaagggtatttttgaaaaaaaggcttagcccaatggtgtattgtagaataattgataaaatcactggtatattatggaaagagacaatgttagtggcaaatcgttgaactggaacaaactcagtggcatagagtagattctctattgaaataatttctagatgtttcatacgttgcgctaattcaaattcaatagacctagcaaggataaacaaatcatgtagctaatctgtgattaatattgtaagtccattaaatttatagaaaaatgcaccatttgcgacatcaaattggtttcatgaaatccaccatgaaatatgtcttgatagtagtgcattcatttattattgtagatgttggtgagtttttctatagacttggtcagagttgaagaaaaaagtgacttaggaacagaggtagtatagaaattcgttaatggaccttaagtaaaggaaggatttattgctaaatattaattattttgtaactatctgatattaaaatcattaaaaagataacttttgttccatgataggctcaactaaatagccattttgtatttacaaatataactatactcaaatttcaacaaacaaaaaacaaattgctgcttctgagatttttaaacgcttcatgctataaatttttttaatcaaccctgcatctaaatggtttgaactagtcatactttgttcgtgtttgttttaaagtcatactttgttattattcttcatgctgcaaaaatgcagtggagttatcaatttatctgttaattttgctacttacaaaaaacatgccaagccaccatgcaatatgtaatgcgagcaagaattttttatactagatatattctagtctattgactaaaatgttgatcagacatgccaaataaaatttgaacctgtatagcttgctgcctggagtacttatattggttgcaatattatctgacatgagtttttatggacagcctgtcaaaatagcaaaaatgttgtatataatgttataagagaagaatgacatcacttatttttgctgtaaaacaggtggcacctgatgtgaccaagaatgatggcaaggcacattatccacctggaggaaaagcagcatattatgatcgatcattttctcgattggaagcgtatagcacccatcaacaagtagcttcttttgtttgggcagtgctgaaacgaatagtaccaaagccattgcttggaaactcttttggcaagagatctttgaggacaaatatatggaagttcataaagttacgtaggtttgaaacatttcaattaagtgattgtattggcgatctgaaggtatcacattattcttggttatcaaatattgaattctctaactgctagtgttctgcaataattgggaaacaaactgggtcatcaactagtgcagaagagcagaaacagaaaaatattttgcattgctggattagctggttattttctgatattgtgattcctgtggtccgtacatacttttatgttacagaaagagaatcaaaacgatatgatgttttttattacccaaagtcagtatggagggacttaactagcaatgccattgcttccttaaataagaaaaacttcaggattttgcgcggtgaacctaggaaagcagttaggcatttgaactgttcgtcaagagtgaggtttcttccaaaagcaaaagatatgagaccattagtagacctcagagctaaatcgaaggatgccaatctcaataaatgtcatttaattatgaaaaagctaagagatgagaaaccagagatgtttggttcatcggtttttgattacaataatgttcaccaaaatctttcccaatttatttcttcaaaaagaagccagttgatgaagaagttaaaggtatatattgttgttgctgatgtatcgaaggcatttgattgtgtcagtcatgacatggttctaaaaatgatagacgatgctttcaagtgtgatgagtacacagtgaggaaatgctcaaaggtaatttgtaacaggtctaagaattccttgtaccggtttgattcaaatgcttctattggcaatggtaacagtatctatgatttatcaattcagctatcatcaggtggtggcatttttgttgatcaggtagtgtatcctaacaaatgtcctttctttacctggttgactaattaacgaatgtgattgaaaatttgatcttctatccttctcattgtgacattgaacacaattttaattgttattctaatagcgtattggaaatttattaaaaaaatagtcataccagagaagtttttattaaatttcaaagttttaaaatgtttactttgcatactattgatgagaaaaaaaaataatggagcaagcatcaattggtgttacaactaataaactggctggacattgaagaacatgctgaaccatctcttccgttggtggatgattgattttcacaatttcattttattgtacaagttgagagtaaggaacttgaaggttcacttctgttaaggaacttgaaggttattttgtatgtttagaattttcctggatactgaactacagaaatatcctaggctgtacagttgagaccaggaattgaaatttcttttttgtgctgtagctgtatatttcgtgtaattcaatcagctcttttattattttgctacaaacaatcatcaatcaggctggataacactttttgtttttacaaatcagggtactatttgtagaatactaaaggaacagtttcatcatcttctgtatgagcaaataaaatgcaatattttgaagattgggcaaaagtattacttacaacaagtagggattgctcaaggaagcaagttatctcccaacctgtgttccctgtactatggccacctggaaaattcagtgctatcaaaatttctgcatgatagcaagcttaatgcaggagaggctttttcggaacctgaatatttgttaatgaggt

SEQ ID NO: 58497 - DNA, 20281 bp, Oryza sativa
  unsure (1)..(20281): unsure at all n locations
accagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttcctagttgttctaagtgatgcacgtggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaactcggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaatttgaaagatcttttagtgtagttgaaataacggaattggaacttgtttggtcaagtaggggaaactcaatcaaactcataactgtcttaatggaatcttttccttcttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgactccctttcttttttatttcctttctatttaggtatggtggagacataattcttatagaaacaaaactctctcgcttcacgttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttctctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccatgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataactaagcggtatttgcttataaaaaggattcgatctataatcaatcgaagtaaagggtcttcctttgtggtgataaattgcctacttaactcagtggttagagtattgctttcatatggcgggagtcattggttcaaatccaatagtaggtaggtagatagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaactgctccacagaaccgccgttaaccatttatcgttgaggaggcgtattctcaagggacccatatctacagctgtgttaatgggggcgtggtttggtaatacgccaatttggccactattagtagataaaatgatttctttcacttcacaattccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagactacgttcttccttagatcccttcttttactccgatagtattgcatatcgcaatcgatgcaaagaaaatgaatgcatttccatactataataaaaagtaagtgtaataaatagagaattggatcatgtcacatgacttattccactcctgccatctcggagtccagggaagcgcacagatagagcaaggaagagaaggggggaaaaatgaaaagaaaaatatgggatgtggaaggatcccattgtgaaaagatgttttcggaaggatcgcggggaggtttcaccgtttgagagatccaacagctcgcattgtctggtgtagaaatcagacggcccataatttcttgaagacgtgggtttattgagttttacttttcacttagttagataggcattcattagctagccactcttagcacctaagagcagtcctactattagccagctatagatatattttaacgagctaaaagatgagagagaagaatagtgggttacagatctgtagccagctgcagcacggactccaagacgcagtgtgtgtatgacaggtgggaccatatatcaatagtatagtaagcaactattgtatgaattggctattagattggctatagatgaattagagctagtagttggttatactattaaatttgctctaagaggcatcatgtctgaggttttgtttgaaattcaggatatggaaaacgtaggaacattaaaaacataacataggaaataataggaatatgataggattgtaggtttaaaacggagtgattataaagcataggaaaactgagcaaactattgttcggaagcgcaaagaaaaactcagaaatcttattcactaatagaagtaactcgataacatattatcaaattgtacttagatggtacaagcaactgatgtgtgggccaaggaacagtaaaccatcgttacaaaggccaattgagttgatttatttctccctttgcatcggtcctatatatggaaagccagcaaaaaaaaaaaagagggactctcgacatgacaaacggctcaaaattttttgggtttcagccgttttttctcaccgtgcgataaatacacgcgtcacccatcccctcccgcacaaaaatcccacccgagtagctggtagtgcgctttgcacaaacggcacaacaaaatcccgcttgtgtttgttttgtccgtgtgggtttagtccacaaaagaaaaaggcccatgacgttttatctttgtagaaagcccacatcccgcaaggagaaaaaaaccaaggactatttttatccgtgtaaacaagcccagaaaaagaagcacacatcgtgcaactcttattttttaggaacccacatcctggacttcttttttagagacacacaacctgcacttttctgtgctgctccagtacgtcttgctgcatgaaccatgctggtttggttttgttagtgatatgctctagaggcaatcataaagataattatatcacataatatgtttatatatttatccgacattgttctttaaaatagataacacattattggttaatgaatatgtgattctttcatgagactttttatgttgtatgttactatttctgaaggatccctgatcaaatatcatatgtggaacaaatatgtttaaatgatcagcacatgtattaattgatgattatgtttcatggatcatggtatagagataccaaattaataatgtggacacatgttggggaacatgttgttggatagacccaacatgatacattgcaagagccatatgtgttgtgttatcagtgatctcatttagtgttggtgttgaatccttagacctgagattatcatggttcccaacatatgtagtatcttacttagggactgctaaacgctactccgtaattgggtagttataaaaatagttttcgggtatgctatgaaacatatagttagatatgtataatcaagatgggatttgctccttctatggagagatatctctgggcccctcgatgttatagattatgaaagtgcatggccataccaaaggtcattgaggagtcaatcacaagttatatatataatatatcacatgttcgagtgaatgattgagctattagaggatgtcatatatctagccttgagcttaatcgatatcatgaggcaaaggtgttcatacatgtatacactagatattcagccgatatgatctttatgtatgcccggtgggtcaatacattctgctaggggccaccgttgacacgtggaccgaaaaggagttttcgggttacagctgagtgtacatgaacctacaggattgcacgcttattgggccggaataaggggattagatggagatccaatatgagcttaattcgaatagggatccgagttggagtcctacggaccttcacggatcctatatatttgtgaggggtatgaccggcggaggtattgcatcacgtgagaaagcctagccgccactcccctccacgagcaaaaaaccctagccgcacgcgggtgctagcacatctgcgcgtggcgttccgtccctgtacgtgtggatactggtagagacgccgctgctttgcggtgctgatcagcgtgggagcacggcgaggagaacgcacgaggaggagaaggtcgagccggtgtgatcgactacttcctctacatcgacgcgcgctacatcgcgagggttccttcgccttcttagcgctttcttccactgcgcagcgcgtcgagtggtaacgatctatgatctaatacttgcatggttcctgatttacgcagtaatttatactatcgtagcctacgcgtgtctcaacaggtttcacatttttttttcaagaagtgttcctgccaaacaaaataaaaaggttatattaggacgacatgattgcatacaaatatggggagcaaaatactaggttcagaaaactgtcagagttaattctgaactgttaaatatgttgaaaactacgttaaccccaaagatgcaatatggcgtgatgcatcattcatgctgagatgcaacaaacatgtattgacgttgtgttgctattggaaaattactattcttggcctagttctttttccaaacttcaaacttcaacttcctcgtttttcattagcacgtttttcaaactattattaaatggtgtgtttttaataaaaaagtttctaagtagaagttgtttaaaaaattccaatgaatctattttctaattttatacttcaataattaatacttaattaatcatgtactaatgagctttctcgctaaaaatctctctcaactcacctatcgaacggggccagtagaacaaataaagagcatcagataaagtagcccatagtctcgcgcaccttgcgcttagatcgaaggagtctgtagtttggcgtcttcaggcgccggagtgtgttcataatcttttagccctcgattgtaaccctatgattgatgagtaataaagcttcatgtttccctcgcaaaaaaaaaaaagaacatcagacaatgtgtagcaaggaaaattgtgtagttgttatgactcaaactaaaaataggtgctatgcatgcacagttatagtcaaatttgtgggcacaaattttaattgctacatcaaggaaatttgcattcgcaactatagcaaatttgcaagcacagctagaaatctatacctatagtataattgggaacttcataggagctcccacgttaaccagtaaaatcagatcgttaatttgatacatcatataatcctaaccattgattataaactctaatctacattagcatgatgggcctgatgtaaagcccatccaatcaaccgctttaattatagtgatgggcgtgcgttccactccagtcttgcacctaatcttcgttttcttccacaaccttatgtcaatcaagagatcaatcaatccactgctcctactcttcctctcagagttcaatccatggtgtttttttttccctggtcatcaatgatttgcaaatagtgataatcatttactcaattttgatgcatcttcacgtagccaaatcaaatagccgatgaatcaaatttaaaacagatctatgtaggccatgccctagctaatctagagcaggaagtttcatgtaaatctcacacctccttgcaatacatagacaattgatcttctgattttatctgacaatagattaaatatttcttctttccaggtgattgctagatattataattgaatataccataccagacatgttctcttacagtttttgccagtacttgttttctttaataaagaacatttgttgcatgccttaatacaattataaataatattcattggttcaacatggtccaggataatgttctgcttataatattggtaccttggaaaatttgatcttcaaaacaaaatgtatacaataatttacttcccaagctacggtaaatagcttaaattcatcagtcaatattaaattccatattttacttttttttaaggtgattgctatatgtttctgcagggcaccataatacatttgttgacggttgttagcgatcagtttcaatcgtcaatattaccaaaatagagaagaactagttatacttgcaatgcatatccatgttagtataataatattccactagtattagattcactagccttttatagagaataaccattaagtggaggagaatcgatatcaaatcagatgatatatcaatcggacgatgtcgagaatcaaacttatgtatgaatgggccaagaactcagaaatgacacaaccaattgggccaaaattcacaagtctgcagagaagagaagtctaagaggccaccagccaacttgtgggctagttaggccagcccagggttcggccgaaccaatgccagcaccgatggatgcatggttttgagggaacagtggagattcactccctatggcggttagagggtattaccgactattccaaccgccataaccgtcattatatctacctatttaaagagctcctctttcatttcactcatacacctcaagcaaagctctctcatattctctcgagtttagtttagtgttcttaagctagtggaataggaatagagtagaaatcggagtccagaagccttcggaagagttcggatatggctctagtagctcttctcttctcttttgtaagctttgtactattattagaatactcttctttatacatttatggtattaaaatactttccgagtatatgaatgccaactttatattatgtttatgttgtactgattatactgctagcttatctgggagatgccttggtgcgggtataatgtttttatatgcaattactccatgtcatgacgatgatattagagtagtatctggtagttttggcgtggtgtctagattacgggatatcattatttggggttatatgctgcggatgagaggtgggccgctgatggtgacagctcagtacaggtattcctctacacgtatatatagtcctaagttaattttctggggagggtactcctccgtatttagcttcggttgtatggtcatgacggactgtcgtaaggaacttggcaatcaggggtggcttctcgaagcactaggagggtatcggatagagggtattagctagtatatcagataactaggatatatgtatactatgtatactagaagtataggaatagattctcgttctcttttctttccactttgcttagatattttagtatgagaatgagtagctccatgctgttgtgtcactctgcttagactatgattatattaacccctgcttagactatgattattacaagtaacatataaattattagtcaggttctctctaccatgatctttccacgggattaaataaatacgatacccttggaatactctcgggtaaaatgctacaatggtatatccgtgcgcttgcggatgaactctataaccataatatactaggaggatttctgcaccattgctgggaattatatttctggcaatgtcgttaagaaatatcaacaagcatttctggcgccgttgccggggacgattcataatagagattaccagaactaatactgtaacagccctaggtcaattaccaggtaattagaaatgcaattatcatcacttaggttgcatctttactttattgcaagtaattacatgtgatagcaatttaaactttaaccggcaaaaccaaagcaacttctaaatgaaaaataacttgaacagaagtatatgtgtttaatattttattcaaatattagtttatttatcatcactaaatataaattttgtggaatttttactctctgtttaggcctcctaaaaattcaaaccaactttcagcctaaccaatttcatcttttcaccagatttaaaacacttggaatttatgtgtgaaactttgaaaaatggaacctagaaacctacacctatcaccacaccaaatttctacatttttgaacttgttttacctagtcaaattgaatttaccaagagagggaaagaaaataaatattggaaattgcaagaacgaatttatactcagtttttcacccacctctctcaccctcatagacagccacgacttgggcccacttgtcactgaccttgggtgcctctttagccccacaacacacccatgggcgtgctcccacctcaggacttaagggggtagagaaaaccccatcttcttcctcgcctttcatcttcactgcttgttctttcttttcttcatcaagctgagctctcatctcacttctcctccccaaatcccatccaatagcctaagatcaatccctgcatgtaagaccacaacaatccctatcataaaaactttgcatccatcccaacatcttgcacatgcatggagagttgagagagatcgagaaggaacaaaagagtggtggtttcagcctgcagggctgcagcagcagcattttgttttcctccatttggtaagcttccatttcatccatggtgcctcttttggattccctccatgttgaacatctatagcaatgttctataggttgtccactccattgctgcagctagaaggtggctgcaactcaccccgagttcatatcttttgatttcggttgaagcagccctaggcaacgtctcttgccgtcagcccaagaccttgctccatctcttgccatcagcccgaggccttagcctcgcatgaccctacgtccaggttgctaccatgtgagcgaagtccgatggaagttggagaaaaggggagtgaaaatagaaatcgatttcaaagatatctattgagctaaaagaggtatgcgctttaaaaattcataactaattcatatgaactccgaattcagtgaaccaaatttctgtggattaagaaaaacgtgatcttcaatgttgtaaaataaaaatgaccaacttttgtactggttttcccagtaaaaatataaatagctaatatgtatcccttgtgtggtctagctcttaataaattcgcaagaaattattggtaaaagctaaaattgtgaaaccaattttgttgagcttatattttagtactctttgctgttgtggtgttgtttttggcaaaaatacctcttaaatcttgtttagcagttatttagcattcccatgattttaacttgtaaaacccatatataaatgagataatccatgaaatgccattgacaagcgtcccagaaatgccgttaacggcgcggaatggacggaaccctaacggcgatggcatttttgggacaaaatcgtttgtacgatggcatttattggaactcacacttgtcgatggcatttctgggacttagacgcttgtcaatggcatttcatggattatctctatataaataatgacaacagatacagctgtgaaatattttttcttagaacctgtgagtgatgtaatttactctaaaaataatcattattatgaaatcttggtttgaaatgcatgttacttgtaatgtactaaaggaaatgttaatatttacagaactgccattttcaacacctgagagcttgtcattttcatatctcccaaaccataagtgataatctagtgattctttcaactaaattcaagttaaaatatgatctacccactatatttatttcataatttattgatcattttgcatgtgcatgtttatttggctcttattcgcatattacttcttttcgatagattcggagattccggagagtaacgagccatatcctgaggaggatagtgactaccctcagcagcaaggcaagcacctaagcatatagaacctgtgctttctctaaaaatgatttggttgcaatctatacgtatatatatatgcatgtattgcctagatattaatattgtcgatttatggtgtatgggtagaacctatttatgcatttagttcttgtgatattgctgtccttataccccattaccattggttgggattgcttgggatgtcttattcattaatgcttagccatgcttagtgctaatagaactatagtgatagacagtgctattaattgtggtatatagacaacttgcattattgggcataaaacttgagcacttacactactaaataatggttgatgaaatatgttggacttggacgggtgatagggcaatgatgggaggttggtttcccctgatgcaagtagccccgtctaggttgttaaggactgaacattttgacatctaatcaagcaccctacgtacttatcacatgccttattttgggaccggcttgttcttactagttctattgtgatcatttataccacgttggagagttgtgaggcaggtagcctttggagggcctcgggtgcctaggtttggccgggggtgcctcccgcgtggcgcgcccgccttggtcacatcacgcacgcacgtgactgagtcgtcgggaaggctagcgtggtataggtggttggggtggggctaagaaagggcatgtaatgagcttgaatcacttgtgtaccgcagttgacggggtgtgtagcatttgatctttgttcatttcgtgtgggaccagttgtacacctctgatcagagtataatctattcgaatagtcgcgtcctcggtgatggacaatgcttgatgtgttagtcagttatgttagcatcaaatgtggattattatggatgggattatgttcgatggtggtgttggcatgttgtgccatgttggtatagactttggtagtccatggttgatgatgagagcgccgtttgggctcatttgcttatacatttcagaattatatacttgctgtccataaattaaaatgatgctagatttacttatccttgcttattttactcattaattgctcaataaaattagctttatgcaaatgttgaacctagagacccactatagcctagaaagcttgcatacttctctctcccttatgtatatataattttgggtaagacttgcgagtacaatcttgtacttaacccggtgtctgcaatttcaagagaggattccggttatgagttatgcttcttgtgtggtaattgcttagacgagggcggcgagggcaatgagtgatctcttgcagcttggctcttgcccggttggtttgcattagtggggttgtggcaccaccggttttatcttttgcttatgaactctatttgagacttccgctgctatatttatgtgttgtatgttgggacctcggaccctattatgtgccatgtacctcgctgcactttaaccctattatggtacttgctatgtttttaattgcttccgatgaaagtgtgaggctaatcacattcctggggactagctaagcatgagtaacgagttttgatcgcttgagataattggggatagcgctttggattgagtcactggggtatacttttggtcgccaccttcgagtggttgacgggcatatgacggagtggactggcaagctatcttacggttatgtcttgcgctcactacttgacattccggttattataacagaaggttgtcaaccgcgatcatggacacattgaggacgaatggctatttatgcgtatatggatcccacttctccaatagtatgtggtggtcgcgttggacactggatggtataatattcggggtgtccccaaatactttatatttacctctgtataatcactgccctttgcaggctaaccttggttgttttcacttttgttgtgaaaacggggtagtgcatgactggtttcaacctaccggaaaactttaaggaaaatccagaagctttcttccggagcgtcaagccgcaagtcatcgctccgtagaaaactctaccgataaagaaaccagccataccagcttcaccgaccttcaagaccatggctgataagaccctccgtgaattcgctgctccctttgctgacaatgttccattgggccgcatatcaacatgggagatgtggatttcgatctaaagtccagcctcatcacgatgacacatgctagcccgttctgcggcaagcctaatgaggatgccaatgctcatttgcagcagttcctggagatttgtagtacgtacaccatgaagggtgtcagtcctccttaaaggctcttgtctttgcgcaagctaaaaccactaatgccttaagcaaaaagctagctgtcaatgacaaggtcttagagaacattaatgtcaagctagatggcttcgcttctgctttccaaaactagctgagctttactaagatgatagaaacccagctagctcaattggcttcataggtacctgcaagtgaatctgggagaattccggggcagtctgactcctccattgaaaatgtcaaggcgatcacaatgaggggaggtaagtccactcgtgatccaccgtatcccatgttgatggtcgttatcgatcagtttcgaccgtcaatattactaaaatagaggagaactagtgatgcttgcaatgcatatatctgttagaataataatattccactagtattaggtatactaaccttttgcagagaatgacaataaagtggaggagaatcgacatcaactcagacgataaatcaatcggacggtatcgagaaccagacttacgtatgaatgggctaagaactcagaaataacacgacacactgggccaaaattcacaagtctacggaggaggacaacaaaggaggccgcaagcaaagatgggttgggttgggccagcccatggtttggccgaaccatagggttcgacggaacctcccatggcgctgatggatgcaggttttggatggacggctgggattgatccccaatgacagttggagggtattatcgaccattccaaccgttacaaccgtcattacctgcctataaaaggagctcatcttctcacttcaaacacacacctcaagcaatagctctctcatattctctcaagtttagtttagtagtatctagctggtggaataggaatatagtagaaatcaggagtccggaagtcttcggaagagttcgggtatgactctagtagcttttctcttctcttttgtacgctttgtacttttattagaatactcttctatatacatttatggtattgaaatactttctgagtatatgaatgcctactttacattatgttaatgttatactgaatatacggcttttgtgcgggtataatatttacatatgcaattactctatgtcatgacgatgatattagagtactatctggtagtttagatgtggtgtctagattgcgggatatcattatttggggttatatgctgcggatgagaggtgggccgcttatagtgacagctcagtacgggtattcctccgcgcctgtatataatcctaagttaattccctggggagggtattcctccgtatttagccccggttgtatggtcatgacgggctgtcgtaaggaactcggcagtcaggggtggcttctcaaagtaccaggagggcatcggatagagggtattagctagtatatcggttaactagaatgtatgtatactatgtatattagaagtataggaatagattttctttctcttttctttccacttagcttagataatatattatgagaatgagtagctaatgcttgtgtgtcactctacccttggaatactctcgggtgaaaagctacaatgttatatccgtgcgcttgcggacgtgcgcttgcggatgaactctataaccataatataccagaagtatttctgcgtcattgctgggaattatatttctagtaatgtcgttaagaaataccaacatcctaaccctataggaactaatggtatcgccaaggaagcaccatctagtaattcggctgatgaagaggttcaaccagagaaggctgtgctgcaggagtactgcgacacacggttgctgccgtttcctcaatggattaggaaaccatcggtggacgagcagttcactcgttttgttgaagtaatccagaagattcacatcaacatgccgttgttggatgctatgcaagtgccaacatgtgcccgttatctcaaggatatcctcaacaacaagagaccgctcccaacaaaggaggtggtcaagctgacggagcaatgcagcaatgccatactccacaagctcccagagaagaagaaatattcgaggtgtccaacgatcacctgttcgatcggggcacaatagttcgaccaagccttgtgtgatcttggagcaagtatcaacgtcatgcccaaacacgtctttgacaaattcaacttcacggtattggcaccaacaccgatgcgcctactagtattaaataaatacgatacccttagaatactctcgggtgaaatgctacaatggtatatccgtgcgcttgcgaatgaactctgtaaccataatataccagaagtatttctgcgccattgctgggaattatatttctagtaatgtcgttaagaaataccaacaacattgtattccctctgtttcataatgtaagactttccagcactgtctacactcatatatatgttaatgaatctagacacaacatctaaataaatatggacaatgctagaaagtcttatattatgaaacggaggaagtattttatatatgattctatatagtattttgaccattaatgactgaggaatcagactacatgataacaattttcaaggtttcatcacaatgtctacctctacaggaaatcaaataattccagaaaacactgagaaatagaacagagttttatatatttgctccggcgcatatatctcaacctttcttcattttgctcatctagttatatttgggagtcgtacggtgtgagaaatacgcgggagtagatcgttgggaatcacaacatcacaagataaatttcgctagcgtcggcgtgtatcgaggcacatacaacaaggtgtagcaagcgacagatcgattaattgcagtctgcagaccagtcgaagcacacgtaccacatcggcagccagcagatattcttcaaatatttagtagcttacatatgtaatctacacatgttagttcttgagaatatctcatatagatcaggactgccagcaggaggaagcgacatggcgcatatacacaacgctagacaagatctgctcagaatactcagcacaattatgtataaatgtcgtattcatatacatgtgtttcgaacacttttgcatcaatatttctctttatatctaccgaattcatgccatttgttttttttatgaattgtcatgttttggtcaaggtagtttgattttgtcgtcaaaatttatattttaaaattatacagttccaatatcttattatatttataataacttaaaatacttataacattatctatctatagaatattcaactatccacaaagaagaacatagtaagtttattttcatttggatattgctaaaacattagaaatgccaaacagatacaattctatactttatgagctgctaaagaggatgcatgatataatgatgttaaaagatatctcacatccacaatataacgattgcattgagtctgaataggaccacaattcctgtttacaaaattaaatactgaggttattagcaatataggatttctggaaaataatattaaaaataaaagaaaatacagaatagtttggacaaaagaatatattgtgtttgttcgattagtccaaatgactcttttttaaaaaaataaagttaccctgtgcaacgcacgggttaacgtctagtaagacaaaatacaacatggagatgcgtgcaatttttctgattgatgctatgcaagcacatgttcagaaaatccagaaaatagattgtgcacattaaggccctgtttagttcccaaaccaaaaaaatttcacccttcacatcgaatgtttagacatatgcatgtagtattaaatataaaaataaaactaattacatagattgaatgtaaattgcgagtcgaatcttttaagcctaattgcgccatgatgcgataacatggtgttacagtaaacatttgctaatgaaggattaattaggcttaataaattcatctcgcagttttcaggcggaatctgtaattcgttttgttattagtctacgcaaatatgtgtacgtatatccgatgtgacatgccaaaaattttcattcgcgaactaaactagccctaaatctacttttctgaactagttactattttcctttcaacatacggttaaatttgtataaaaaagcaaggagaacatacaagttctaagattttcagatttctgaattcgaaacatgcacagaactgaacatggtcggtgctaactaataaaacatcatctttaactaaatttgccaactaaaatttcagaacataaataaccactatttgagtggaaaatgcgcgtattgacctagttactagttactattaactgttgaattttatgttggcaacatgaaattttggagaataaaagctgacctgaaaaaagagaatgaacaaatgctgtcccattctttctgaacacagccattttgaaccccttatccacacgcaaggattccctttggcactagtcgaatctgaacacgcctttcacgagaaaatatcaatggttgacaaaaacaaatatgatattgatagcactgtcagtctatcacaagcatgcattagctactcagcacaaaaatattaaaaatttaacagttgatgtattaaaaattcaatacaaatctactgaatctcatcctatcccaaactcaagatgcattacttggccaagaacctatcctttgcagtacatagctcaccttccctacttcaagaaacacacaattttacaaaaacaatcactctgacttcccttgtctgatatagctattagaaaattattagtcctagtaga

SEQ ID NO: 58498 - DNA, 34044 bp, Oryza sativa
ctcatcactgctagatccatcgccaccatccgctccaccgtatcaaacccgctgccgccgggctcccaccccccctcccgcgctctcgctcctgcccgccgccgagctccccaccactctcgctccctctctcgtccaccgccagagaaagtggtcgtcggccgctcccgagctcgccactcccgctcctgcctgccaccggcagaagtggttgccggtcgctcctgctctcgcctgttgtcggccgctcctgatcccgtccgccaccgaaggagagaggaggaggaggaggagcggaagtggaggaggtggaggaagtgatgggtggagagcggagaggatgagtataagagagagagaggacttgatattttaagggtaagcttgatctgatgagctggtggcaggcggggctttgaacatgccgtcttacgaaaatagatttattttcacacgtgatttttgaactgtgtttgagggaacgatttttccataggaaagcagctatggaccacctgcaacctaaagggattttataaaaaaaaaatcgattctgtggtagcgtgcacgtcgatcgtcactgctgatcccattgagacttgagagtcacccactagctaacgcaatctgctactcactagctagtagctgtttctgcagctgcaagaacctattctgctccgacccggcgaaaaaaaaagaacctattctgctcacatgtcgcagctgagatacaaatattgttcattaagctatctcatgcatgcatgcatggtcctaatagtttagttatacgaacagctaataataagtttattcgaatataattcctactgacattagcgttcctgcttccgatctgaattcagaaataatgcaaattaactgcctaataactttattcgatcgaatccattcaactgatggaggctgatgagctgctggtccagtggcgtcttttaattctagttgcatgcaacgtcgcttgcacatttggtagctagcaagaattgagctcagctcatgcacgtagctgtgtcaagatgggcgccatggccaagatccatggtcatccgaggcggtgtctcctcggtgctctcgtcggagccatcgccgccaccgccctcgtcatcgccgcctcgttcatcctccgcccgccgccgctcgccttctccgtcgccgacgcgaggagcggcgccactgacgagaacaaggcggcgttcctcaacctgaccctggtagccggcaaccctagcgggcgcgccgccgtggagtacgaggcgctggacgtcatgctctggtacggcaccaccgactacatcgagaccaacaccagcctcctcctcgtcggcctcgccgccgccgacgaggcggcgctgctcctgcagccgccgcgcaacgcgacggccgtggaggtgacggcgcggacgctggacgacaggtttgtgcaggagatcgtcgccggcgaagggaggagaaccgggctgtcgaaacatgaattcggcaataataaaagggggtagcgcacgagacctaaaagtggatggatgcggagacaaaggatttagacagattcaggccctctcaatgagagataataccctactcctgtttggggatttgaatccgccgagtgtgtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgacctattacatattccatagatataagttattccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaatcaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccacctagaaaatgaccacaatatataatcagcctaagccataatattggtcaataaaaatgcacacttacgtggcgaaaagcaatgatattgtatctaatcaattgcttaaaaacccaaacagcaccttgacttatatataaaaaagtcagcgggacagctatataaagctttactgtttgacaccttttaagatgcattgtaccaactcctaaaaaattaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcttaggccaaaaaatatgccttcgacaccctttaaaggatgacgcatgtgacatgctcccgagtaacaaatcttctgggtaatatagaccaagtgtagctcatatgaatagcttctgatctgaatgattatcccttatgggatactccaaaataaatataataattgaatcccgactggcgcaagtattcggttgatagcccttacggggaaaaataattggtccagtctttgagcatagaaaatagactcatgactatgaatccatgtggaatgtatccgaaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacaatgacaccaatcaaaggtaatgaagttgcataaccatggaggcgaagaaaccagtcggctacagccaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaatacttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggccgatgaagcagaggtgctggtgatgatgtcagtgacaataatccatcaaattaatgttatggctgttgtagatgcttcacttggaggagagttgatgtcaaattaattttgagccttgtatttgtgtagcccccgactctttggttagttgggaaacaactgaacatagagtcgagaattatagcttcttgtcgtcgagtagttattgcttgattgaagatatgtgttgaagatgtccaagtagaaatcatgaatgttggagagccacttgttgtagtaaaataacacggcatcgcatgccgagatgtcgagattcacaacaacgtcgtggttggtgaagtagtaaaacttgcgaagtagcaataatagagtttgccggtgccgaagataataaagatgaagtcgctccaccatgatgacaaagttgtattgccgtaatgaagtgaacataagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagggatgaagatggtaaggccaatcaacactggcagaatcatgcagccatggaagtgcagaaaccagtcggcagccatggcaaacgtaggcagcttgtgttgaagatactgatgcctattagtagtgacagcgatgtagccagccgtgaagaagatagcatcagttggcgttataataggccagccgtgcaggtggaaacaccagtcagcagcggcgaaggcaagccggttggtgaagacgtagacgcccaacaacggcggcataataggccagccgtgcaggcggaaacaccagtcggcggcggtcgaggcgagccggtggtgatgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctaatataaatataatactcgagaaaaaatcaagtattttaaaatatgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattatttaaaaaatacgatataacatctatagcccccgactcactagtcaacggcgaaccagttgatgtagtgaggcgaaggaaaagacaaaatatcatataaagaataaaataaatgatgacttagctttgtaatattccccttggtgatggcagaagtggccaatgtgggaacaaagtcgtccatcaataacaatgaagacaccagtcggcggcgacttaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatggatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccatcgttgccgtcgtgctgatgcgaacaagatcaggcagagaatagcagcgacgattcgtcttgttgaagtcgtcggcggcgaggaatcaaggagctcccaaagtgaagacgaagccggcgactcataaagttgattccatcgcactcgtcgtcaggaaactcggcgtttacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacacgggccattcaacgtggcggtggcggcgcaggtgcggttcaaggtcgccggcgtggtgtacaccaggccgtacaacgtcagggtgtcctgcagcgacgtctacttcgtcgtcgccgacaacaagagcgccgccgccaccgcttcgtctacgcccattgattgccatggctgatttcatgtgtttgtgttgtatatgcgtgtgcatatggtttgattttgggttgtgtgattggtatattgcgaggtctggtctgaaccgtttgtgacgctacctcatattttgcaaatatgattgaaattttaatatgtataacatcaataacatgtttggtgtaatgcatgggttgatcgatgatgtgtaatgtctacatttgtacgaattgtagtgtgactagtaactccattccatgtgtacaaatgtaaatcaattccattaaaacacacgcatttatatgtacgtatcatcaacatataacatgggaaaactcatttcatcccttagagtatcctctcatttttctaggttattaaatagtcactatttgttttttttttaaaatagaatgatagatatatttcattacacaaacatgcaaattcaaattcaacctacaatacaagtacaaaaaactgtgaataatgtgtataagttaaatttaaatttataggtttgttgagcatatatcaaatattggcttatcttgtttttttttcaaacattttgatggcttttcggaacatacacaacatgatctttacatgaaaaaaaacacagtaacacacatcatgtatgtatgtatatatcacatgcatcaacacacagatatatgatgttacaccaatccattgggatgcaaattaatcataatgaagtgattaacaatcaatcaatccaaaaattagccaatccatgcatgcaaaccaatctttactgtaccactccaaccatcagtatcctcaatcaccatccgatcgatgccgcgatcacaccgacgcggcggcggggcgggcaatgccggtgtgcgtgacgagcgcccagagcacggtgacgaactcgccgccgcgcgccagcgcctcgccgtgcgccctcacctgctcggcgtccctcgccggcgccacgtacacgacgatctccgtccacacgtcggccaccagcttccacaccgccgcctcgtcgccgccggccgcctcgtccatcagcgccttccccagcctcgcccccttgcgcaccaccgtcgtctcctccgccgccgcctcgtcgtcttcttggccgccggcgatagccatcatcttcccgtaccgggtggcgtccgtcgagaagtagtagcccttgagacccagctcccgcttgagctccgtggtcatggcgccgtacacccgcgccgtgcagtcgacgtcgtcggggagcatctcccggcggaacgccaccaggtaggcgcagtagcgggacagccgcgtcgccaccgtgctcgacctcgccgccgccgccgcctcctcctccgcgtgcggcgggcacctcacctccaggaggctggtggcgatgtgccatgtgagtatcacctcggcgacgctgccgctctcgcatgccgacgagatcagccgggacgcgttgcacagggcgttcctcgccgccaccgccgacctgccggcgctgagcggggcgacggcgccgtcgtacgccgcgaggtactccacgatggattgcttcgcctcctccggcacggccgccgccggcagcttcagcgggagcctgcagaaccagagcacggagtactgcttgacacggaggtaattgcggcggctcatcctgttcgtcacccactggacgccgcggatggcggcgcggcggagccggctcggcggcttgacggcgtagtcgcagaccatggagacggtgagccagttggagaggaggaagacggcgagctcccacgcctcctcgtagaggatggtgaggaagaggaggaacgtgatggagaggtcaatggaggagaagagcgcgacggcgaccggagtactctgctcaggaggcacctcgtcatcctcagcaagccgaacgacacggcgtagttgtccctcttgatgctgccggcgatgaaggcgatgtagccgttgccgcagagcacgacggtcatgaggcagaggccgagcacgaggacggggaagacgatgtagttgacgaggaggaagaaggggctcgcgagcatcacagggaggacggagtggtagtactcggtgacgaacccgagctcgtcgtcgatcacctcgaacagcgtcgccgccgccgtcgcggcgccgccgtcgttgcacaggcctcggaagatgagctcacggcagtcgccggcctccgcggcggtcaacggcgtctcttcgaactcgcggcgaagcagcttgaagagagcgtaggagaggcagagccgcttcagcttcgggttggacaccagcagctggtcactctcggcgagcgaccacactctgcccacggtgacgacggcgtcgtcatcgccggcgactgtcttgcgcaggtcgacgaggtagccgttcggcccggcctccctctgcaggttctcctctcccatgacggcgtacttgcagctcgtcatgagctcgtcgtctcgccgcgggcgccgctcctgctgctccagcgtctgcgccatgtagccggcgagaagctgcggattcttgccgaaggcgaaggagcgcttaacgaactcaccaatcgcgacgcgctgcaccagcttggcagcggcgacgacccagagcgcgccgaacaccgccttccggccggcgccgtggacgttgaagaagacgaggtaaccgaggaaggcgacacggccggcacggctggtggggccgccgccactggcgcccttagtgccggtgaccgtggcctccaccttcttgcggagcagctcgacgagcagcatccatgcgagaatgagccgcgcacgcagaggcagctcggcgtcggtggcgtcgccggcgccggggacgtcgttcttggcctcggagaagaggtaggaggtgacggggaggaagagggcgagggagacggagaggacgaggcgcgcggcggggcgcagcgtggcggcgccggcgaggaggtcgaaggcgaggaggagggcggcgaggaggagcatggtgagggaggtggcgacgatggagacctcgttcttctggtcggcgtaggaggaggtgaggttgtagacgtaggagcccatggcgccgacggcgccgccgcagtgcgcgtccgtcccgttgaagtagtccatcgttgattgcgacgacgagctagcagatatgatgttcttgctcttgcagctaattaaattaatcaatggatgtaaacatggatcgatgcatcaacaacttgttaatggagatcgagctaattgatcgatcgatcaaataatggatgcttttgttcgaattggtaggtaggtgatctagcaagctggctgagcacacacagagagagattcagtctgctttattcgatttttgtatggtgattaggcatttaggcccaggtgaacaagtccctgggctgcggctggattgggctgaattttctaggattctgctacagctgtgctctggctggcagtgggccttgtatatatgcctttgagccagacaaatttgtatacgtgccatcgttagaaacaggcttcgctgaaatgctatcgtaaaaagggattcgctccaatgccactgttaagctgtgggcattcgctacaatgctatttttggtgtttgttgtatttgcaaaatattttttatcgaaataattttttgggacggttttacccctgggcgtggatgtggttaagaccatccacatatgcgtttctcagagcatctccaacagcctctctaaatcggactctccaaacacccatataactagctctccaattgatttgtcaagccaaactcattcctcgctccaacagcctctccatctacactctctattataagcttatgacactgggacccacacgtcagtctctcctacaccatcttcctcctttttctcttcctcttcttctcctctcagcgctcttcccgcacgacggtgagcacgcagaggctggcgacggcggcggcggctctctacgacgacctcgacgacaacccgtggagcggaggtggagggggcaatgctggatggccgatgagggcggccgcgtcggatgcggccagggtcggaggcggctggcgcggaggagacagcgccgacaacaccttgccgctgccactcccttcatgccctcgacgccggtggccgcgagcgggaggccttggcgatgctcgccgtcgtgccgccccaccggcgcttctcctccgcctctcgaccttgcttccgacctccgatcctcaatgttgcacggacgaacagcgggagatggcgaagatgaagggcgagaatactggaagggcggtagcgggtcctcaactctctgtcaccgccgtacgggagctgggatgtgtcgccgccgctgcacagaggggcgtcatcgtcgttctcattgttgcttccgcgctgagcataattaatcgtgtgcagtcaatgagtacatcgtgacaaattgatctttgttttcttcagtgaggtatctgtcagatgctaatggtggtgggttcttgtcctgagtcctgacgtgtatccgaggtaggctccatctcgttgctctgtccccgtccgtcgccaccgctccaaggccgccattcctctaccaggcagagcaacgaaaggaagggacaagctcgagctcaagatctggtggtcgccgactctgttgagctccggtcctcctgctccctctgctctggcgggccgcgcgggccggggaggtgccgcctcaccgacaggcgatggcggaagggggacggtaggggagtcagggagaggagacgccggcaatgcagtggaaggggatggggcggcatcgaagtgtgcagagaaagggatacggggaagagaaacggtgtgggccccacggttggccatccgattttggctggccaagtttggccagcgaggaacccagtctggccagccaaatagcttggagagtgagatagccaatttgttggagtctgttttttatccaaaattgctaaattttagcttggagagtgagatagccatgctgttggagatgctctcacactggcgtctgcgaccacatagagcgagagggagagaagggcgaagacagcgacaccacgccgaccacgtcgacgctgccgcccgacgcacgcgtgcattgccaccgacagccgacgcgcgcgcgccgccgccgccgcccgacgcacgtgcgcgccgctgccttctcccctatccgcgccgccgcaacagcaacaacagtacatgcatgctttggttttgcaacagctgatcttggaaagggggtacgttgaatcccaatctgtagttgtgaggccggtgcatggcttttgggttggaattctctgataccttttcctgcacaagcctcaagtaaagaccgtgaagcggtctttgttgatggagcttctgcgatgctgttaactctttctggagattcctcagagtcggatgatgatgattcttaacgttgagcgctcaaagaagtcactgcttggctgaggaatgatgatgattcttgatggggaaagaatgcggcggcgccagcggctgttgaggagacgacccagaggaatggatgctgggcggggggaggctgcggcgccggcgcggttggggaaagaatgcggcggcgcatatgggggaaaggcagcggtaggccgacagcgcgcgcgtgagtcgggcggcggcgccggcaggctggcagcgctcggtttgagggcagcggcggcggcggcctcgtgcgttgggcggcgccagcgccggcggtggccattctccctctcgctcgatctgttcgcgttggagccacagagagagaaaagcacgactcctaggggcaaaacggtctgagaaaaatatattttgagggaaaatgttttggaaatgcaacaaatagtgaaaatggcattctagcgaacgcccacgggttgacagtggtattcgagcgaatcccatttgaacgatggcattgtagcaaagcctgtttataacgatgacacatatgcaaatttgtatatgtgccatcgttagaaatagacttcgctgaaatgccatcgtaaaaatgggattcgctccgatgccattgttaagctgtggaaattcgctacaatgctatttttggtgtttgttgtatttgtgttgacgcgaaaaacacacactagtctgggagatctgcttagctccagtgcaggtccaaaggttggtgagatgcaggcgtgccagtcagtttgaccctgcaactgacaagatatgcagatagtagatcaatgagacgatcggctgacaagccgatggagtaattccagccgatgccgataccagccgatgtcgatagggttttaagcaatcggctatatgtccaatgtagataatgatataaaggcaatcggctgttgataatatgatataacaataatataatccagtataaaccaatcggctaacaacatgatataatataataagcgctgatccgaaggttgaaatatatatcggctggaggtccgatgtcataaaatccacaagattagataaacagtgaaacctttgttgtcatcggctaaatccaacttatatatatatgcaatccttataagccgatgcaacgtccagataacttatcggctagcaccccaataaaacagtagcatgaacctatcggcttaacaagatttatattatcaataacaatctagtaggtcgaacctaaccgatgcagcacgagatttgtatatgataatctaatactcgataagccgatagatctgtctaatgtgatggatataacaaatctatttagaacagcattgtgattgtagagatatatcggctaagacagaagatcggacctaaccgagatagtcccaactaaaccgatgtgtctctaaacacaatgcaattagagatagaattaagatatcaggtaggcaaatatatcaaccaaaccagagcgatccaagagatcgaagtgatgcagccttaaacaacaccaatgtagccgatagattcaccaggaccggtggaacgtaggacttaccccttcgccggagatcgaaagccgatgcagccccgcgtcaggtgccaagttccgccggatgataagtaaaaacctcggtaaagagggtggcgatgcgccgagagtattattgatcgagagattgattacaatgaccccgggtgtacatatttatacccatgggtagatactagtccttgtaggacaagaaatgaacttttctaaagataaaaagaaaacataaagtccttatcggacactaaacacactttcctaaagataaaaggaaactaacaaattattcctaattaatagataaactgccatgccgcatcctctttgaactcagttgcttatggataagcttcctttagtagattaatttccttaaccgaatatagcaggaatccgactattggcgacttgataactcccatcggctgatttcgagatgctgaagccgatagttactctaagccgatgatgaccttgggcttaccaaattttggcgttaacacatgccccccagttttggagtgtgatgactcatgctccaaaattctgttctgtctgatcttgataactccaaaactgatcttcttttgcttcttgcaatcgactttcatgagctgataccgtctgcattagatgagccaggccatcaaactcgtggcaaaataatctatctctgataggtgctgacaacccttggaatgcaagatctgcgagctgctcatcacttagactcaaacaataacatcggctgtgaacatcacgaaatctttggatatatactatagccgattcttcttcttgctgctgaactgatatcaaatctgaaagcttcatctcattgatgccagcaaaaaagtagtcatgaaattgcttctcaagatcggcccattctccgatagaattcgatagtagtgatgaaaaccatgtgaaggccgatccagtcaaagacaatggaaaaaatctaactttcggagcctcttcagccgatgcctccccacattgtgctaagaattggctgatgtgttcctttgtagatacatcatcttgccctgaaaacatggagaaatctggaatcttgtatcggtgcagaagtggaactctatcgaaccactcaggatatggctgccgatacatatggatctgttccttaggtctcattccaaactgctcctctactaattttgcaattctatcggccaaatcattgttatattgatgcccatattgatgaagttcttctggccgatattgatatggctcatcatgttgatactgatatgtttgccccccgagccgatattgttgttgttctgcaatctgccccccgagctggcttttctgaataattaactcatcaactgttaccttgatcaaactttgtattgtatctgccaaaactccagattgattaaacaatgcgcgcgatgaattgcttcatcaactgtatcttgaagtatttcaactatcggcttggggaatcgagtcttctgagttggcccttctagtgtcatgttgaaacattgaagacaacgcatttgaaaatcaactacaaactgctccatctgttgcctctgttcctccgttaaattctccactgtgaccatgatcttggcattgacttcttcttcagacatgtggatataaaattcgtggtcctaccaggtgtgccaatttgtgttgacgaaaaaatcgaacacgccgccctaggagatctgcttagctccagtgctggtccaaaaggttgatgagatgcggacgtgccagtcagtttgatcctgcaactgacaagatatgcaaacagcagataaaacagccgatcggctgacaagccgatggagtaattccagccgatagccgatattagccgattccaattccagccgatgccgatagggttttgagcaatcagctatatgtagataatgatataaaggcaatcggctgtgaaaaacatacactggcctggaagatctgcttaacttcagtgcaggtccaaaaatcttgcctttaggttcgtgagcgttccagttgatttgatcctgcaatcaacaagaaataaagacaggaaaatcgtggttaaatccataaatgatagccgatcggccagtcgctgatgacatatcatttatcttccagccgatgtcatatttgaatcgattggcaattataaataagcaagacagaactaaatctactcgatcggctgtagatattaacgatatataattcttctgtcgatgtatatttaaatcaagtgattgggatagatcggtcgccatgccgagacagtataaatcacttagatcgaagtatacattaacataaagattataaacgtctatagcatagccgatcagatagatctagtatgtaacggctaatactccaatactactctatattaagatattaaaacagctagaatatatcaaacagaagtctaatatactttattgcaataagatcttaacataaagggcatatttaatatatcaatcaagcatataaggatataaagtagttaaattaggtaagatcggctgaaaccccgatgctatctccctagataaacataaaacaaactagatatcatgattatagatattacttaatagatcaaactcaaccgatgcagcattaagcataaagacaagcgcaagatgtaagcaagatgatgagaatatgtaagagatggtggatacacgatataatctagatcgatagcaaaatataactctaccgattgtttcctaacaacaagaatcagccgataacaagttatatagtgcgattaatagagattataacgcatatatgataactcgacgatttacataaacagaattagagtgttataaagatggaagcactaatcccgagaacgcaagccgccatgacaagtatacctctggttgaagatcaaattgatgcatctcgacccgaaagcaagaactcgtcgaaatagaatgaaagtaaaaagggtggcgatgcgccgaagttgtattgaacgtgtgttgttttttacatggtcctcgggctatatttatacccgagatacatagtatgtccttgccggacacgactcctaactctattacaactctaagacaccacaagtctttacggcagactcttgcccaaacatatctctaaggaaataacataaaatatcctaattaatagatacaattgcctttctgggactcaatccgtgcgtggcaatccatatgaagcaccttgtcttaacccgatgacgtgtaccaagtcatattaccaaaatcggcttaatcggctaaccttgtccaactcaaactctgccgatcttgaccatagccgattcggacttcagccgatccttactctgtttccgaaacaacttatcccttggatttcgcttcgattttatctctagctccgatacttgaattaccaaatttggtcattaacaaacgcatgtgaggactgaggtgagagatcttgagttcaaatcccacatctcacatatatttttgagaaaattccctatgtagcatcagaaaaagttgctcttccctctatagcatctaaacttaaaaaattcactacctagacaccctcaaaatttttcttccctatctggcatttctgttactccggttagcctccaccgtcaaaacaagagacatggacccaccatcaagagaccagcacgggcagccagccccaggcttactcggccctgtagctcttgctctcgtgacccattacagtgctcgaccaagcgcaagaggagagagctcaagtggtgacgcgcgacctcgccggcgccgccaccgctgtgccggctgatgcggtctctgtcaacgctgcctcccacacgtccttgttggagatggagcccaagaagtcacacttcgacagcgcgagccggcagcaggacctcgagctcgtcggccgcctcttgggcgtcctgacggcaacgcggagctggcggggagaggcggcgcggtttaagcggcaatgctaacagcggcgcatgtggtgggcggcgccagcgaggtcgcacgtcgctgctcgcagccatcgcctctgctaccagccgtgacccccgaaccccatcgctgacgatgtgctgtagcgtcgtactcgccaacgacggccactcgtctgcgagagacaagtcgccattgccaacggcgtccgctcgcagctgccgagcctgcaggtgcgccgcctgagccgctgctcgtagtcaccgcctccgctccaagccgccacccccgaaccacgccgccgacgatgtgtcgcggcgccgtcctcgccaacgatggccgctcatctgggagagactagtcaccattgccgccggcctccgctcgcagccaccgagcctgtaggtgcgccgccagcgccgctgctcccaactgccacccccaatccacgccatcgacgatgtgctgcagcgccatccatactaacgacgggcgctcatctgtgagagatgagtccattgtcgccggcctccacttgctgccgccgagcccgcaggtacgctgcctgagctgtcgcccccagccgccaccctcaaaaacttaaaaaagggcaaaaccgtcttttctcctgctagttaacaccgtcaccctcaaaactaacggaagtgccaaacagggaagaaaaattttgagggtgcctagatagggaacttttgaagtttggatgcaatagagggaagagttgctatagagggaagagcaactttttttgatgctagatacggaattttgtctatattttttgacttggtatgcatctttagtcctagttattttaaccgggactatagacatctttaggcctgaattgagtgtcccggtttttttacttgttatgcatctttagggtatagacatctttagtcctagttattttaactggcacacatctttagtcctgtattgagcgtcttggtttttttacttgttatgcatctttagttctggttattttaaccggaactaccggttgcataaccgagactaaaggggttacaaaccaggacaaaagatgggttccccgctagtgcctgaaccttagttagtgcatatcacctgttcattctgtatctgaaagaagatttttgcactgcttacttttatataaaacatgcacgggatatatacatgatttctagtacagaattgaaacttgaaagttaaaaatgagagcatatgttcttcagagacaggctagcagaagtgcgcaagcaagttcgaaggcgtattttacgatgaagcatagaagtagagattagtgaagatggagcgcagagacggaggatcagccttaatttggaaaggaaattaagactgagctagtgatcccttccattttgaaacatatcattattactaaaggaaaggaaagattgagcgtacttgattaccaaaacaaagaaaatcccataaatacgatacccatctcacgccgatcgatcaagcgcagccatgcccgccaactccggtggacggccaacccggcgagcctggccaacctggtgagcccggccaaccaggagggcgcggtcgcggaggccgtggtggccgcggcggcagtggaggcgctggcggccgctttggggctcgccgagatggcgcccgaggagggtggccccggcggtatcggcggcgagggtggccccggaggggatggcggcccccacggtatcggtggcagcggcggggacggtggttgcggcggggtcggcggcctcggcaggaaaggtggccgcgggggtcacggtggccgcggcgggaacggcggcttcggcggtggtgacggcggccgcagtggggacggcggggaaggtagagtaagaggccgcggtggggacggcggagtaaattaaattagcaactttacctgatgagtaatgcatttatattttaaaactatactaggccaaataaagggttgcaaaatcgcctctctattgcaatgatagttgcaatatttttctgcattattaagatttttgagaaacaggagaagaaaataagccaatgttgtatttctgtttctatggttgaaattaaacaagcagcacagcatcaggccaatctatttcttttgtatgttctttctatggcagtaatgagaggagataaaagttaattcagaaatcagaactaattagaagattgccacttgttcaaaaaaaaaagagaagcttttcctatcagtacaggtccaagcatggatagatggctcagtgcatgcacaatgcaatctcaagtggaagtatagattagactatctccaacaggctaggcatagcgacacccaaacccaaaatgcgtgctccaggctactgtagcggaaaaaaacagggtccaacagagtacccatactaaggacctattttaggtgctagccgaggcggaacccaaatatgagtgccctctctcctcgaccgaaacacctggcgcaactgtttcgcgggaggtggagagaagaggaaagcgcacctggccccggcgatagggaaagctccgccgccgacgagatctgctctgagctagacttcgcaggtatggatctctctccaacccaccctccttcatccccggtcccatctctcctctctctggacatggatttggccgcggccgctcgcaccctggccaagggcgcatcgcgccgcatgctgtgcctagccccagcgacgccgctcaaatttttgttgaccgcaccttccccagcatgtttgtgccatgtttgattgaatctctgttgtaataggatgatggataaaagtattggtggctcaagtgctcgcgctggtgaatctgaagaaatatttgggacaaatcagtgggcttttggtttttctgccgctttgcattcttttgatgttcctccgaacccccaggtttattgcagccatgcatatgatgattttctttatttacatatcaatacatcgatgattaacagtccttttcatcactagttcaacatgcatggctcgtcccaaatgtcatgcccacctataaatgagcaacctagccaggggttctccattgacaacaacattggctctgaggaccctccatcattgaaatcacagagggctgcaaagaagaagaaggtgtccaggagaggaactgcattcaccaaagaggaggacatggtggtgtgttcggcatttctgaatattagcaaagacgctattacaggtaatcatttgcaacatcttttatgaattctttgatgcccaaataacatggtggcataacatgcaggtgtgaatcaaacttcaggtggttattacaagaggatgcatgattatttcaatgagcacaaacctgaagggtccaaccgtagccagattgctattcagcacaggtgggcattgattcagaaagcgaaacaagttctgtgggcacaaagcagccgttgataggctaaatgagagcggaaaaaatgagcaggatcgggtatactttcactcatattatcctccatctatctaatttacatatggttactttctaaccggtttaatctatatttatttttgatagaaggtttaatctatattcatatttgcagatagatgatgttgtacaaatgtacgagaagacagaaccttttaccttcatgcattgttggaaactacttcacaacgaggccaaatggaacaataagtttcttgagctaaacaactctacatcacctgatcgaatggaacctccttcaactcaaggccatactgtagccggccatgcagaatctgggaatgagaatatagacacagcacggcctgagggtagggatagtgcgaagaggcgtagatcgaagagctatgcagagacatcatcatctagtacagcagttgaagtcctccagcggttgcaggagaaatcagagaagaccgaactgaagcaagaccagcagatggttgaaatccttagtaggaaggacggaaaaattaaaattcagagggatcttttcaaccttcagaagaagcatatgaagatgagtgtgaagcagcacaagaaggaaaatgagattagggagaagcagactgaggctcaactgatgtcagctgagtctagtattatgtccattgacattgagaaggtccccccttatctgaagaactattatctaggcatgcaacgacaaatcatggagcgcagaggattcagtagtcccttgaacaacggagactaaggagcgtgtgtgttgaatatatgtccaacttggttcgcttgagttgaacttttctattgtgtgcaactttgtactattatctattggagtgatgtgtgtctgttcatgtagtgactattatctattggagtgatgtgtgtctgttcatgtagtgactattatctattggagtgatgtgtgtctgttcatgtagtgacaattgttcatttcagcaacaaaatgtcatatatttcttatcaacaacaaaatgtcatatatttcttaccaacaggcaacaaaatatctttcagccactatagttcatgtgagcagccaacaaaatacaaaggtcttatgagtaggcagcaaaaaaactaagcctacaactaaagactagttcctgtgatttgcagcaaagggaccagagcattggccatatagcatccacatgtgttccatcaagtcattttgaagcaatgctgctgtctctctgtcctgaatgatgttttgagcatcaacaagtttttcaattgccgggatttccctatcctggttaataggtgggtcggacactccaggccattctgatggatggacagtaggtagctgaaccccacgctcatcttcaactaccatgttgtgaagtatgacacaagcacgcatgatggaattaagtacttttggactccataaacgagctggcctatgcaagattttccacttagcctgcaggacaccgaaagctctctccacatcctttctacacgactcctgttgctctgaaaataccttttgtttgttgctaactggcaaagcaatgcttttcactagtgtagcccaatcgggatagatgccatctgctaggtagtatccaagggaatagatgttgtcattgatatggaactcaacagagggtgccctccctttagccacatcatcaaacacattggaacgatgcaaaatgttaatgtcattgtgagaccctggtaaaccaaagtaagcatgccaaatcctaagatcctcggtcgccactacctcaagtattagagttggcttgcctttgtgccctctgtacatgccttgccaaccagtcgggcagctagaccattcccagtgcatgcaatcaatgctacctatcattcccggaaaacctctggccaaattgatgcttaatatgtgctctatctcctcactcctgggaggacgaagaaattctttgccaaacaccttgatcatagtcataacaaattccatcagggtcttcaggacagtactttctcccattttcaaatgatcatccaactcatcagccggtccaacatatgctagcatctttagagccaccgtgcacttgtgaagagcagagaatcctaactgcccagcagcatttctcctctgtgtgaagaacctgttcttggctgtgacctcatccactattcgaaggaacaattcccgtctcatgcgaaacctacaacccaaaattacagttgtttatcaaattaattcaatatatctgcaagaatagtgagcaatatacaattgatcatgaaaatgttggcatttccttcaacacaaatatttcatgaaaatggaaactgggccaaagattctaccttctcctgaaatgttcttcattgtacagtggacgttcaacgaagtagtcctgattcaattgccagtctgctgcaattcgatcacgcttgtaagtcttgtgaccagggactgaacctccccaagggcgttttcgtggcgtctgggtgaggatgaccactgcggccatgatctcatcgtcctcggagtatgctgcggctgtcccgaacattgacattttgacgtaactccaagccatggccaccacaacggaagtgcaggtctaaagccaagccaatttagggacaaattagccacaaattaaaagggaatgtgacatcgaacaagcaaatgctagaaatcagattacctgtgttctgattgactctgctgcgccaacgttcggccttgtccgaacggtcgctcgccggcggctacctcgctgccactgagactcccttctcacatgcagccggggcggcaaaacaatcctgccatcgagccaaccccacagtcccgcgccccgcgcccggtatatctcgcacgacaccctccgtttcccgcgtaaaaatttcatcgcgggcccgcgaaggaaactgtctgcattgcagggtttccatttgcgttcgctgttggagaaggcaagaaataggtgcatgacccttttgccgcaggcgacgcataccgtccaatgggtctcctgttaagggtattattgttggagatagtattattcagcaatataatgcagaaaaggcgagcagaaacatcatatgtccaaaaactatttgcccaccttgagattaattatgtactgcagagcttcatggtgaaacagttggctgaaagtttgaattatttggcccttttaaatggcattgatttcctataaatgataattaagctaactaacaaaaaaaatatttcctccgttacataatgtaagactttctagcattttctaaattcataaagatgttaataaatctagacacatatacaaaacatatgcattgattaatagatgaatctatttaaaaccaaaatgtcttacaatatgacacgaagggagtatccttttaaagtacatctgcaagacagagatcaggtggtttatctctgtaccaaactacaaatatgtatgatccaaacatatatgtatgatctgcaacatgtactactgagtggttgctttaatttgttaataatatgcctagctaccaccatacaggccacatgtgttttaaatgtttataattcgcaagttctttaaatttgacatttaaatgtgtgaaaataacatatattatataaaattaaatctgttcagttcacaccttgcggccggctgatagtttcacccacaaaaggaaaaagttcactgcttgttttcgatgtaatctaaatactccagacagatagcatgataactcactgctacagaaattattttttcagatgagaccccattagattgcaggcgggccataaataccagcgccagcaaaaatcggtcccctggggggtcagttgatggacaggaaaccggttggtggattgcatgcgataatgcattatcgtatgcggctactacctaagaggatactaattaagaaggaacttaatatcatattcttgcataaagcttgatcaatcatagccgtaaaaatggtgagatagagatacagtgttaagtgcagctctccaatactagctataagcatatgaaagcgagttggtttatcgttgagccatggatgtgcacgttttttcgcttttcgcagaaagagacggagtgtgatcctcttttgtatgttggtccatatacatacattttatttggacgaattttaaagggtgtggagcaccaaagctggtcatataaaggcgtataaagacgagcactgtctgaattcaggatcctaggccggctaaaccgacactaagatactgatccctcggatttttaatgcatgacacatttacttttagagacatgtttgattatttatgttattaatactttctctgatttttaataatgcatgacaccttcaattttgaggacatgcatgtttggtcatttcttatctttttattaatttctctctctaattaggccaaaaatgtcctcagcaaattattagttgtacttgtgtcgtgatacggtttttacgatgtttgtcggcaaattacatgaattttaaatgtcatgtagcaaaattcatcattaataaattatgttatttcattcattttatttattttatcattaaaattactttaaacataacatatatattttacctaaacttttaaataataaaaatggtcagatgtacgttaaaaattaatgacatcacacattaaaacctaaaaaaaggagagtagttaaatgtgggcgcacaaacagtgaacaaatcatgtaaaaaggctatagatatgggaaaagtagtacatgacttgataagatggacataactcgatattacaatctcacacgagcacaaatgacatcaagataattaactaattattgcagacaacataaacaaaagagctttgctagctagcctaaactttagcagacaatgcatgctgcaagccagctactttaatccctttccatagagatcatagatgctctactagtactgtaggataaacatgtcatgagaagataaacagcgattaaattgactaattatttcatcaaccaagctaattaataaaccaagctagtttggcaagcaagcaaattaatttagcaggcggcgctccggaatcgaatggccttgccggggacgtcgtacaccacctcgagcgtgcgctgctgaacgttaccgatgaaccctggcatgcggtcgctggcggtgggcgcgaaggcgaggcagccttggagcaggatccccgccgcgtcgaggttgacggtggccccgccgtcgaacaccagggcgatgctgggcagggtgatgctgcggacgccagaaaagtcgtagcacgtgtcgaggatggacaccggcggcgccggccggtacatggtcatcgcgctcctaaacgccgcgcgcagcgcctggtacgccgtcggcggaatccgcgagatgacggtggcggagtcgatcacagagctggcggagaagacagtgggcggcacggggagcgggcgtcccgccacgatgatggagcggaggagcaccctgtagaacgtcggcgacatggtgctgctgctcagcaacggcgtggagacgaaggtcgggacgagcgcggcgcgctgcggcggcacgccgaacatgatgaacccgaaggagctcgtcgacggcgggacgcagtacgagaacaccctgctgtactgactcgccgtctgctgcacgaaagactgtgagccgccgccgagagccagggttccggcgacgtcgtagctgaaggtgcttccctggtcggcgtgcgcgcagccgaagaggaagcccctgacgacgtcgtaggggcccagtgtgaggtcgtcggagctatacgtcccggtcgccgtcgcgccgttggcgtaggtgatgccgaactggcactgcgagttggccaagcagccgcggcggtaggggccgagccgcgcgcaggcggcggagctgcaagggacggcggcgtacgtggtcgaggtggccgggtcgaacagggggtcccgctgcgggtggcacaccagcagcgggcatggctggcattgcacccatggcacgtcgctgcccgagtcgatgatcaccgtctggctcaccgccgacgtgccatccggtgccgaattagtcgtcgccgtcgttcctaacctcgtcgtctataataacaaatcaatcaacttatatatgtataatagtagagaattgaagtacataaaaatatacgtagtactataaattcattcacatatacaggatgatgagatatttgttatatatatataggagtatcgagcaaggagatggggcttacagttagatggggcttttggccaatgccagcaccagtagcgacctggaggctacttaccacatgagtgtctccaccctcaacaaacttatgtggatccgcgccgtcgccggtgtcgccagcgagcctcttctggatataggcgacgcggagttggtcggcgtcgagcgccttgcccatggaggccacatcgtcgtcggtggtgctgttgtccgtgtccgaatacgccggcgagcatggcccggtgcccaagtgctgttaaccgacggttcgttacttggagcaactgtgcatatgacactagtccgttcgtcagaggtttaaaaaaccttcttatgaaaaactactccagtatgatgtgtagacggttaagatatttaattatttcattagaaaagacatatatatatatatatatagtagctctaatctacacccctctcttagaataactattctacacccctctcgcatcacggcatcacccaacccactcctccctcccgtgggcctcctcccgcgcgccgcccctcccctcttcctcccgcacgcgtcgcgtccctccccctcctcatttttctgtcgagctcccctcccagcgccttccccctctcgatcccctcctcctcctggcgcctccctccctccctctctctttctgttccctcctccccctccgtgtctctctctctctctcactcccgttccttcttttcttttttttttctatttttccaccaggatcgatcccttctctcttccttcttttctttttttttcctcctatttttccaccgggacctcctcccggcgcttgatcgatctcttctttttttatctcatattttccctcctcccaaggtctattctctttcccttcctttgcttcaccttaaaaagaaaactaaaaattaaaatagcaaaatcaagacttgaacacatgaccccatagtttataataagctctcctaaccaatttacccaataacactatgtgattaggggttatcgcttgcttgctttctacctctatataaattttatgagaacaaaccagttatattactataggaatcgtaccttgttactatgatttggtagtaatattatcgcagaagtgcagtaacacggtacgttactgcgaaatttataggttattactgcgaaatttataggttgttactgcggtttttacagtaacatcatgatgaaactgtagtaacagagaacatatgttattaatggtactactacaataccactacttgtgcatagctaaattattaaatctcaatcttgtgcaaaatacaagtgctaaaaatacatgtgcatatgcatagtcacaagttaacacaaagtgctaaaagtacttttcttcgttcatataaagatacatagtagcaagcttagtacaagtaaactattataatctaatctttaaacaataatacaatagtcttgttactacacgataatcgagacaacatgcttaacgaaactagatccatcatgactattttataacgttgttactgcggaaagtagccgtgttactatatattgactgtcgcgttattacgccgttccagcgagacgagaactaaaaaaaaagtaaatatcaatctttagagagcaatatctctcactttatatattatttttctaatccgtctgcaccataatattcgtaaaaaagtgctcaacaaaactagatccatcatgactattttttgatgtcgttactgtgagaaagttgtcctgttactgcacgatgaccgttccgttactgcagaattcctgtgagacgaggacaacacagtggtgggcgggggagggagtcaatggacgggtttgaccggcgggagggggctttgaccagcctttgactgaggtgggaggggggatttgggccctatgaagggtgggggaggtgggattggcccatgggagaggggggggtgtagaatagttattctagaggaggggtgcagaatagattcactatatatatatatatatatatatatatatatatatatatatatatatatatagacacacacacactatatactatatgtttattatgagaactttgaaaaattaatatttaagatgctctcaggaacaggaatttgtacaaaaatttgcacatttcagcttcatcatatatacttcctcagttttttaatagatgacgccgttgactttttctcacatgtttgaccattcgtcttattcaaatttttttttgcaaatatataagatataaatcacacttaaaatactatgagtaataaaacaactcataacaaaataaattataattacgtaaattttttaaataagatgaatggtcaaacatgtgagaaaaagtcaacggcgtcatctattaaaaaatggaggtagtatatagaagaaattatacccttgtggccagagcaggaagcttttggtttcatggagctggttgctatgaccatataggcgccgggttcagcgtctccgccatgagcaacaagattaatggagctagagaggacgaaaagcacaaccagtgctgctacaaacggggtcatggtcactatgactagatgtgcttgccgatagctaagctgttgatggctactgcctgccttgcattgcggatgtggaggctgcacgtgttatatagggcatatacgtacggatgcgggtttgaacagtacttgacagcacaggttatatatacagaataatatatgtatataatgcccctcgcttcttaaaatgccaactaattaaatacttatgtgaaaaaaaatgctgaaacattgatgtcataaaaatatataccgcatgtctcgcaatattattattcctagtatataaccataaactcgatttaatttatcttatgtatcgactaaaaagcatttgcagttggacttgacgtttctttttttaaagcaaatattatcttacatgtttattattattttaaatgaaatgaatttgaaaaactctttgttctgattccgatccataggtataattgtactttacatgtacaacatactcactactttttcaaaaaaagatttttcctgacacatatgttttacattttcaggcaaattaaaaaaaatcccgcttgtgaaaataagaagaagcaccatagatctagccccgtctgtaaaaatcaatttttacatgcgaaaatacctttatttccataggaggacctctttaagtccctttttttacaggcgggacataaagaggtccgctcgcaaaaaaggtagtagcgctattaaagccacgtggcacaactgagctcgagctagctctttctcatgtctctggtcctccctctctccctccatcactctcagccaaggagcaaagggtgttggcagtgggggcgagggcagtagaaggggcggtaaggcggctcgggacaagcgcagcacggtggagggaggagaggggacaggagcacggctcggcggtggcaatcgcttctccctcttggctcgacggagacggcggcgaagggaatagtggagggtcttggcgtgggcgatggtgtagtggagggagaggtggctcggtccagatctgctaacttctccgctcccctcccttctctctcttctcctagatccggcgtggcttggacgacaatcgagctcaggcgaggcggagaggcggatcctcctacgacgagcccaggagtggcgaacctaccgctagcaagcttcggcttggcgacggcaaggacgaccacggctagggcttcatctcggcaacggcaatgcggtgaggtagcttctacctggcaacggcgacgacgactgtggcgagctcgtttgattggttttttttgctgtgaaattgagctgaaaaatcgattttggtttggattcagttttgtttgcaaaattttaggctggattgtacgattggccaaggattttagcggtcagccgagattgaaatattttttgtagtcggacaatataacttagccgcctgcgaaccaccaacgaaaatctatttccgtaggcggctaatctccgcttgtaaaaatactctattttcactgacctttagttgcaagtggcgcggtcagccaccagcgaaaatcgattttgaccgcctgtgattaccctttttctagtagtgacttatcaaatcaaattgaatttgtgatacaactcttagcatatgttttcgtagaaacagtcatattttgtatgtaataattttctagaattatttggactaatatattgtcgacgttgtagatcctgactacgatggtgctggggtatacacgagatcgaggtaaaaaagacagagacaaggattttatactggttcaggcaagaagccttacattcagtttatatgtaattatgagaataggtagcaattacaaaggagaacaactgagtcacggaataccgacgaactcccgtcaagatcagtctgacgagaccaatcggtgatatggctgtgggtcctccagattgctttggctatggcgagatcaaagatagcgctagatccatcttgtcggcctccaatagcactagacggggtctgtttaggtttatctctaatgtcgatatcttgcggcgagtgttgatctctctatgttcgctcccctctctcctcctaaggggctttatatttatacccacagatatccctttgtctaagtaggactacggagacaagtatggatacgatccgaatagttcatgtggaactctgcttctccctccttatccgaactccttctatatacgaggtaaggttccgtataaaaaatggtatatggtgggtcccatcgagcttaattgactagtattgggtatgtgttctctataaccctgacatatataacttgtaacttctgtagatacaatcattttttttagacaactaaaaaaccgacatacaccactataattttgatctactacaagggaatggtcggtgtatttcctttttctattaaaatgttaatttcaaagccttagaaaaaacacggtggtggctttttttcaagctattttgataatacaaattaaatactttccctgcatgcatttgtatggaattataacttgcaaaatacaggtcatgcatgcaactttttcagtaaattgtgcttgtaacatcattattgtaccacggttggatgggactccagaggagcaaagctcatgccgtgttggcatttgcaaaaaaaaaaaaaaagaataagaaaagaaaagaaaaagatctcctgggaagaacatattcatagttttgtttctgtttacgtacaaaacatgaagtcatccaaaaaaacacgccggaactaagaatatcattaagaatatccaaaaaaagactcagtgagagcgatgccaagatgtgtgattgtccgtcttcgccatgtttattgtctcacgtatgcaaagtataaactggttacaagtacccggtccttattagctaaagtataaaagaacatggtaattattgcaatttgcaagcaccacatgcacagccttgggagtcggcaatctattcagaacaagacatcgatacaaattaagctaccaagtacgaactgatcctatttaattacctatatatatccttttcgcaagcaaaattaagcaccaccccggtggcttcaccactgaccatataagttaaaatgaatcctcatgaggccccttcatcactactcccaacctccaatgacagctttggaagtagggatgaaaacggagcggatacggacggataatgctcataccgtattcgttttcatattttttactggatacagaaacgaatacggatagctcgaatacggaaacaaatacggattatctcgaatacgaataagaatcgaatatgaccggacacgaatacggaaacaattttttctcggaacacgaaaaccaagttaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccgaatagcactgttcactggatatccgaattattatccgtatctgacggaaatcccgataccatattcgtatacgtatccggcaaaaaatatccgtatcagaactatccgagaattatccgatctgaaaggtatccgtattcgtttttcgccggagcggacggaaactatccgctccgttttcatccctatttggaagttcccaaatgactgcatgggaccactttacctcgttctcttagagcaagtttaatggtatagctaactattgactattagtctatattatagctaacttgg

SEQ ID NO: 58499 - DNA, 23877 bp, Oryza sativa
ctccccctcccacccttcccaccccacccacccccaggaccctaattcgtcggcccttcgctagagtttgggttgtcgctggcgccggagaaagaagaggagttcgtcggagttggagaagaagcagttggagcacgaattgcgaagcacatccagtgaaccaaaatttgcaaggtttggaggtaggttttctgtcgactgaagtttagcaattctgttttttttttttcaccgtgctggatggtttaattttaactacatttttttattgtatacagagcgttgctattttacaattgttggtatttcttaacgacattacagaaatataattctcagcaatgccacagaaatacttctggtatattatggttacagagttcatccgcaagcgcacggatataccattgtaacatttcacccgagagtattccaagggtatcgtattaattttatcctgtgggaagatcatgtagagagaacttgattaataatttatatgttacttgtgataatcatagcctaagcaggagttaagataatccaagggtagagtgacacacaagcagtagctactcatataatatattatctaagctaagtggaaagaaattagtaaaggaaatatattcctatacttctagtatacatagtatacatacattctagttatttgatatactagctaataccctctatccgatgccctcctggtacttcgagaagccacccctgactgccgagttccttacgacagcccgtcatgaccatacaaccagggctaaatacggaggaataccctcccagggaattaacttaggattatatacacatgtggaggaatacccgtactgagctgtcaccatcagcggcccacctctcatccgcagcatataaccccaaataatgatatcccgtaacctagacaccatgtataaactaccagatactactctaatatcatcgtcatgacatagagtaattgcataagcaaacattatacccgcactaaagcatctcccagataagctagtagtatattcagtataacaagaacataatgtaaagtaggcattcatatactcggaaagtatttcaataccataaatgtatatagaagagtattctaataatattacaaagccatacccgaaggcttatagaagagaagagaagagctagtagagtcatgcccgaactcttccaaaggctttcggactcctgatttctattctgttcctattccactagcttgatactactaaaataaacttgagagaatatgagagagctttgcttgaggtgtgtgtgtgaagtaaggagaagagctccttaaataggcaggtaatgacggttatggcggttggaatggtcggtaataccctccaaccgccatagggggtgaatctccaccgttccctcaaaaccctgcatccattggcgctggcattggttcggccgaaccctgggctggcccaactagcccacaagttggctggtggcctcctggacttctcctctccatagacttgtgaattttggcccaattaatcgtgtcatttctgagtttttggcccattcatacataagactgattctcgacatcgcccgattgatttattgtttgtgttgatatcgattcttctccactttatggtcattctctgcaaaaaggttagtatacctaatactagtggaatattattattctaacatatatatgcattgcaagccttactagttctcttttattttgttaatattgacggtcgaaactgatcgataacgaccgtcaacaacaatcactgattctctctttatagtatacttgagaactccaaaaaagtgcatgttcccataaaattgttgcatatacagttaacaaaattaaatatgtacaagtatttatccgaagacatatatgtgtctttagtacaacatattaacaaaaataaaaatatgtattagactggggcatccaaatacatgcaaacataatattgagatgttataaagcgcctctaagagcgtctccacgttaattcagttatggcgcaaatgtttgttctaaaaatgattatttatttatagagaaacagctaaaacgactatatgtgtttatggagacgtgcttcaagcgtgtccagtgaacgtctcagattttgtagaggtgttttgtaaaatgtctctatatttttgagacggtcctgggggaggtgttcctataacgctttataaaaatgcctcaactatctactagagatgaaacaaaacgtctctattctttataaaaatgtcttctttgggggtgttttgttttagtggggtcctattgccacaccgatacaaggttccagacttctccaagtttttagggcaagatgatatatctacaatggaacacatcagccgattcttagctcaatgtggtgaagcatcggttgaggaggctctgaaagttagattttttttccatcatctttgactggattggctttcacatggttttcatcattaccatcaaattctatccgaggatgggccgatcttaagaagcaatttcatgattacttctttgctggaatcaatgagttaaaacttttagacttaatatcggttgagcagcaagaaggagaatcggctatggaatatattcagagatttcgtaatattcgcagccaatgttatgatttgagcctaagtgatgagcagttagtagatcttgcattacaaggattgtcagcacctatcagagagatttttttgccacgagtttgacagtctggctcatctaatgcaaacagcatcggctctagttttggagttatcaagatcagacagaaataattttgaagcatgagttctcatactccaaaattggggggcatgtgttaacagtgaagtttggtaagccccgaagtcaacatcagagcttcagagtcctggaattagccgacgggaattatcaagatcagttctggagttatcaagaccagaattttgaagcatgagttctcatactccaaaattggggggcatgtgttaacggtgaaatttggtaagccccgaagtcatcatcggcctagagtcagtattggcttcagagtcctggaattggccgacgggaattatcaagtcgccaatagtcggattcttgctatattcagtttgtgtttagtgtctgattcggactttatgttttccttttatctttagaaagtttctttcttgtccaaccaggactagtatctacaaatgggtgtaaatatgtatacccggggccattgtaaactatctctcaaatcaatacaactaccctcgtcgcattgccaccatctctactgaggtttttacttatcatccggtggaacttggcacctgacgcggggctgcattggctttcgattttcagcgaaggggtaatgtcacaccctgaagttcttctcccaagccgaaattaaattaataaatgatctcaagaaattgtctgtgtaatggcaagagagaaaccctaatttaataaatgcaaataaaaatcgaaattggcatatggaatttttcttgggttctacatgtcaaaatatgctaacaggatttttaatggaattttcagagctctagaaataattttaaccaattaaaacttagcacaagcaattattaaatccctagaaattctttttcctttttcctttccttttggccccctccttttccttcttgggccactggcccatttccctcctcccctcccgcgcgccccctccattgggccggcccagccgccccgcgccccctcctcgctccaggacaccgacaagtggggcccacctgtcgggcccgtccccaacctccggccggcgcccgcgccgcgcctgcaaccgttgccgcctgcctctcccgcacgtgcatgttgcctgctcctacgccctctcccgcacgtgccgcaaccgccgccccactttcccccgccccccgcgccgcgcccgagatggccgggattcaaaaatcgaatcccgcctctctctcctcccccacctcccccacttcaccggccactccccgcctcccccggccacatctagcctccccggccctatataaagcacacccgccccctcctccacctttttcccgttctcgccgagctctcccgtgccctccatcgtcctagcgccgcgcaccacccgccactgccgctttagccacctccggctgctgctcgccgccgttagagtcgccgccgagcctcgccgtcgcgttcgccgcctcaagcgccacaccgtccacccctccgttggccgaatctgccgccggaacttgcctcccaccgcgcaccggtgagcttgccattgccaccaccttcggccggcgtctccgctcgttttgctccccctctccccctcaagtccctctcatttgcttctttaggttgccccgcagtccgtcccgccgtcgccattgctttccgcttgtcgccatcgtcaatcgtcgtcagtgaggcctcctcctccccttcctctctctctcgggccacttagccgtcggccgctcactgccggtcgacgccttgcgccgtcgctgcgtagcaccgcgccgccacgcgccagggccgccgggtcggcttcagccgcccgcacgcgcccggccgcgcgccgcctctgccgtccggggctgttcatcgccacccgtgtggcagcccacgtggccgccacgtcagcgccacgtgtgcgccacatggcgctctcttccccggtcccgtggactcggcccaccatggaccggcggcattgagccgatgacatgtggggctcgtatgttggcgccgcgcccccccctttgctgacgtcaccagggttaataattgcacaataaatcaattaagacttttctttttatagtaaaaacacagtgaatcttctaaaattcatagaaaattcatccgtgccccgtttaagcccattcaagtctcagtaaatcgagaaaaatgtaaagaatccattaaaaattgttttgttctctgtttcagtagtcttatagcctgtttgcattgttttccttgtatgtcgcatagatttcgtgtctcccgacgctccggtgtacttcgaaatagtcgccgaagttcctccagccacagagcaaggctagtaatgcttttctcttgaacatattgatctcatattgcaaatgctctactattttcctttaaatattgcattgttttataatgttactatcggatgattacctactgtctcagccatactatttgttatcctgttccttgctagcttgggtcgtaacatgactagatgttggattagggattgcttagccatgcttagttcaactagtacacaatggaggaactacattaatgcatagacttcagattctagtattgatgttggattagtgccactgctttggtgttggctaattaaaatatattaaatggtgggctatgggtgcatggttttgatggtcgcgcccatggcaattaaggaccggttcgcgggattccctggaagaatttatcgtacttaccacaagccagcgtaggcaacggctgggcttgtagtgtggcttttctctagctgacgcatccaggcaagggtgggcgtgatggagcgggatgggccctgcgacggcctttgtcgcttccggattcacctaggcacgagaggggattgcccgctgccttgcgaggagtgggggtgaaacctgaggtgtggtgtgcttggttagaggggcttatgtgaagggtcctttcacggcctctttccggtatgtcgtggtggcatgccggcgcacgggaacgtgtcgtggggttgtgtcttgtggtacagttgtataccttttatcagagtaaaactattcgaatagccatgcccacggttatgggtggtcaaccagattcactgtgattagtctcaccctagtttagctcgatggaactgattagttcaggtggtgggttgggcctgtctcaacgtggtgtagtgttgagcagtgattgttttaatattggttaattactacaactgttttactgctttcaactactatttataaatgctagctttatgtaaatgaaaccccttttagccttctttggttatatcctgcatcataccctccgttccggtatgacttgctgagtacagtggatagtactcagtcttgctctatctcccaatccctcagagtttgagtatgcgtccgatggtggtttctccgaggagtaggcttcgtccgtgccatcgaggatgcctgtggagtggtgttctccgctactatccaagtcaaggcttagctctagttatcctttaatttccgttgcatttgtgtaagacttttataatgtttgtaagacgcggatctgtatgtcaactttgtcatttgtataccctggccggtcctggacaggggttttattgcacattctacttggaattctattcgggaatttctgggtgtgacaggtaagtcctatgttccgccggacttggcaattgtattggctacattggtgttgttgaaggatgcatcgcttcgacccttcgatcgctctgttttggttgatatatttgcctacctatttatcatatatcttagttaatctagtttcagtatatcgatttggtcatatcaactaattcttgctttaggatttatgccggtatcggctaaatcgctttactagattagattagctaaggtatctaccacccctgaaaataagtcaagggcttcattgtctagatattgtgcttcttttcatacttagtgctgcatcagtacattcgacctactaagtcgtgtttagaaccatgatctctaggctgcttttgattgccaataagggattcatcggggtttcagccgatgagttatctagatgttgcatcggcttataaggattacatacaggttgggtttagcctattgcaacaaaggtttcacttccagctgatgtatgctttaaccatcggatcgcttattctattatatcattgttagccgactaatttctattggattatattgttgttttttacattatcattagctgattgcctttattgtaatttactcaagtgtcagaatatatattggatatattgctcaaaaccctatcactatcggctagcatcggcatcggcttgaattactccatcggtttgtcagccgatcggctctttgatctgctatttatatcgcttgtcatttgtcagatcaaactgactggcacgcccgtatctcatcaacctttggacctgcactggagctaagtagatctcccaggccgttgtgttcattgacttagtccgcgcttgtaaagttttggcaccatcggccgagcgcggatttttcgttaacaatgtcatttttctggaaaaatggaaataaagagaatgctactgcttctttaccttctcccccaatttcttttccttgcataaatatggagagggcatgactatttctttttctctctgttttttttatcatgctccatattttggaagaggatgttttttttattgctaagcctttccctgcttttctctttttcttttacaaatgatttttaggagaagaaggcataattggaattggagtatttatttggatggaaatgtgtggaaatagatgataccaacttccagtgtagaagcttagcttatttgtgcatcaatggtggatgagtacccttgatcatgaaagtatgagagacatctaacatgagtcacaataatttggcaacgcatgtatatgttttaacattgatatagttgtgtatgaccttggtacatagtgatgaagtcatttgaggagtaagaatccaaaattttagttttgaaaacaaaaatcccaagtgtcatgacaaagatcataaaactttccttcatcttaaccatctctcatgtaacaattacttagagcaattaggttccctaaaatggtagttgttcacaagtgacaactatagttgaatcacaggaaaatttcattagttgagagtttatccttttcaatttggccttgagttgaattttcatttaatcactgctcatgtactgaacaaaaaaggagagtatgaggaagtggacgtgcttacctgtacacctgacaaaattaagagagattggagccacgatgggttcagccgaaccaggggttcggccaaacccctctgacgcccattctctctgtaattttcagggaagttcagtgattgtcagaagtttagagatatgcattattttcagattttgcacgttaggagtccgaagtatcaccgccacacttatttttgaacctaaactttattgaatatcctagaaataaatggcttccattggggtaaacaccaatgagccaaaattattataataaagacatgcgcttacattgaacattaaagaaagcaaagattgaaaataaactaaagcgcctctaaactacttattaaatggggaaggcatctaattcgcataatacttgtcctccttccccatttcagtgaatgcgcttgttcttagtgcacattccacggctaaaggtgttgaaatcatgcctaagctcagcgagctcaacacctaatattgcggtcactcaactccttgttctccttacggagcttcttcacttgactcacgagtttagtgaccgaaggcttgtgcgattttcacttcatcttcttggtattgccccggcgcccgaatgataggaggaggagtcaaatgacgcctcaccttggcgggtgaggaaccaaccgactctgctgcctcgtccttttccatgggcgtcaaggggcggcacaagcccttgccgtacccaccgctaggggttctcactcccataatgcaaaacctctcccccttaggggttgatggagtggcggtgggtgtcttgtacttgtttagcacctcatctcctgccttggtgtacagagtgcccacatacttcttggcgggtagcagattggccttcaattgctcttcgaacaaccccctcgccgttattgggcctagcttgcccgtcgtactggtgaatcacccacaccttggtccttgtcatgtggcacggtgagagagatcgtgctgccgaacgcgtagccgaacggggccgggaaggattcggccaaaccagggagttcgccgaccggccccaaatcggccgaggagcttggcacgaagatgatgggttgcgcccacacagcgtttaccccctccattgtgtagtttttgacaggaactaattggttagccggagtgggttctccctctaggttaaacgtggaattggaggtggatccgatgtagggcatgagagattttccagccatgggggaacaatcactagtgtgaggggaattgagggaacttggaaaggagagaatgcaaaggaggagggaagaagagaggcttgagagtgctctgcgagttctagattgatctaccctgaaactcgcatcacaaacgaactaacacgagcgggggaggcatccattcaaaattggggccggcaggacgccaaattttgcacatctcttgactaggctaactcaagctagacatgatacaattttatagaatttaagcaaattttagatgagatcattatggttcgtagttgattaattcaataatatccacttctttatctaaaatttcattcggctcaaggaaaatttttaagcgctatctgtttaccttgaatatgttacctgagtcatcccggagtgtgattgctctgtgcggcgaggtatcgatgacatcatatggcccttcccatttgttgcgcaactttccatgtccaaatagcctttcccatttcctggcttgaatttcttgatgttttatccgcttgtcgtgccagcgttttgttctctccttataagtcttggaattgtgatataccttgtctctccattcttctagttcagctaactgcatttatctccattctccggctccctcaaaatccatattccagttttggattgccaagtacgctcaatgttcgagttctacagggagtcgacatgacttcccgtagattatctggtatgtggacaattccaatgggtgtcttatgggccgtccggtatgcctagagagcatcgggtagcttgtccttccatcctgtgcccaatttgttgatcattttctgtagaatattcttgatctgtttgtttgacgtttctgcttgtccacttgtctgaggatagtagggtgtagcgacgttgtgcttggtgcccatttcacgcaaaaggtatatgatggttttgtcaatgaaatgtgatcccccatcacttatgaccattcttggggcactaaagagaggaaagatgatttccaagaacatcttcttagcatgtttggcatccgtagccctacgcgacattgcttccacccatttagacacatagcctaccgctaccaggatatactcacaattatgggacttaggaaaggtcccataaagtcaataccccacacgtcgaatatctccacttgtaggttatacgtgagaggcattgcatcgtgagcagtgatccctccttacctttggcagctctggcatcgtttgacaaactccttggagtcttcatatattgttggccagaagaatccactctgccagatcttggcttgtgtgcggaatgcaccgtagtgtccaccatagggcgaagagtggcatctctctataatcttgagcccttagcaatccgtccgaacagactctatataggtatggctcatcctagatgtgacgtcagctctcatatttcagctttctctgattttcttccagtgatacgtactttaataccatgtagtttactatatttgcgtaacatgggttggagtcgtgcaccgtcattagcatatcgtcccatagaaagtcatttatcgggggttcctgcatgttagtgatttgcatcctcgacaaatgatctactatagtattttctactctctttttatccttaatttctaagtcaaattcttggagcagaagaatctatcttaaaagacttggcttagcatctttcttagtgagcaggtattttaaggcagcatgatctgtgtaaacaattaccttagctcctatcaagtaagatctaaacttatcgatagcaaaaacaaccgtaagaagctctatttcagttgtggcataatttttttcgacggttaaaacagcgggagaggctcctatatatatatatgtacaagattgagatattacagggtgggaagaataaattacagtgctatctaatggtttgtatccatgcttgccaactgggattgtctgctgcctttactctgtgcatatgccgagtaaaatcatccttgaaatctttggtccattttctgaagcttattggagttccattaaagatgaggtcatttcttatagcccagatattccaacagctaatgcccaggatttccatgaaaaaagaatgagggaacagatttttagttgccatgatcatattcatgaattccatatttaagttccaagttatgccaacatggttccaacattattatgcaaacggatatgagaaaaaaagtggatataatcttctgtgtttgtcacattgcacaccagacatttaattcctccctgagtagagtagttctttctttgaagcagttctttagtgtttagtctatccattaagagtagccaaagaaaaacctttattttcattgtgcttttacttttccaaatgagagtaagagggatttccggttggatatgggcgaagaagagcccatacaactttttggattgaaacagatttggagtccaaaagtaattccattgatcaggctcaatattggattgcatttgctggatgttatttcatagtgattgccactgagttatagctcctttaggaagtggggtgtagaaaaggtcctctacattattcgttaaggtgaagtgtctgtaagataggtattcctgttttgcataggagaatagaaggctgtgagtgtcttgaagtatctgaccattccaattatctttccaaaagggcagtgattttccagttccaatagttacagatgtgatggctctaaagatagggatcagcctgaagatgtctttccaccaaaaggagcctttttctttatgtgcatgaggaggtttttcagattcaacatagtatttgttccaaatcagattgacctagggtagatctttgcagttaaagaatttatctagatgttttgtgaggagagcaatattttggatttctagattgacaatttctaatccacccttgtttttctgcttacaagccagttcccatgctgccaaagattgtactgttgcatttgggtcacttgactttctccagaggcagtgtctacgagctcgatcaatatgttggataacttttttggggagtttgagagtacacatgtagtaagttggcagagcggagagtaccaaattaaccattatcaacctttggccatgggagaggaacactgaagtagatggtagtcttctttctattctatcaatcaggggtgcaaaatcaacaatctttggtttattagtgcccattggaagtccaaggtatgtgaagggcatagatccaatattgcatccaaatgtgccagctagaacctccattttgtggttatcaacatttattggaaccatgcatgacttgtgataattgattttaagacctgtgcaaacagagaaagtttgaaggagtgctccttgagacagaaaatttctttctgtatagctggcatgattattaaagtatcattagcatattggattactggaaaatagttgccattagttgggatggggagtgagataattccttcttctttcgccttgtttataatggattgtaggaggtcggctgccagcacaaacatgagaggggaaagagaatcaccttatcttactcctcttttgcacttaaattctttcccaggaactccattgagtagcacagatgtggaagcggtggtgagaatgtttcttacccatgaaatccaagtattgtcaaaaccttttgcttgaaggatttgtataatagcctcatgttccactggatcaaaggctttttcaaagtctattttcagaattacaatttctcttttgctttgatggcattggtggatgtactcaaaactccaggctagacagtcttgaatggttctgcccttaataaatccatattgattttcatggattagattcagaatgactgattgacatctattggccattatctttgaaataaatttcagagcagagttttgtagggcaattggtctgtaatcatttggggtttctgggttgggcttctttgggattaaagtaatgtaggagttgtttaggttctgaattgatgatcctccactaaagaaatgttctgctagagaatagaaatcttcggagatgatatgccagcatttcttaagaaaaagtccattgaagccatctggtcctggggctctgtcaattggtagattcttgataatttgatccatttcattcctagaaggtatagaggatagagcttccaggccctgaattctatgaaacagactgtttaggtttaggaccatttgtatatgttcagtagtacccattctgtttttgaaagaatttagtaagacttgtgctttttcttcatgagctgagattgttctgtcctccacctttaagtgtgagatcttgttcttgttccttctgtgactatctgttgcagaagcttgaaaatatttaggattttcatccccaaatttaacccatctaattgtgcatcttttcttccaaaactcattctggtatttcaacagctatagaatatgttctttcaagattattctaaaattccattctcgaataaaaaggggtctttgttcttcaatattatccagaaataacaatacctcattgcagtttgagatgatagcatgaagattataaagccttttactccaacttttcaaacctcttctcaaatttttgaacttgccattcagttttgtggcctgatttgaacctctgacaggaatactctagaactgggagactacatctataaagcctggcatgtcagtccaaaagttttcgaatctgaataatttggatttaggaactgaagtttcaattgaaatcatgcagggtgcatgatccgagatgtatttagccagagctatgactgaggtgtgaggaaattttagggtccaagctagagatgtgaaaacccaatcaagttgctgtaagagaggctgttcctgcatgttgctccaggtgtaagataaaccttttaaagggacttcaatcaacccgatattactaatgatttcattgaagatcagaatgtcattcatatcttccccaggaagattcctattttgcactgaccgaatgaagttaaaatcacccattagaatccaattatgatctatgtttatttcaagattgttcagccatgaaacaaactcatccctttgttctccagaacaggggccatagatattagatagagtccagacttcatgtaaggaggagttagaagtaaactctatggagattgcaaaagggaggttttcaatcaaagttccagaaactgtattattgttccaaataactattagtccccctgagttcccaagcgaaggatggaaaatgaatttgtcaaatcttctagggcaaagttttctgatgtaagaatgatcaaaaaaatctcttttggtttcctgaagacagattattgaacaggaagattcagaaatcttctcagagagtgtaagccacttttgagcagagtttaagcctctgatattctagcacaggatattacagtttctgttgtgatttagattcatttaaccaaagagagagagatatactgaaatgggtagagattaactgcacacccatgaagaacatccaccagcaattaacagaaaaggcttgagaattttcatgaaacagcaaaagagagtagcacttagcctgagagcttaaacataacttaagaagggtccagaagtaatactgaaagcagttttgatagaaagagataactaccctattacactttagggcagcagggctaagcatagccacattattacaaacaagagtaaattgattcattttttggtcttgaggagttttgcttcagccacttcctcaggaagaaggccacacttttccaccccgattttctggagttgggcaacagggactggagggggtagacccttgctaattgcaggaagaagagctctgactggctggactttggatttcttttttggattgtcaaagtctaggtcttgcttttcttggcccaggaatcttgggcttcttctaagattctcagtagatatgggccctttttgtctctgtttcctgggcttgggagttgcttgaatttcattttgaaggctggattcatcagatgcaaattgcagcgatcttgctacatgtcttcctacaatggccactttctgcctctttgcaggacttggactgacttccaggtcttgaaacaagatcacatttattttcacctcccaaacagttctggcaagggaccatctctaaagaacaatgacaggcttgcacaaaggaggctgaaaggcaagaagcaaaggtctgaaaattccctgagcgaccgcccggcaaaatggttcgggtaagttgagaatcgggagcgatggaagaggcaggccataaggaataatctgccaacccagatgctgctgctgctgcaagtgccaagttgtctctaaatcatatgtagagtaatcatgaactgacagagagtcttgaggttgctgcgcagggatgtcaacagccatgtgattctctccctaaaattcttcatcattctgatcatcagcatgaaaatcaaaattttcccaaatgttgtttttgttgttctgcattgttgtcctgtggagcagagagcatctgccatatgggtaaaaggtcctcatcacctggcaagatatatgttggcataccgttgaggacaaagacatgaaaagtccaagattgtcctaatcctccaaaagccgtagcatcacccaaaaccaacttagcagggatatcattaacagatttatatctagccttgaccaatacccttccaagcaccttatcgcggtagtgccagtcaatgaattccccacagaggttagtagcctgttcaataatagctctagtcttaaggtgtagggcaatgcctagaatcattaaccatccttctctagtgaatggggagttcctccagtttgcaagttgatcatgtttaacaaagtttgcatggaaccaattaccgagaagcacaggttctgaattcactagaacatctcttacaagagttgaggccagctctacaatgcacagggcgagagggtacctactcctcggagaaaccttcacctgacccgaactcgaactctggggttgggaaaaatagagcaagactgagagtactacccactgtactcagcaagtcataccggaataggggtatgatgcagggaatcatcaaagaagagctgaagtggtttatttgcataaagcgagcatttataaacagaagttgaaagattaaacagttgtaataattaattaatattaatcatccactgtccaacgctatcccacgttgcgacaggcccatccatccacctaaactatccaaattcaaaagattacactaaggtgagactaatcacggtgaatctggttgaccgcccataaccgcgggcacggctattcgaatagttttactctgatcagatgtgtacaactgtacccacaagacacagccccacgacacgtttccatgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcctgcgaaccggtccttaactgccatgggagcgaccagcaaaaccatgcacccacagcccaccatgtgatttattttaattaaccaacaccaaagcggtgttactaatccaacaaaccattagaaccaatagtctaaacattaataggattttttccccattgtgaactagttgaactaagcatggctaagcaatccctagtcctaactctaatcatgttagaaccccaagttgacaaagaaacatggtacatcaatagcatagctatgacaataggtaaacaacccatagtaatattataaaacaatgcaatatttgaaagaaaacaatagagcatttgtaatataggatcaacatggtcaagtgacaagcatgacttgccttgctctgctgctggaggaacctcggcgactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattaattatgaattttagaagattcactatgtttattactatacaagaaaaaccttaaatcatttattgcacaataaatcccagggctgacgtcagcacggagggggcgcggcgccggcaagcgggccccaccggtcagcggctcagggggagcggttcaccgtggaccgggaccacgcgggtggtccatcgccggtccacgggaccgacggcccagatcgccctcgggccgatcggacgggcggcggtggaggcagctgctgggctcggctcggcatcaaagccgaccgggcgacccggggctaacggcggtggcacgcgcgcgtcgcgttgccggtgacggcatccggcggcggaggcgacggcgcaaaggcgacgcgaaagcgacggcagtggacggcggcaacgaccaaaggcgacggcgagcgcgggcggcagcgacgcacggggaatcgaggaagtaaaggaaaggggaaggagtcctcaccggaggggacggcggcgtccggcgacgaggagcgacggagggaagtcgacacgcggcggacggcgaccgggacgacctaaagaacgaaacgaaagagattagagaggaagagaggagccataggaggcgggaaggccggccgaaggcggcggacatggcaaccctcaccgtcgcacgacgggaacggctctccggcgacagacctcgacgaaagaggggtggacggggtggatctcagccacgcgaacccgacggcagcgatggcgcggtgcggcggtgagcctagcggcggctagcggcggtcggagtagcggagacggtggcggcgggtggttgcacggcgcgggagcgatggagagcacgagggagtttggcgagaaaaggaaaaagcgagagggagtgacggggaagcttaaataggggaggggagggccggacgtggccgggagaggcgggatttcgccggccaacgtgggagaagtgggggaggagagagaggcgggattcgaaaatcgaatcccggccatctcgggcacgggcgcgagcgggagagagaggggagtgggcgcggggaacgcggcgcacgcgcgggcgtggtcgacgtggcccggaggaggcggaggcgacgcggcggcggttgcgggcgcggcggttgcgggcgcggcgtcggctggaggagggagacgggcccgacaggtgggccccacctgtcggcgaccccgagagaggagggaggcgggacggcctggatgggcctcggcctgcggccggcccaacaaggaggagggggaagaaaggagagaatgggcaggcggcccattcggaaaaatggaggaaaaagagaggaaaaagaaaaagaaaaaaggaaaaaggattttcccaggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttcaccagcattttcttggggtcgttttaaaaaaaaatttaaattttaggcttgggaggagaacttcggggtgtgacagggaggaaacctgagagagagaggcgaagacaaagcgacgctagaaggaaacctgaccaaagatttttccgctgatttcgggatcgaccgcaatttccagacttttttctttgaatgggccaaacaggaacgggctagatggccgtaattgaaacaggcccgacatctcaccgagttggggcaatcagcataccgatgaccagcgcccaaacagcgggagcaattgaaacccccagataacgccgaatttaagcccgaatttgaaagggagcccgaatgatgcacaagagtaatggcgggcatagaaaatggcatctaattcaaaaaaatgggcgaagaacacggtagaacaggctttggtaggattttcgtacctgaagatgaagccttgggagggcgaatgtaagaatccccattggaaaagaacatccttttgaacactgaaggtttattcacttgagatttaccctttgactgattaaaatttaaaacttctgtggaggccttagtagaatgaacgagaaaatcacccttggtgtcagatagcctcttgaacattgaaagattattcacttgagatttacctttagcctgatcaattttaacaacttctgcataagaaatgaactccggttagagttttgctagcgtaacagattgtgtgatgctttttacctttggtttggcccaagaccgtaccaacagagaagtcgttggcatcacacatgatttcgaagggtaacgtccaatcgggaggttggatgattggagccgagatgagcgcctttttgaggatttcaaaggacttgaggcacgcatcatcaaactcaaaaggagcatctttagctaataagttagtgagcggcttgacgattgtagaaaagtccttaatgaaccttctataaaagctagagtgacctaagaagctacggatccctttgatattcataggaggtgggagttgatcaatcacctcaatcttagcccgatcaacttcaatccccctcttggacactcgatggccaagaacaatcccttcgcggaacatgaagtggcacttttcccaattaagcactaggtcattttcttggcatcgctgcaagaccttgtccaaattctagaggcaatgaccgaaggtttttccataaacagagaagtcatccatgaagacttccataatatgttcgatcatatcagagaaaatggacatcatacaactctgaaaagagaccggagcattgcacagcctgaatgacatcctataataggcataggttccatacgggcatgtgaacgtggtcttgctctgatcatcaggatggatgggaatttgatgatagccagagtatccatcaaggaaacaaaaataggaatgatttgccaaccgttccaacatttcatcaatgaagggtagtgaaaaatgatcctttttcgtagccttgttgagtttcctgtaatctatgcacattctccatcctgtgatggttcgttgcgggataagctcatttttagcatttgcaacaaccgtcattcctcctttattaggcactacttggactgggctatcccactcgctgtattgcacaggatagataatccagacgtgcaggagtttcaggacctctttcttaacgacttccctcatcgcattattcagctgtctttggggttctctggacggtgagctctcaggcacgatgggcttgcgatgagtatagagcacgggattaatccatttcagatcctgaagggaatagcctagaacagcgcgatgtttttcaaagacggctagaagacgactggttttgccatcagaaagcttgtcactgataatgactagagcttccttattaccatatagaaaagcatagcgcattccttgcggaaggggttttagctcaatcggaggtcacagcggtgattctaagattggaagttcgaaagtttcacagtgctcatcttcttttacaatgaaatctgggacttcattttcaagaagagactccagagactcatgcagaagaacggccattacttcctccgcatattcttcttctggtaaggaatcggttagggcaaaccttgcccgcgaggatggaattgagaattcattccctcctatagaaattttgaggctgtctaatcgagcagtattaatgaggagctactcaatcgggtgctcgattagaacatcaaaatcttggatttcaaagacatggaaatccaagatcacctccttgccgtcatgaatgacaagcactcttgcacaatcccaaatccttcaataagatttccgttgggatgcttgaagaatttgtttgtcggcataattgtcttgtcatgatgcgaccatggctaccatggatacaacctttgctcacatcatggatcaagaataacacttcaagaacaagccatccaaattctgaaatccaattcggccacctgctactgtgctgaattcaaatggtggctagatgtgcatacgacctccgttttgggtccgtgagtacttgatggaaagctctcggaatcctctttccaacagatccagccttgttccaaaattccttctcagtcgacagaaattgcaaaaacaaggtgctacatcccctatattgggccaatgggcttgtaacttcgtttgggactccggcccaagtggggcccatgtggggtgcgccccaaccaggtggagcatgaccctagagtccccttggtcatccttcctacctctttaaatagttaggtaccccttcagggtttctcgggttttgtttagatcaaagtatagcgtcgctactctgccgagttgatcccgtggtcgattagatcgccggattgcttgttactgaaccccacttgttacttctattgattcaatccaacatctttgattcgaaaatttagttgcttgttcatcttgttcttgctggttctcgattgcttgcaggaacaaataccctcgtggttgggctgatcgtgcatccgtcgagattcatgaccgcctctgaagttagtgtaacgattgctaaggcgcaacatccctggatagttgtagttggatcgccaacgtcactccatccaatcgacttatccctctcattgaaagatcgggacaccctcgagcacatcatgtcgctcagataagcgaacgcaaaggattccgagacaatatgagcaccaacagttggaccataaagaatactaacattattcccatctaaatgatacggaatggttcgagaagcgctatttatccgaattacttcggatgaaagctctgccttcatgatcactcataatcgatgtcaactcctgaactgttccctttagatacccaagctctattggatcgagaggtggcaagggaataggcggtctcttcttactaaagtagttcaaggtatttccataattttcatcaagatcatacctgaacattggagcacatcctggagttcaaatttcttttttatcaacagatgatggctcagagacatgttcctcggtcgaattgatcgaagtagacggttcagtctttgattcgattaacaagggttcctcgatcctagccacatatgcctcagggaggggttcattgcactgttccatgaagtaagttttttccataattcagtctaggattacttttccttcggatagagttatatgtatgaacgaccctccggcagtaatgtctagataaaatgcagactccttatctaaacccgtgcgaaaatgatgcaacaacacgtattcgggtatggataaccttggaccgaatcgcactaaattagtaactctggacctggcttcactgattgattctttatttaactactagaaactgaggatttccacacgaagcgcagtaatacgggttataggaaaaaaggcaaggcagaacctgtctcgtaatttctcccagttaccgcttacacacctgacgatagatgtgtaccattgttttgctctctcttgaaggtagaacagaaacaatttccactgtacagtttcttgcttcatgcctcgaatctaaaggcatgagcaaagctgctcaaattcccgcagatgatggtaggagttttcttggtcaagaccaaagaaaggtttttccctaaccatacttattaatttggggcgaatttcgtagccagttgtaaaaattggctcttatgaaggaggtggctcgtagaattcgcccctaggggctgattgttgacggctgtttagtaccaaattaacgccgtcaatacctgcataaaaccataactacaaaacatccaacatagtgttagggtttatttctaacaatttccacgagtgttggtatatattcatatacaggtgacaaactaccaaggttgagaggaaatatacatgaaggaggatgagaatcaaactcgtatccgaacttaaggagttttggacccataaacccaattaaacacctccaaatgggccgaacttcataccaatgaaatgaggggcc

SEQ ID NO: 58500 - DNA, 15768 bp, Oryza sativa
ctttcttaataattatactttgctgttaagcagatacatgcatagcctaattgtcagacggatgcaagatgtggagctgcactataatgtgcgtccagttctgaagcttaggcgaaaagaaaccatttggcttggtttaactgcatacattcgtgtgcttcagcagaaacaatcacgttacaaggatatgctgactttgttgacagcagagcttgggagatattgccatttaggtcatgaatgtgataccttgcgctatgctgtggatgattctcactcgtctatgttctggaaatttaagttctagaaactagaagttgctttcctggtgtactgcagaaactactgttcttttggatattcttttgacaagtcattttgggactttacctccaatctgccgacgtgtcatcgcacgcagtaccaatgcctacctcgctaaaacatactcctggtgtgtgcaaaacaaaccggtggattcatgtcctaacctcattcaaggtgcgactgttggcccgtgttctccaatctagtgtaacgaacgagaacgagcacctcactagtcaaaggttaatggtctcctgaggtgacagtggggtgccgatcatggtttttttttaaagcattttacgactgattgctcatttctttaggatacctggtagcactcgagcagtattaactttttgtataatttattgtgggcattgatttgttttccttaggttactgcaattgaaacgattgcattttactaattgttgccaatcggaattgtaccccttcaattttcagcaattccaaccttttggctcttaatgctaaatctactcaggtccctactaaagatttatagaatactccctccattccaaattgatctagatatagtttttttgagattattcctaaatgatctacatatttgtgctcatttattgagtctattcgttatttgtgtattggagtaaatggacattgatgcatgtatctatgcacacaagtatttataacccacatgcaatatcttgatttgctgttggctaggaaatattggagatggtgcatgcattgagtttgttgctagaataaatatagtatgaaagagttattagctttcttggtcttggtgtacctatgaaatatgtagatcaatttgtaatggagggagtactcaattagtactaagcataaaatgtaatttgagacatgcataatgctagccattcttaatttaattgagcttgtgccatgcatcatttaatttgctagttaatatcaggagatccttttaatacttagcttcagttatgaattttgttgggctcaattttcctcggatgtatttattcttcctatatactccctccattccaaattgatctacatatagtttttttgaggttattcctaaatgatctacatatttgtgttcatttactagagtctattcgttatttgtgcattagaataaatggacattgatgcatgtatccatgcacacaagtatttataacccatatgcaatatcttgatttgttattggctagaaaatattggggatggtgcatacattgagtttgttgctaaagtaaacatagtatgagagagttattagcttttcttggtcttggtgtagctatgaaatatgtagattaatttggaatggagggagtagttggtacccactaagtgcaattatgactataaagctgcatctagaaagagccacgtcatccaaataatcctaaccgtcagattttatttggactgctaattgctatcttagatgtgaactatctcagatcaggctcagatgaagaaatggttcagcccatggaagcccagccgttgccacagtccattgtcttgccctcaaccttttcggatcccctgtccccgatgcaattatttacatgatctcccccttccccttctcttgaatttctatggttctcctgttcactgctttttttttttgggttcatgcatggattattgataataattatgagttcaagatatcaatcttttgggtgcataccaggagatggactatgaggcaaaataaattaacatatatgtatttcatcctcgcagttttctgttcatccaagcttcgtgctgaaaatttgtttggattatgtatttttaacttgcttagtttgcaccaataccagattgtgtagattaaagtcttttattacagtaaatttacggataggaggctctacgaccaagtttatactcaggacaaatccgttctactttatttcaaattatgtctgatcttaataccttttaaattagcctcatatatctctttttttcatgctgtgtaagttccaattcagaattacaattggctacaccacgggacatctcactaacttaaaggtgattttgttcacttttctttgagatcaactgtatgtacaattctgaatgtgcctctttttttttttctatcaaggtttcatgtagtccatttggactaatcattcatgtctcttttccatattatttcctcaaagcaagaataccactttggtaggatacaaatatcccacggtaacacacgaggtacccatctaattttcctgaagtcagtgccagctagggttctaccgaacctctggtttggccgaaccaggcaaactgtctctctccaccgcctttggtgagaggctgcaaggtgcgcctctcagtcggttcccaagtggttggccctactttgagccggtttgaactaacttgtgggcttttcaatccgtgtgctcgcacgtgattcgtcggatgtatgtttcattgtatgtcggcttcatttcttcttcactttgatgtataactcctgcatccaagttaattctctaatcctaatacaactacattatttattattggtatttttccctttactagttgagtgcccatgcgatgcaacggtgaaaaagaaaatgtgatattgttaagtaatcatggtggctagacccttccaataatacctgactgttgctggtcacaattgagctgccgctagccacaagcattatgaccattcgaaccattttcctgttattatggttagagtaatgcatgtgctgccatagatgccattgtctgcagctcctagcccccttccagttgtccatacaaggatatgacaaagtaacaaaatatcaactaaataatcaacgcagcaaattaaactgtagaagagattaatcatcacctagaaccaaacttgtcagatcaattggtgtccatcatctatacaaaaatttcaaatattgtcttgctaaatctacacctgtgctaaaggaacctgtagtgaatccgatccaaaggagccatgcttgttctgtaccaaatatgctgaatttttgttataattctttttactgaaaagaatgctctatggctctacctgccttaaaatactttttttttctcttaacctttatgttcattaccagagtttcagctaacctgtaacaatgcaagcattgttattatagtaccataatacatattcaaaatgattgtgatagaagttagatatatgacttactgtgatccaaaaataagatgagactgttgttgaatctcttagttaaaaaaactaagaagccagacatatataaaccgatcatccttctcccattcttgcaacaacatcatcttggccaggatattgtcttgcacattatatatacaggctttataatttggaataaaatgagcatgggatcttaaaaatttcataaacaggtgctcactacttaccatgggattagattgagcagtaccaaatttaatatatatagcagagtgctcagctgccaacatgagtaacattattactctcacgaatttacatggattttacccgtttaacaaccttctaaatgaagaaccaatttgtacagaagaatattgttattaaagaggacattaggacaaccaaagttagtgctgctaactggaaagcaaattacctgtgcatggagtaatagtaaaggaacgcatacctgtgtaacaaaaattgattaaaaatagaatacaaatctttttcatgcggctattgaagattgagaaaatcaaaggcatgcttcatgtgataattgcaatgcagacaccaattctaggtaacaaacaaatcaggtgttgccttacccatatgggcttcgtttcataagccgattcccaatcggacatgcgaaagaattttgtcacctgagcataaccttttgacaaatcattcagcctcaaaggctatttcaaattttagacatttgtgatttttataccacccaccagcatggccatgccaaatgctattccacgggataaaggtggttacctgttaccacacgacttaaactcagacatgagcatccatgacaatttaaaaactctgcaattttgtttcagtgacaatgttagtttcagctgtaacttcagatcatgtgagatactcatagagaatatttatatgttacctagagaatgatcttttcttgtaaaaaaaataatgttaattcaggtcaaggaatcagagagataataaaatcaaaaactcaccaagcgaatgaccttttatgcttgattgtgactctctaatatttgatggagatttaaattgaaacttggtaaatccggaaacaatcaagcatcagcctaacagtagtatatggaagcatgggaaatctagcctaaatttgggcaattattcgaatagcaggaaccatagcatttttgttgaatgaagttatataataaaattaattatgtttcataaaagcattcacaggcagcatgttgcacaaaaaaaaaaacccacacttccaggcattttcttctttcttcagtaccatgaggctgttacctacttggatctttctacgcatttatatagaataagtaaaagaaattcagggaaactgctaatgtccaattcaggttggttagataccttgatttcccctcataattcaaggtgcaaacaaagaaataaacaggtgcatttacaacaacagtgagcaagagcaaattaaggaacctgttgactgctcaatcagattggttacacatactttgacttccccttgtaattcacagtgacaaagaaagagatgaacggccgctttgacaataccaacagtgtgcaaaaaaagccaaatcatcataaaaaagggggccgatggggctgcagtagaaaaggctccaggagcacgatggagggggcagagagggcgcccgggtcgccagaggccgcgtctaggtcgcagcggaggctggaggtggcgtgagcgcccgccgtgcgacggggaccagggggtgacgaatccggaggtcggggcggagatggatggaggcgtcgagggcggcggcagcggggtggcggcgcggacggggctgcgacgggagagagcgggcgagcgagaggagcgcggggcgttgcggaggaatagatgcggtcatgcagagaaagaggaagtcaggaacaaatgcggaggagcgtggaccgttgattctgcaggacgatccttccagcaatcttagccttcgattgtttaggactcaccaccaacactacgcttttttaaaatagtaaagattctccaatacaagtgaaactacattttttataactgagatatacgtgtaagaaatgttagttctccttttatttattacagtagtcgatgttcgaaatcggtacttaagaactgtcaacaataccacataggtgattagatgatgagatggagataagtagagagatgatgaatctattgtatatgttacctcttaatttgttgatatataatatgtatgaaaatagagataatagtcgcctctgctataaaaagtttgctcttggacagtaccagaataaattagagtggaccatgctttaaaatgcgtggcaaatattggcaagaatcaagatggggcctcgggaggttggcttcaaggccctgtcccatagattttttttttcccgctgagacctgattaatgatccgatcatattcagatacgctgctgctcaatccggccagttcgagaggactgattggccggtttgaaatgatcaagtgatcgttaaaacccccaaaactttcctctggcgatcgatgatactcatgaagttcccataggccatagctctgcgaaacaacaaaaaagtacttcttttcataagtgcggtatctagctctaccatacaaactgtataccgtgctacagttccttatgctacaaaaacgtccaaaggtgttcatatggtgctttttccacaggtaacatgctttactggaatgcgtgtaaagatgttcatatggtgcttcactgatgactgatctaatcagaagtataagctcactttgcagccgtcgttcgaacatttccaaaacagaaaaggtggtatgatctccatcatgccaattaaacatgacctgctaaatagcatgatggatctgacaaagtaagattatgacaacaaataaagcttcagtaaatgaccataatagcttgaatgcataattacctttatcttctaaacatgcgttgattactaaaattcagctaagctccttcagtgatctcagatagttctgtctgtgaagttggcaaccatatctcaatacgactacctccagtccctataattgcatcaggtctccgaggcgatatcacacgcaaaacacagccatagttctcaagtatctcacgggcaactgttaatcctgcaatgaaattccatgtcatattatcttcatgcataccatccgcaaggtctgacccgaatggagcaaggcaatgcatctgtgtctgtaaaatgatagaaatcagaaatttgaaccaattgtcaatgataaataaaaactttgctggacatgaaaatattcttacagtgcttgaagcaatacaagcaagtgaaccaaagttcaaacaaatttaggcctccaaaatatcgcatctaaaataaaatatctcaatctggtgaccatcagttaactttaggtttcactagaaaattgaaaaccgacactatatttcattattagtacattgcacaatagtttgaatgagatgctcttgtattgttgtcccaaaggaattctttggcacactgatgaaaagtcataattacattggattgatgtcccataattctccctatgttttatgttttcttttgtttcaaaactagagtgggtgtgtgttttggctgtgtgcatcttagttatgcagaggccaataaagtttccattatctaaaaaaacattatgaaacactaaagagccttacaaatgaaagaacaaatgtacttaccatgtattgcatgtcaggaccatcatcatcaatgacaacgagaatgcctcctgcaggtgcttcaccagcatatatctgaactcggccaccaagctgagtgcgtagaagagcaccctctatgagattactcagcgcttgtcttaaagcagattcctcaacagcaacttgaagcgggtgtgaaattcctgttacatctagagtgcgttgctgcctaaaagcaagcggttgagctgctccaaccaaatcttccagtacaacagagagatcacatggtctgcctgacaacaaataaagtgacaaataatgcacaattgaattgttggggactaacatctaagttattttttactcaagcaattaaaaatatggtaacttgagatgtaaacaaataaagtactgacatacaagtacacgggacatgggcgacatgaggtcctcaaaagagcaaataccccaacactatccaaatcgataaaagtgatttttttcaatatatacactattcatacaaacaccccaataaatcaaatgcaaaaagaaagatttatgggaagggacaagatggacgattgttttgtcttgatcaacactgtgaaacaagaagacagatgaaacaaaaattagttcacaaaagaacaaagaatgtcagaaaaacataaatcttttctagcatcaattgaatttaaaatttaaatctttactgatgatggtccacttttttctgactttgtttttcttcttctgtccaccaacatatgtgaaaaccacttctagttggtaggagggacattttttatctggtttctagttttaagagttaggagatgagttttgtttggttttgtagttgagagaccaaaattaaatcgattcaactgggtaagggaaaagaaataaacttttctggacaaaaacatggagttggtgcttgaggtaaaagaacagtttaggccgcgttctttgcaagtgctgggaccacttcctccagcacacaaaatggagcgacggattatcgcatgattaattcagtactgtattagctaaaaaaacttgaaaatggattaatatgatttttaaagcaacttctcaatatgattttagcagttcacaaaccgtgtgcacggaaaacaagcattgcgaatagtagtgtttaatacataggcattgatcaagatatatgtaatgaaaattttcagaaatttggtcaatgtaaatatgttttttctttggatcagtagatctttttttaagaaaatgatggttttattctccacttaatttcaatgctacatgctttcctgttccctttttagttgcatatttgcatagtacaatggatttagatttcacatatgttttgcataatatccttctacctttgtaatggatctcaaatgcaaaactttgtcagtctgaaactctggcaattaagataacataaacttgaaatgtacagtaatatttacttgatattcatggtaccacaatagaacttttgctagtacagaaaaacagaccatgaaatttagagtattatggttttctcaaatattgaaatataagcatggttaggaatagtgtagaataactaggatatgatgtttcatgaacccaacagctagatttatttgaaaccattgaaatgttatgtgcatttttatttcagtaaacaataaaatagttattacacaagaaatggtccagcataaaataatctgtgcaaacaactactacctccatccctgaatacaaggagttttagagttggacacggttattaagaattacttagaattaaatggtggaagattgtgattggttgagaagtggaggtaggtgggaaaattgcatggtgggttgtgattggttgagaagggaatgttggtggagaagttgttataatttggggcaaattctaaaggctaaaagttgttatattttgggacagagggagtactttagaagcacatgaaaactatgacaaaaataagttttactgaaaacaggagtgacactatgcattgggtactggtaatcaatagttattggtctgtgatagactacacttattttgaaataactaaaactgaactacaagtaaatcacagctacaacaatttcttggtaaacaaagcattcaacgcatgaaattagtctactatgtaactgagagttcaacatcttggaatggcaaattgaagcaaactgttacctagcgtcttggggttgaagaggggccagccagagaggtggcatgggtatcaccatgtctccattgtcagaatcatgtgatgacaacgaatcaactttctgtgaactattcttaggatctgattgatagtgtggtagagttcttgaagaaggtgacccctgaattttctttaaggtttcctcattgtacctaactatgttcacctgttcagataacatgacaaaaattcacttagggatacgtgaggaaaaatcataagagataatggaattatccttgtatgctaaaacattgtcttaattaagttttatcatttgggatgtacataggtctgctcattggcctacaccactgaactgatggttcacttttcacttaattttgttcccatttgtaggcacttttcccattgcatccctatatgtaccccattacccttggtatccatttccagcctaacgcttagtagcagtactttcttattttttttattttccaagctaataagaaagaggtgtatttaagtagagcacacagttttgtcagtgatttatgaaatgtcattacaatgttaccttagtcagataaactgcatcttgaatctgttgcaaagcatctttcaaatgatcaccttggatcataacgtcttcaacaatatcataagagatctgcaaaaaatcaaattaggatacccaaccaggaaagcgtccaagacaacttcaagattcatttaaacaaagtgaaaaacaatgaacagcttaatgagaattgatccacatacctcatttctctttgtatgaactgataacatctttgcaagagctcttatattagcgaggggtcctcgaatctgccaaagggattcttgtaagatgaatactatgatgtttttcagttggtactttgaagttaaaaacttgcctgttctactaagccactcattctaatattgttttgccaggaagcttgctgaagcaaatatgctttctgcgaggaatgcacttatgtgaataaccaaaatatataactagcaatgtaaactagagcaggcgaggaattcagttatggaatattttcttcagtttatcaagagcatatctgttacacatgcccatgttttatgaataaaacatcaggaaatatttcacatatgcctgctgtatatcaaaggggatgcctcaaaactgcattcctaattgcatgttttcccaaattccaaaataatatgtgtctacaagaaaggttataggcattggctggcaacagttaatgattccagtcaaaaacagttaatgaatgattttattttgaataaaaattatctaatggtcatgaacaaactacctggtccatgacataagccattgctaaagttcgagaaatcataagtgcactatttttccattcagtaactaactgagcataactattagcttggtctccagaagtttgaaaatcccaagtttcccctttagtatatggagttatatctgatgacttgtctaagaatgagtgtgatggtatctgaatatcagaagtctcggagttctttgtacatccaactagttctgggagctccgcaacaaggaaaccaacaacaaatgggtgtttcaccattggaaggactacagctccaaattcagttatgatttccatctgcagcatatgagatatagtaatcaatgaaattaaaacaaataggaagaactgacatgattaaacttgaaagctcaatagctgctgtaactaaaactggatgagcaggtgtggcctgacaatctctttaacgctaacattgccctactatttgccagttgcatgttcagttgattaaaaaataaataatttactaaaacaagtttatacactaagttttaacccacataaatggtaaataatgttgttcccgctgtatgcacaagtgaactctgcattggttcataggcacatccgcacatgtggtgacaagaatgaggtcaggtgttcgttaaccttttgtccaatcaatacaattcttaaacgaaataaggtgcttcattggcagtattacaactatgaaaagtaccatgtggattaaaaggcaatgaataatttacctggtgttttacaagaaaagcttccgctgctcttagtccagcagatatggtgaaattaccaactagaatcactgtatctcctttagaaacattagtttcaggatataaagcaactcgacgtaattcaagctgatccataatataactgccagcaggtcttacatacaccttcaaaataaatagataaaaacattttctttattaatttatgaccacataggttgaaataagcacctaataaattcctaacaagaaaagaatttattcatctaaatggcagataagctaaaaacgaaacaaatggtgacatgattgtttcagattaatcgcggaactagttatttgctctcatactttacacctccaaaggatgaaattcagaatttgctacaaaaaacatgaaaactgttggcactcacaaacactttgctactccatttttgtgggctgaggaatcctagtgtcatttgcaggggctaatagaaaatttccacaaatgaaaatatagcagttacatttccttttgaaagaagaaggggatgcacttcaaaaccttttctacgtagtctagaagaaaacaaacttctacactccttattaattattagagtaaatttcacgaaaccacatattttacggtgaaacttacataaaatccttggtattttgactggtggcacataaccccagccatcatggttctaaagtttcacaaaacctcgatgcatgttgactatggatttaattacttaaaattttaaaatatagagtgcatataattttttataattattgcgttcttgactaaggttgatagtttaactcttcactaatttgcaaaatatcgtttcagatatattgaaattaatcgagatctgtctaaaggtgggttttatgaaacataaggaccataaaacctgtggttatatgccacaagtcagaatatacatgtggttttctgcaacttaaactataaaacttgtggttttctgaattttactataattattattcagttaaatttaatcatcaactgttcatgaacaaatgttgtgcacataagcacaattggacctggatattaccatcctggactcctgatatcattttgttgtcatccttaccttattatatgttctccaatgtttcgatgtactttttgttccttaaaataacataagatggtagtacctattctcatctaataactatattgctcataggtgacttattttgagcagaacaagactgtaggagtagcaagcaaacctatatagtgctatcaatacatagggaaaaatatagcttacagagaggacggcgtcgcgggagatgaccacccggaacatctcgagctgctccccgcacagtcgccggaagtcggtgctgggctccgtgaagcctccctctcctcgcagcttctcattctcctcccggtgcaccctcctgaaacgcaccggcgacgcgctcgaagcacgccggatggcctccgccacggccgcagccgacggcgtgccgaggtcctctacctcttccccctccccctccgctggagccgcgacgtgacggagcggctggcacgcggcacgggcgagcaggccgtggggaaaggagtgctgggcttcgatggcaacggcgggtctgggattgtggggggtcgggaagcgggggaggcgaacgcggagggcgaggtagggggtgtcgaggagtggcatcgcggtgcgggaggaggcggtggcaacaacgccaaggggactattgggacgacgacgttggtttggccattggcgagccgcgagcgccagaaacgaccggcgtcgaccggattgcggagagcaccggacacaagtttccgctaccgcttcctggtgtggctgaacagtggcttcttgccggggctgcgtgcctgtgcccacaaacccacgaccgtcgcgttagccagagaaacgttatccttgtatggatggattatagtttctccctttttaaaaacttattttacaaataaattattaaaaatacctattcaataactaaactattttcatggcacaaacatcattatggccatggtcgacgctgccattgatattgcatcgtcccccttgccttccacataacctaaattacggttgagaaagggttgttgtcagtgacaccaatcacttgtttatgaaaaatagtttttaaaaaaactaaaatgtaaatatttttttcttataaataggttgtcagcaccaactactcttgtgctgagaacctatttgtaaatattttttattaaataagttgttatatcttcaatatatttttctttacgtttaacttgtcattgattttgtgttgaattgtttactgttgctaaagattggaattttttttcgatcactaaactaagttttaggcttagtatacgttgggagaaattttttcaggatttaaacgttaaacggagggttcattttcaacactagcataaacaagttaatgcatacgtatgtttatattaaagttctcatccccggaagttctcaagtacatctacagctatttcccgagcaaactcctaggcttcatcaattagctcaagtgcgtgctcttctgacgtcccatcggcgaagccatcctagcggcagttatatccactcggggatacaaagattttgtcatcgccaaggcctggctagctcccctggtggcatcctctttgatactcttgaaatatttgcttggagaacttcttaacttgtcaaagatttctatgccatcttccgagttggagcccaagctattttgaaatatggcattaaggactggggtcggtgcactagctatttcatcccgcacaggctcagccctttctacccttttagcgaagacatcaaattgtgcctaggtttttggctttatgggctacaagtcaagattgacattttatcacaaggtatataacggcaactatggtagcagtgggttagtatgcttacctgtcacgcccaaaaatttgaaaataattgaagaaatgatgcccccttaaaaaaaatagaaggaagatgaaagatgtgatacactttctagctgaagaacttatttagattgatttccatcaatttagaagacatgccttagtcttatgttcaggaattttcgttgaactttagttttccattcaattgtgaactcggctgttttgtggatcttttttttttggctgtctacgtatctgttgacagaaaatcctacctcctatctttcaaattaattttggacaattggatctgcttcaagattcgttcagaccccttaactctaactcctctcctcctcccccatccagatcgcaccgccactgctcctaccgtcccttgcacgatcccccgtcaccaccgccccaccgcgccgccgcctgcctcgccggctggatggagggcgtcaacggcgctggcgatgccccccggccagcctcctcccccttccccctccttcctcctcgagccgtcggcagcgtgatgcccctgccaccaacgctggcccactggtgtcctccagcccaacggctctagtgccaccgtcagcgcctcgccacccacccgatccgccacccactgccgggcatccctctaagcccggcgaactcccccttctttcccctccccctcccacccttcccaccccacccacccccaggaccctaattcgtcggcccttcgctagagtttgggttgtcgctggcgccggagaaagaagaggagttcgtcggagttggagaagaagcagttggagcacgaattgcgaagcacatccagtgaaccaaaatttgcaaggtttggaggtaggttttctgtcgactgaagtttagcaattctgttttttttttttcaccgtgctggatggtttaattttaactacatttttttattgtatacagagcgttgctattttacaattgttggtatttcttaacgacattacagaaatataattctcagcaatgccacagaaatacttctggtatattatggttacagagttcatccgcaagcgcacggatataccattgtaacatttcacccgagagtattccaagggtatcgtattaattttatctgtgggaag

SEQ ID NO: 58501 - DNA, 36527 bp, Oryza sativa
  unsure (1)..(36527): unsure at all n locations
aggtatgcagctggtgaagggaattcagaatcatcaagtggagaaatctcaggttctagcagtgggaagatggatgcaactcatggattgcagattattggtatgagtgctactatgcccaatgttgcagctgtagctgattggcttcaagtaagagaacttctgtaatttttgttcatactattatctgtttttttaagaaatgctgttatctaccataaacatgcttgcagtgtaatatcttacggtcattcaccatcattttgacaagaataatgtattatttaaccaaactgtctaatgaaatacagtagtaagtagtaacaagttatgtatgctgatttgctgaacttcaaagtttcacatgtatattttttgtgagttgattttccttttaatgataacaccaccatacttttgattattatgctgaaatgaaatagtgtactgtgctgaatgtacaagtagaaaggatgctgggaaccattgcattacagtgaggattctactgaattagctttttttttttccgagaaaaccataaaatttagcctgtcctgaggttccttgtagtgtctccacaaggtggtggagggctggacaaacactgtgtgcatcattttgacagttatgtcttaagggcctaattagaggcatctaaactacaaatgactgatgcaaccaatctgatttttatgctgcagaaggacgaagaatttactgctcaagtatttcactgaaaataatgtggaactgtgcgatgctctatagtgttactatatttgacaaacagtattagacatgctctataggctttcaacagtatttgacaaacatatttacagtggtacgggacattgacataggtgttagagtatgacttggattcgagtatctgattcagcaaatttggagaaaaaggattcgaagattcgtataatacatattttataaacatattatataatataaaatattaacatgtaaaatagtcggtcaaacacttaaaatacttttaataccagtgttccaaggagtattgtggacataagatccctttcctatgtctgttgtgcatggaagcttcgcttgtatgctcattggcttataagccacaggccacagccagaatttgaattttattagaacttaatttcagaattgattttgtagtttaattgttttctatttttcagccttggcttttggaccaataagaatagagtataaaagtcttaccctatttttttattactttgtttattttctaagcagtacctcaaaaggtgcaggctgcatgctctctctccagcctcctgcaatcctggaaaagctgcaacctttccgcctcttctttgtgcgcacgcacacactctctctcttcacttgctttacctcttaccgcaacttcgttcctctattatcagcagctgcaagcctgcaactctcctctctttcctttggactctgtcagatgggtgccgtcccacgtctaacatgcgttgacgcacgcgtgtcaacatggtaaaagaaaaaaaaaagggacttgcgagtcccagtaacactgcatatttatcaataacaactgtcatgaatattgctataaatatatctaagagaatttcacaaaattgcaattattttgtcaaaactatcactttgttacaattttacatgggtatttcacaaaactgcaacaatagtgaacgatttatcacaaaacaacaactttacctcctatgtgtgtatggcatttgggcccgacttacaccatcataagtattgcatgtgcgtatgacaggtaggctcaaactttgtgagaaataaagttgcagctttctggtaaaatcatacactttgaaatgtctagctgaaattgcagtaaattgataattttgacaaaatagttgcagttatctgaaatttactctattatatgaaatctgcaaactgaccttcaaataccagcttgagtctcaatgcatgatagaaattgttttctgtttgtttaagtcttgttgatttttatccagtctatttgttccttttattttgtgaccgtttaatttctttttttttgccgggccggcgaatagccggccgatgtatattaagagtaagagaccgtttaatttctaacacgcacaacctaatttgtaaggatttatacctgtgttttggttgttgacttgattctgcagcatttttattataatcttccttgattatgttgctttgctaattcttgatctttttggtcaatatgaaaggctgagtgtgacaaagtcttttgtgtttcaagtggcattttactttatcgtaaaactaaaattggatgattcatgtgtatctgatattctgctgcataattaggctgcactttaccaaacagaatttcgacctgttccgctggaggaatttattaaagtcggtaatcaggtctttgataaagatatgaatgttgttcgcgtgcttccaaaagtagctgatcttggcggtaaggatccagaccatattgttgagttgtgcaatgaggtaaatactttgcgctatttagtctccagtaaccgattccttactatctaaaatatatgtgtacacatctaccttgttttgcttcccaggttgttcagcaggggcattctgttcttttgttttgctccagccggaaaggctgtgaatcaactgcaagacatgttgccaagtttttgaaagtggcttctgttggatcaagtgacgttggctcagaatttccagatgctacatttgcagttgaagccttgaagaggagcccttctgggttagatcctgtattagaagagacccttccctctggagttgcataccatcatgctggtttaacggtattgtaattttactataatttctcatatcatgccatgaagagttggtggaccttatttatgccattgtcgttgcccctaagcatttagaatctgcactgcgtagctgaatgaccttttttttactacattttagtagatgctgttttgaatttattactaatttctaaaaccattccattacttcatgacaacctttatctttcagtaggactgtaggaaacatgaatgtatgcattgtacttttcttgatgtctattttgacaactattctcctagctattgatgatcgtgagcttataatatgtagtcatttctgtttcatacaagtacggctttctcttttggcaggttgaggagagggagattgtggaaacatgttaccgtaaaggtcttgtcagagttttggctgccacttcaactttagctgctggtgttaacttgcctgccagacgagtaatatttaggcaacctaggataggtcgtgacttcattgatggaactcggtacaagcaaatgtctggtcgtgctggtagaactggcatagatacaaagggagagagtgtaagatatgaaactttcatttatactagatgtttcccatgaattcatcagcttagtttcaattttttatttatgtatctggttgtgctgatgttttcttgtttatgaatgtctaatactttgatatttgaaatgtagatacttgtatgcaagcctgaagaggtcaagaggattacaggtattcttagaagtaactgtactcccttggagtcttgcctctcagaagataaaaatggaatgactcatgcaatcatggaggttgttgctggtggaattgtgcaaactgcaagtgatatccatcgatatgtgaggtgtacgctgcttaactctactaaaccttttgaggatgttgtgaagtcagctcaggactcccttcgttggttatgccataaaaggtttcttgagtggaataatgaaactaaaatatactctactactccacttgggctagcagcttttggcagttcacttaatcctgaggaatcgttggtaggttactttctttagttattttcaatattttttaaatttaatcttacaattttctatttctctgtgtaggtcgtgctggatgatctttcaagggcaagagaaggctttgttctggcatgtgatttgcatttggtttacctggtaaccccgataaatgtagatgtcgaacctgattgggaattgtactatgagaggttcatgcaacttacttctcttgagcaggtatttctgttgcatcttagaacgttttttctccaacaattagtctgagtacatgtaatattttcatatcctatttgtgtatatcaatagtaaaggaccacagactgattcttgctattgtctatattgtccttatagcctgacaggcaaccatccttttcaagtgaaaaatgtatatatttttctctttacccaagtaaaaaggtgaacactaagatgacatattgagatgatcagataacttaaaatgtatcaagtgatgttgtcaaggaggtggcattaaacagtatgttgttttactcttattgtaaaatggtagtgatactaaatcaaataatattcatgtaatgcatcacaaggccatgaactcatgcacccactttacaagttcatggcactatgctagaacttactctattttatctatagtattgatgcttgttggtaatgtgcagtcagttggcaaccgggttggagtaatagaaccatttttgatgcacatggctcatggggctgcaatgcctgttcgtggaaaacctcagcgtgctggtatccgcaacaggtcaccaacacgaggttctggtggaaatgcacttattaatgagcaggcacttcgagtttctaagcgcttttatgtggccttgatgttgtcaaggcttgctcaggtataattcaactctgcaagattgtatcatcaatttgcttactattcctgaaacctagtagtatgttaacgatctatctctgccatgccagcaaagtgcattactctaattggttttggatctttttttatttgtaaatatagtatgattgaatatttaatgaagctatttaatgtattgtatctttcaggaaattcctgtcacagatgtttgtgaggcattcaaagttgcaagaggtatgattcaagctttacaggaaaatgctggcaggtttgcttcaatggtttctgtgttttgtcagagacttggttggcatgatttagaaggccttgttgctaagttccaaaaccgagtctgttttggagtcagagcagagattgcggaacttacatcaattccatttgtcaaggtttgcttatgtcactttgcatgcatgataaatcctaagttttgtcccatcatatcttcctacttatttttatatgttaatatgttatgggatgcagggttcacgtgcaagggctctttataagtctggtttgcgtactcctgttgccattgctgaagcatctattcctgaaattgcaaaagctctttttgaatcttctacttggtctggccaaggtctaatactctagctatgtttaaactttctattaaaatatttgtgtatgttgtgttagtctgaggttctgagactacagtagtgctgcaatgatggtggtggtggtggtggtagcagtagctttactattagagaaatggtgaaagtaatagctcaaaagccatcaaactcgtaaattagtactcttaacaacctgagaacaagacttctcttcctttggagatggctgtaatgtgtagtccacattggcattcctttctattttctatttttgttttcctctctttttgttcaacattttggatcagtttagtatcaaggggtcagattcatcctattggcttatttcttgtgattttcctgccttgtgtaataatatctgttcaatggactaggtgattctggtttacgccgaatgcaattgggtattgccaagaagataaaaaatggagctcgaaaaattgttcttgaggaggcagaagcagctagagtagcagcattctcagctttcaagtcacttggtgtacaagttcctcagtttactacacctctactcccaactatcgatgaacccccaactcgagatagcatggtttctgttggcagaggtcaagctagtgatgatacaaataactgcttcagttatggttctcaaagggcttctacagagagaactttagggaacgatatgcaccctggttcttccatacaaataacagagagtgcaagaatagtgaataatgccaacatcgttgtccaagtagcatcacctttctccatagaaactaaattaagcagcagaaatgtggctgacaaaggccctgttaatgcatataatttcccaggagggtttgacagttttcttgatcaatggtctactgttagtgagttttcttttgatcttcattatgtcaagaagtcaattaaatcatcttcaacctatttcgatattcttggtttggctgtctgttgggaaaattcacctgtttactactgcaactttccgaaagacctaatgatggctggtagcaatgactccattgaaatgtgggacgaactaacgagaagatggaacagagtaatcgaaattatgcgacaaaacagtgtcaaaaaaatgacctggaatttaaagttccagattcaagcattgaagtatccctgtgtttcttgtcaacggctctctagacttcatcttgactacaaaatgttgaagaatgttgaagtcctcgacaacttgtatgttttcctacaaccagtttctgtccacagtggattggacatatgcttggtggcatgggttctctggcctgatgaggaaagtaaaacagtgccaaatcttgagaaggtataatatcttatgctgtgatatagaactcatgcttggtttcctctttaaatgttttcatggcaatctctttcaaccttaacatttcccaatgatttgttaattttttgacagaaaagatttcttaattttgatgctgagatatttcagaaaatgtactttatttgtaatttttacctgatattaattaatagttagtgaagagacgactacacaatgaagctgcagcagctgcaaatcgagatggcagatggagaaatcagatgcacaaagcagctcataatggttgctgtcggcgtgctgcacagacacgggcattgtgttctgttttgaggaaattacttgtttctcaaaatctcaatgatttactcgaaacaattgagggcccattggtacgttctacccttgccaaaatgcaatattgtcatcaaatgctttgacattcacattatatttgttgggcaggtaaatgttcttgctgatatggaactttggggaattggtgctgacatggatgcatgtctccgtgcgaggcatatcataataagaaagctgaaagaactagagaaagaagcttataaattagctggcaagagcttctcactaannnnnnnnnnnnnnnnnnnnnnngttctttatacacacttaaaactgccagttccaaaaggttgtgggaaaggaaaattgcatcctagcactgacaagcagtccttggaccatctaaggtataaatttgatctatttgttgtgtgtgtcatttctaggcattgcaaatttattatattagcaagtgtttttttttcctttcaatgtgccagtcacaaacttttcatgattcaagcatttttgaaatttaaaatgtatttccttgtatatctagtctcaacaatggttcactgacataatgtcttcatgttgtattatgtctggattgaagtatccttgtgtccattctagtttctgcatgttgaagatgtcattacggtgttgtcttgatctaagctggaattattggggtgccatcacattttattattatgtctgattacagtatgtttcaagagttgcatgtcatgtttggcttggtgcttcaaagaattatagtaaagtgagggtcagggaaggaagaaaataattcttacgcctttcagaatgtcatggcaatgctggctcagaatttgttgaacatgccaatgagttggccagggaaactttattacaagtagtgctgtaatctgtatattcttttgatgcttcactcaaccctcacgtaattttttgcaagtttcccaaggaaagtgtttgcactggtaacaataagatttcagtaaatgtggagaattgctcttgttgaacttctaacttagatcatcactccgtctaatagtcttttgctctgtttattcagggattgacatgtatttagagatgctttggttttgttcatttttaatacagtgtcatattattatgctctttttattcagggatcaacatccaattatatctgtaattaaggaacatagaacattggcaaaactgttaaatggcaccttggggtccatttgctcacgggctcagttgtgcagcaaatcacaaagatacatcatacaaggaaattggctccagacatcaactgccactggccgtctatcaatggaagaaccaaatctgcaggttatgttacattattgctagtgttttgtataatatgattatattcataggtcatagcaatgattgactgcattttttccttagaaaaaaaactgactgaactataatttgtagtgtgttgagcacttggtggatttcacaacattgaagaatgatcatgattccacaagcatgtcaatggttgatcatcatgaaatcaatcctcgtgattttttcattcccacccaagtattgctcactcaacaattgtttcatgctgtatatattttcctatcgcaagtaaggtaattttgtggtctcctttttgctaggagaattggttgctggtaacagctgattactcacagatcgagctgcgtttaatggctcatttttctaaagatactgcattgattgaacttctaagtaaaccagatggtgatgtatttactatgattgcttcaagatggactggtaaagcggagtccttgatctgttcaaaggaaagagagaccaccaaaagatttatttatggcatcctctatggaatgggtgccaactctctagcagaacaacttgaatgcagcccagaagatgctgcacagaaaatccaaagttttaagaggttctttcctggtgtctcttcatggctacacgaagctgtggcatcatgtcgtcataaagggttagtttgctttgtcatagccatttctgccttttatgctctgatatgttttccctttgatttttttatcttttcttttgaggtgaaacattaggggtagaccctactcgaagtatagagtaaattgcattggtggtacatgaacattttttaagcgagtacacaaacttataaaacacttattttgatgcgcaaacttgttttgtgcgtgcgaacctaggctaaaaggcatatctggctgctattggtaagttgggtgctaattaggatgcctcgtaggcacacacatgagaacatagtactgagtaaacgtagtactccctccggttccataattcttgatgttttggacaatgacatggttttcaaaatatatctttgactttgtttttctattgtaatatattcaataaataaatgcatgtttacttttcttatagtactttgaaagataaatctatatatgttgttctatttcctttaagctttatatttttaaagttattgatgatcaaagttataaaagtttgacctctaccttggccaaaacgtcaagaattatggaacggagggagtactatattataacgatgatactacaaagaaaacatataaaatatagacgaatgatgcagtggatagaaacaaagaaagaacaaactagaatcaaaatatagaggtgatttgcacatgtaataagtctcttgtcctcaggtatgcacgtaacatcgtacttagcgtccaactcggtaaatttagtcacaatgtgttgttttagcatcagtttgcgtgcattggacaagttcatgtaccaaaagaactgttttacaagtttgtgtacttgatcgtacccatctaacaagtttatgtaccgccaatgcaattaacttggaaatatatatagcagttttaggcaccatgttgccaaggcagaaagcacccacatagatacacccgttgcagtactgtgaggattgttgcattcgacgtgggcatcgtcttatacccacaagtgtttttgagatagaaattgtgaagaaaaaaatgagtatattgtatattggggcacctatcattgccaaagtttcacctattgatcgaatgagcaatgttttcactgagtgagggccaggtagtatttcctttttgttgcactttgaagtttgaaccaatccctccctccatcgctctcactcgtcttccttaactttggatggccatctccttgatcaatggcagcatgacatgaggtgaggatgggagtcggcaggctccagtttggcaacttacagcggtgtgaggtgatagggctgcagcataagtaatttacctgctgctaccttgggcgtggcacaccagattggaatgacatgtgtccagctggcacatctttgtgagctctgccactgctcccctcattgagcgtttgccactagtagccaactagccattgatcgaggaggctggaaaaaaaaaagaattcaacttgagttaaatttgtttgaactagtttcaattagatcaatatgttgacccgtgtcaatcatttttgttattttgaccagtgtggtagctggcaatatagcatgcatgattgttaatgaaatctaagttttccaagttaaaaaacatattgatgaagcacattttctggactgttcacaatgccttgtgcactactccctcatcccaaaataagttaacctagtacaggaaaataaggtaacctagtacaggtgcctgtccagattcgtagtactatgatatatcacatcctgtactggtttacttattttgggacggaggacggagggagtactagaagctgaggacaaccttaaacaagaaacagctaacacacgggtgaataggtgcatctaattcagttaatctaagaccagtgcaagaggtgtattcacagtgctatgaaaagaagaatgggggtacaacacgcatgaggttgcgtaacctacagggaaaggcacatctgtgctttctgccaatgtgtagaagtacatatcttataaagcatgaatcctctgcttcattttataaccacccacatgtcaatacttaaaggtagtgcctaagctattatcacttatcaggtatgtggagaccttaatgggaaggagacgttttctttcaaaaataacagccggaaatagcaaggagaaagcaaaggcacagagacaagcagttaattctatttgccaggtaatagagcaaccatctttcttaagctgctaggttcttaattcactgcaatacagtatttaagtgcaagtctttccagggttctgcagctgatattatcaaagtggctatgattaaagttcattctgcaattacaaatgggagcacggtgggagcaacagttgattcaattgatgtggctatgcagaacttttctgaaatcagaggccgttgtcaccttattctgcaggtatttgatgaagctatcatgaaatatcccatttttcctggtcatacatacatatatgtatgtatcccattttccatcgttgttctgttagtttgcttgtttagatgatggtaatcctcttctgtgttttaggtgcatgatgaactggtgcttgaagttgatccatgtatggtagcggaggctgtaaggttactacagactgtcatggagaactctgcttcactcttaggtatcactttctaatctgaagttctgaatcggatactgctagttttcattttcaagctgaaaattgaatcgctatttgtttctttcaccagtgcctttacgcactaaaataaaggtaggacaaacttggggttctttagaaccgttccatctagaaccttgacgcgatggtgaatgcttctttggagcaaggtcccaagaaatcatctgtttgttaatggaaaggctaaggtgccattgcagtcagaaaggctgggtcaggttattcttgcaaacttctctgaagccatgtttgatctgccaagtctgacaccactttggattcgaacttactgtagcacgattgatgttgccaggttacataaattgataaatgcattccttatttcataccttctaaattctggttttggaaatagtttttgttctatcaaatctgaaacttgaatcaggtgatttctctttctgcagggccttcggtctcctttcttttattacgtgccaccttgaatctatataaaacaggttacattgcttcagttacggagtccattgttgagaatgaggattgaaggacaggccaacggttccgactgaagctgcagtaccgcctatacaggattcatcacattattcatagagcagacaaggggaacatctcaaggggacatccacttctacagtatatatatattttttttgcgaggacttctacagtatatatgttgtactgtaaatggacagactgtaatagcttgttcattcttttttgcctgatgtcttgattatgtatatattgattatagaggtgttgctcgagttgaagacttgtgaaactgtcatgttgcacagtacttatcatttatgagagtaacatcgttcgttgctctttttgtgcattgtattgtacagtattgggttacattgcactcgagcaaacttttgcgagtcgtgttgcttgcttattttcaatctatagctgcatctttcttggtcgccctagctatatgtatggtcgttgttgagaaatgaggaatgactgccaaagcaacaaattgaccttatttacgttgaagggcagggtgctgctagcgctttggctatcaagaatgctagtattcttttttttcctatcctttacaaagtcaagtgtcacaaacgaatcgctgtgttccgttcttgattgtatgtcatcctttgcattccattggatgtaacatcgtcttttctttcttgccaaattagatattgtctgcgggaatgtaataagttagctgatgctatagtatccattggatgtaacagtcccccaaacaccgatcttttgggacggtgcacctccgggcgttgagggtttggttgccggcgattttgtcgctttcatgggttaatggaaacatgaagttttccttaaaaaaaaaaactttgcattcctttgtcgcgcagaggcggttcgtccgtcagcttttccgatgaagcaattgccatattgccataattgctactgatactccatcccaattgttcttggaaactatatcatctcatgttgttttcttaaaataaattatcataaccatctctcttttcttccatttcatctctctatcccctcatatattgaactggtttcttacatgataaatgatttcttcatctttttgttttctctgctcaactcttttgcaacatcattttttttcttcttacttatcaacatattaatgctataaaaattagttgaagtgaagggtttcggattgcactaaccatcatatattgcccatttgcattgatgttgatcggtgaaatcgtacactccattccacgcacacgacgcatcgtacattgcacaaattcgggactagatacgctacaacccactaacttaggtagggatgtgatcccttctagtacgatgaatctggatatccatatatcaaaattcattataataagggaccacctatacatttgtcgacaaattttctcctaaaaatttgacagatgtaattatagtataatcgtagtgtaattacactgtaacttatatgtaattacactgtaacttgcaggtaactacagtgtaacttgtatataagtttcacgtaattttgaatcgttaaatctattacaagatttgttttattgaggaagaaaaaaaaatcacgacacacacatatgtgtaaggatttattctcacaatctccattttatcgaaataacatattacacagatatttttgaaagttacatacaagttacactatagttacagtgtaattacatgcaagttacagtgtaattacactatgattgtactgtaattacatctgtcaaatttttgggagaaaaattgttgacaaatatatagcaaaatcgttataataaaaggggttacatcctttttagttgagttttttttttaaatggagagagtagcaacgagcaaagcataattttcgtactgtaccattttgcttgggaacgaacaaaactagagaggctgagcaaccaacaagacacggccagggtggatcgcccatcccgtccctgtggtccagaggataagccgcaccaccacgcgccgacacgtggctgccgacctgatgggcctgccagcttggccggccgcatcatccccggcgaagcggcagccactcctccccaatcctctcggcagccaaccgtggccatggatgaaatgacatgatacgattgctgtttatataagctgctggtgaaccagcgtacagggcctcaacagcactgctactggacatactctactactactagccagtaagctagctaactaactacgtggctatggcccccaccgtgatggcctcctcggccacctccgtggctccattccaagggctcaagtccaccgccgggctccccgtcagccgccgctccaccaactcgggcttcggcaacgtcagcaatggcggaaggatcaagtgcatgcaggtatatatgatatatacctcctcaggcttctcctttaaagtcaaggatcaaattaactcatgttacgaaattcaaattaacctgatttaaatttttacattatttattcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatatttttattttacagtttggttatgtaccatctcaatggcctctgctcttaacacatatgtaataatctcttccctccctctccggccggttttattgtaagagtactacaattatcgttgggtgaggatatgtgaaaacaaagctccggctatatacacacaagatatgtatctagagcatatctgataaattcgtcgacaataaaaaaaatggatggtatcacgtaattatgtttgtttttaagtatttgtttgcaatgtttgtttctatgtttaaccgaatgtattgtgaatataggatctgacataattatttgtgtaagttaattagtaaacgaatgtatttctttttgagagaacaatgatttgatcttttgtgcaacggctgataagtccttaaaaaaatgaataaatcaaacaacaataatttatctcagcacagtacatctcagttcacctgactgagcacgttagcaacgagcacagcatatttttcatattttgcttgggaaaacaaacaaaagttagcaatcaacgacacacggccaggttggatggatcgcccgtctcgtccccgtggtccagaggataaggctgatagccatgccagcctgcccgcccgcatcttcaccggcgagccgcagccactcctccccaatcctgtcggtaaccatccaaagcgggaaatttaactatttgccactcttatgacatggtaattaacgatttgccacgttctgtcaataacacgtgggccctcatgtgtctatgacatgtaggtctagtgacaaatcgttaagcactattcgtaagagtggcaaatagttaaaagctccatccaaagcaacgggcatggcttacatttctaatcatttgagagggtgtttccttgtgtatctttttctaaattcaatacaaatagttacttctttaaaatattaaaaatatagagtatagtgatatacaacactctaaaaaaaacatcaagtttaaatacaacgtacacattgagaatcaaaagaaacggaagtcgaatgtaaatagtactcttttttatatatcaactatgaattgaatttggatataaatataaatgttattaaattgtttgagaatttttctataactatttgaatgatttttagaaaaaaaattcctcaagcaatgcttgagtttaagatgggggtattcacttaacctttacaaacctcatgtccctagctagtagtgtttagtgggaaaaagttagggtatttaagatagttggttaatagattagaagtggtgtgagataggagtaaaaagaagtggatttatctctattattataaaaattgaagatgtttttgtcgatacgttggtacgttatccgtgcatgagtcgatttttaattttgttcgcttttggaaatacatatccgcatttgagtcacttcgctcacttttagaaatacataaggactcgtataagatatctatttaaaaaaacccgcatgctaacttgagatgattagactcctaatgtagctcatgattatatatatatatatatatatatatatgtgtgtgtgtgtgtgtccaagccaattatcacagtgaatttcatcttaactaaaccatataacaacaataagattaaaataaccttcgcctgttgtgaggcacggacatttttttcatgttgagaaaaacgatcgagagtgacgtattagatgtagttaaatatatacatatgagatatatctatatatattaactttatttcatattttttttgggttttccggaaatgctcaggatcgatcccattgggtctgcccctgccctttgagatcgaaacagttccatagttggcgttatataaggtgctggagcctcaaattgagacatgcaatcatcctctctttatttctactgctaagcacataactactctagtactaataagctagctaactaagggtctgttaagattgatgccaagagacatgcaatcatcctctctttatttctactgctaagcacataactactctagtactaataagctagctaactaagggcctgttcagattgatgccaaaataagccttaccaaaatttatcaatgccaaaattttgataaattgacaatattaccaaaattttagtaagattggcttaataatgttgccaaaattatataaacattactaatatttagtaacaaactaaacgcagtcacataattattaattttaccaaataatgatatggttgaaaatgtcatcaatctaaaaggccctagctacgtaactatggctcccattgtcatagcctccttggccacctccgtggctccattccaggggctcaagtccaccgccggcctcccagtgagccgccgctccaccaactcaggcttcggcgacatcaccaacggcggaaggatcaagtgcatgcaggtaccatacgtcctcagcttcttcttcaaagtgatcgtgtaggatcgaatacagagaagcctattaaaggtagtgtaaatctctatctttgtttagcttttcggtgacatgcaaaacgtgataaactattagcatataaataattaagtattaattattataaacttaaaataaagtttatttgattctttcaagaaactactatataaaaattatttttgcaaaaaaaaaacaaaccatttaaccatttgaaaaacatactaacagaaaataaaaaaaagttgaagtttggagttgaaaaaaaaagaaacggctaaaagggatgaatgttagataaaatcaaagaaagtcagacagtcaaaagtttgaaaaacaaaaactaacccaacctaaaaatcctaaagaacatttctggcggtctgagcggacccatcgtactaaaaacatagttatgtaaaaacatgttttctctaaaactagctattggattaaagccaaaacttgttataataaagtagacaaaccatagaacaactccactgggtgaatttgcaaaccaatcaatgtttaagagaaaacatcctcaaaatgtctgttgcctcaaattttaccaaatctaaacatagcctaaaatttaagaaaatttgaaaccttccatatctgatctatgaagtattagaaatgttattaacttaaacaaaattgccgaaaaatgaagaatcacaaattaatgacaagacgaaacaaaatgtaaaacctacacaaccgaaaaagatcatcgacgccttgatgattgaatatgatctttattgtcaagcattgtccataaggtgtagccacaacacctctcacaaaatctctcaaaaccctaacacaatgagccctaatatctcgaatgtctcaattgtctttaccctcaaggcatatcctcactctctatttgtacccatggatgtggttgttcatagccacgagctcaactaaaaataggaatcataataacataggaaacccctcaaattaaggttacactcatccttttacaaatacggactcaattacaactcaaacttggacaccttccaaacttgacccctttccatacacatacatatcctcatgtatcctgcatgatctcctttcgcttgagcatcctacataatctcctagattgtctagacctcaacgtttcccaagtttactcccgattcatcagtgggaatactcccgttgttttaagcaacacctacatatagacaatcaagaaactatatccaagtacaagttctttccaacttaactcacattaacataaatgtagttcataatacacacatgaaacatctagaagtcataaacattaagcaccaaatgcaaaactcaattttaccccgaaaccgactccaaccaagaataccctggaccacctttagcattcctccagtcggtccaccatgtactagcttgaccatcaaggtcggtcctccatgtataggtcggaacatctagccttgtccagaacgcttcgctaatttaaacacttcaccaaagtcaattcaaacacttgtacaactagttgttcatcctaaaaccttaaatcagcacaatgattacacggatcaatcaaactaactgatgttcaaaagttcagagtgacctgattcaattgtttccatttgtttaggtgtggccggttgatggcaagaagaagttcgagacattgtcgtacctaccgttgctcaccgcggaagacctcctaaagcaaatcgagcacctgctctagtctgagtgggtgccttgcctcgagtttagtgatgtagggttcatctattgtgggaaccataggtctcctgggtactatgatggcaggtactggaccatatggaaactgcccatgttcggctgcagcgacaacagccaggtgatcaaggagctcgaggaggccaagaaggcatacccagatgcattcattcacatcgtcggctttgacaacgtcaggcatgtgcagtgcattagcttcatcgcctaaaagccccccgagttacaaggaaagcaactcctttgacgtaaaattagacggatagaagtccctaataggtggagcccatcctcatgggaccacacatcaagggcttcatggcctacaagcccctgggttgtgaggagtccgacacaactaagccaagatcaagcatcacagcacaaaagtaatgtctctttagcaatgcatagtttctaggagccaaaataatctatatgcattgcctttgctgttgttacaaggatatgtgctaatacatggttatgcttggtaataacgctgcaatgttgcaacggataagttcagctggaacactactttaatatacgtttctaccttctataattgccatctttattttgcattatatttttttttcagttatcataataatcaaattaattgtatgatataatattggaatgtttaaatcacatcaataggcaatgaacatcaacgcatcatttcattcataagtaggaacgatatattttttgggaatacaatataatcttacaaaaatgcttttgcaaaatcaaattaacatgtcccacacctgaatcgaatgctccaccaaggttgctagaggcgtgtcacgagtaccttcgatagaacctgccgaaattagtttggggctgtccaggcgaagcatgacaacaaaaccctgattgctgtgaaggcgaaggattagggcgaaccacgtggcaaagcccaggaccttcgcccccaagccaaatgtcttcgcccagtccaatggtcttagggcccgaaggggtcaactagacaacgaaggcccaccttgcggcccaagaagatgcccagggttaaattttctgtaattatcctcataaatgtccctatcgtaagtgtatctatgtaaattcccttgtaccaagtaaacctagggtgcatgcgtttgtactaagcctataaatagaccccaaggggcatttattggggggatccaaaaatttcaatattaatacataatttttacatttccacaaagagtgaaccacatccttcgacggacgcagttgtcattcgacaatagctggaaccgtctgtggggaacccagaccaaaaccactaattattcctccgtcagtttgattacctcagttgttggtagtggtcttttgttgttgaggttgtccttgaggtaacgcgcgtaggtgggcacttgcattgtgtccaacaatggcacgatgatgtggattttctggatcacctaaacaaaacgagcaaactgctcgtccaccaatggcttcttgtatctttgagggaatggcaacagccttgtgtcgcagtactcttgcggcaaggtcttctctggctgaacctcttcattaaccgtgttgtcagatggtgcttcccgagtgtggctagctcctgcaggattaggatatggcggatcgcgagtggacttacctcccctcatcgtgatcgccttaacattttcaacagaggatttgggttgccccagaatccttccagattcattagcaggtactagagcagctaattgtgccaaccgggtttcaatcattttattaaaactcagctggtcttgaaatgcagaagcgaagccatctagcttaacatttatattttccagggtcttgtcattagcagctagctttttgctaagagcatctgtagttttggtttgcgcaaaaacaagatccttcaaggaaggttggttagagaaattaccgttattgttgcctccttggaaatatgggcatggctggttctactattgacctccttgtggtcggaacccgttgttgttgttgttgcccatatacatcgcctcttcatgggtttctgagtagtcgttcctagaatgacccgtgccgccgcagacttcacacgtaaagtgcgagtctcatgccttgacggtgcctttaggtcatttctcgtggtcgtccaagcgttttatgatgaggtccagttttgcagcgagcatctccgtctccttgacggtgtgcattcttcgctgacgggtctagagtcgttcctcgctccagcacatgttggagaccttcttctctatgagatcgacggctcctctgcccgtcttagagaagaaggctcctccagctgccgcgtctaggtgatcacgggacgtgggagtgagtccattatagaagttctgcaggatcagccagtcgtccatcccatgatgaggacaggcagccacatactccagtagtcgttcccacgcctcgggaatagactcgtctcttgtctgctggaaacttgagattctcccacgtagggcattggttttgcccattgggaagaactttgataagaatgccgttgagcatttgtcccaggtgttggtcgtagcgaagttggcataaaaccactgcttcgctttcccaaggagagaaaacggaaacaatcggagcctgacggcgtcaggattgacgcccttcatcgtgtacgtgctgcaaatctccaggaactgttgcaggtttgcattggcatcatcgtctggcttgctacagaatgggctagcctgcgtcatcgtgatgaggctggacttcagatcaaagtccatgtctcccatgttgatttgcggcccagtggccatgttgtcaacagagggagcagcggactcgctgagggtcatgtcagccatggttttgaaggttggtggcacgggaatggctggtttctagtaacaatccggcccaggtggggttggccgaggcccaacaaattaaggttgcccggaccccaacagttcttgggcacatccactcggggaaaggcccaatctctctaaaagactagtccaataggggaagggtgactctccctttaaggtggcttcctcctcccaagctaagcaaggtgggattattcagaggctcacacggtcgccgcccgacttttgcgtctttgccatcgggtaatagtggaggatgtcctcatcagtttctttgtcgggagagttttctgtggagcaacgacccgcggcttgacgctccaaaagaaaacttctggattttccttgaaactttccggcaagttgaaatcagtcatacactaccctgtttccacaataaaagtgaaaacaaccaaggttagcatgcaaagcacaatgattatacagaggttaatataaagtattagttatgtaatctcttttataaatcttctccggcaacggcttaaaaatgcttattggtatttcttaacgacattactagaaatataattcccagcaatggcgcagaaatactccttgtatattatggttacagagttcatccgcaagcgcacggatatactattgtagtatttcacccgagagtattcaaagggtatcgtatttgtttaatcccgtgggaagattataatagagagaaccatactaataatttatatattacttgtgataaccaaagtctaaacaggggttaatgtaatccaaagggtagagtgacactaagcagaagaattaatactctcatacataattatctaaactaagtggaaagaaaatagagagaacctattcctatatttctagtgtttgatgaaaacaaaacaacgaacacacagaaataaggaaaccctgtattttattaatcacgattcattaacatgaatgttacaaatacatgagggctcccgtaggagttcgccttttgccttcgcgaggaatgcttaatagaaagatatgctgactggagattgcgtgcagtccgctgattcccggcgcctagcaatgagactaccggttaattacatccataggacgagcctacggaacacctccgattaagctgcgctttgtgattgtcatcttcaaaattaattactcgccgaaggttgaggttggtgcagatttaatggtgaatatagtgaatgtggaacaggtggctttatttcgccaaaacccgatcacaatacactaccaacacgtcggtgtgcggagagaatttggtgaagcgggtgacatttgcctcgtcggtacccagtcatgtatcccggccttcatcaaacatagattttatggtttcttttgcctcgtcggtgcccagcaacggtgtatccggctcccgtccattttagacgtgttaatagtatagtgacctggccttgtcggcactcggccatgatttcgtctagcctcatcggtaatagacaaatgaaatgaatgaatagcagtagccctgttagctttagccaatacgtcgcccggcctcgtcggtctcggacgtagcacaaatattgatgaatcggccatttcatctcgtcggtattcagccacgatgacgacgtgtattttaaatctgcacgcctcgccctcatggctagcgttgttttattgtgcgaataatgcttgtcttcaggaattgtgagaattgctcccatccatccgatagatttttgagagggaaagaattgctcccgtacatgacatgcacaaggcaatatgtgactcatctgacatgaatataaatatgtatagatcatggttggtctgatgctaataagactcaaactcatcctaagtttatacaaataaatatccacatccaatatttgatattgataatttagacggttcaaccctcacgagggtcaggctcgccttgtatttatttgcggcccatattaatcgcttgacaaaatgacgtgtgcgtctgcatgcgccactggggatacttatatccatggctacaattcacaacgcatccacgacatattcaccagtactccactttactgttttaccgtccaggctgcgcaactgcacaaccctacggtgtatatttgctccctctagaagataatgccgggctatgcataatatctgcacagtactacgacgctgttgtattgtcgatgacaaatagcttgacgaagaaattatgttgatgaagcgcggctcgacggaaggcgaatgattaatttagagttgcaccagcgacgatgaagcatactccttgacgttgacgattactttgccttctcctgattcctcccaaatatttgtgtggctataatattcaccatcaccagcacaggcctgcatcttggcgcagcgcctggcggcggcgtgtacgcgtgtgcgcccctcgcgaggagggcgatcaggccctttatataggcagagcagcagcaacggcgcggcctcatcctcgcgagttttcagcgtcgtcgacgtgttgtagataatcaatcaaccacctactgtagataaggaaattaacaaatcgcctgcatgcagaagcaatcacgacattaaatagctaatgacagtgggccccatgaatatatcatatgtgtttgtttgccatgatttatctcctcggcacagataaaccatgcacaaccatagagataatcttaagattaggatagcaaatgacagtgggccacacatgttgtttgccttggcttatcacttcgttattagagataatgcccaaatcaatcacaacaaaccaacccaagtacgtataatgctagtactagctgatttttccatttcaccaactcatatctcttcaatggttgattcgagaagcaacccctgattgccgagtttcttatgacaatccatcatgaccatccaaccggggctaaatacggaggagtaccctccccaggaaagtaacttaggactatatacacgcgcggaggaatacccgtactgagctgtcaccatcaacggcccacctcgcttccgcatcatataaccccaaataatgatatccagtaatctaaacaccacgcttaaattaccaaatactactctaatatcatcgtcatgacatagagtcatcgtatgcacgttcattatacccacactattgcatttcccagtttagctagcatcataatcaatataactcggatatatagtaaagttagtattcatatactcgtaaagtaatacaataccagagtagtataaagaagaatattctaataaaagtactaagtcttacaaaggaaggaaaactactagagctatattcgaactcttccgaagactctgaggattgaagattctattctatttctattccactgtactctagagactatactaaacttgagaaatgtatgaagcttcttgcttgaggtgtgtggaagaagtgagaaggtgaaggtcttatatagctttccaatgacggttgtgacggttggaatggtcggatataccctctaactgtcattgggagctaatccacaccgtccacgccaagccctgcatccaatggtgatgtggggggttcggtcgaacccactggttcagccgaaccatgggccggcccaaccagcccacatttcggctagtggcctcctcgtgttcttctcttcccagacttgtgaattttagcccaatttgagtatgccacttctgagttcttgccccaccttcctctaagtccgattctcaacagcgtccgattgatcgatcgtttattttgctgtcgattctcctccatttatgtttattctctgcaagaggttagtaatcctggcactagtggaatatttcttattttaacatgatatgcattgcaagtataactagtttttatttattaaggtaatattgatgggcgaaactgatcgataacgaccgtcaacagtacccataccttgcatctgtacatttgagatatacagcatagtagcaactcctgatcaacaaccaagtttagatttttgtgaagtcctttactcgggacaagaaaaggttcaagcttgggcgtttttgattatggtcgttatcgatcagttgcgcctgtcaatgttaccaaaataaaggagaactagttgtgcttgcaaagcatatttatattagaataagtgatattccactagcactaggattctaacatcttaaatacaaaataggggagaatcggcagcaaaacggacgatcaatcaatcggacgctgtcgagaatcagacttgaagacaaattggatgagaacaccaaatttacaagaaccaacaagcccaaaattcagaagtctgcggagagaagcaaacaaggaggccgcctgccaaagtttgggctggttgggccagcccagggtacggccgaaccctgggttcggccgaaccagccgcagcactgatggatccagggtttggctggacggtagagatcaactcccaatgacagttggagagtattaccgacctttccaaccgtcatcaccagcctataaaaggccttcacctcttccatttcaacacacacctcaagcaagaagcttcatacattctctcaagtttagtatagtctctagagtatagtggaatagaaatagaatagaatcttcagtcctcagagtcttcggaagagttcggctatgcctctagtatcttttccttcttttgtaagacttgtactatttatagaatattcttctcaatatatttacggtactttccttcattctgattattcgagtaccaactttatgaaatattattcgagttataattgtttagctaacttactcgggagatgcaatgctgtgggtataatgttcatttatatgattactctatgtcatgatgatgatggtagagcagtatttggtagcataagcgaggtgcttaggctattgaatatcattatttagagttatatgctgcagatatgtcgaggtgggccgctgatggtgacaactcagtacgagtattcctccgcgcgtgtatataatcctaagttattttcctagggagggtactcctccatatttagccccggttggatggccatgatggattgtcataaggaactcgacaaccagggtggtttctcgaaacaccaggagggcatcgtaagggggtattggctatataattatatagtagataatattgactaaagtgtatgtatgtatattaaaagtatagcaaatgactcttttcttattctttccacttagtctagaattaatatgtatgagaaaagtgaatgcttctgcttagtgtcaccctacccttttggattatattaactcttgtttagactttgattattacaagtaacatataaatattagcttggttctctccataataatctttccaaaggattaaacaaatacgatacccttggaatactctcgggtgaaatgctacaatggtatatccgtgcgcttgcggatgaaatctgtaaccgtaatatactaagagtgtttctgcgtcattgctggaaattatatttttgataatgtcgttaagaataccaacacgcggtatcctacaattaaaaccgcgaagtcatgatgtcacgtaacaaaatttaccttttttagctacggagtacgtgtgtaacgacttgtctttaagagctgctatagataaaatttgccttttttagctacggagtacgtgtgtaacgacttgctttaagagctgctatagatacataattaactgacaggtgttggctgccggaattgttataaaaatctgtcgatagatttttaacaaaataatctgtcaatttttagactacggtttaagttaagattagtgctagggtgctagaaaaatgcaaccgcgcgagagagctggagcctggagggaggaatcgagcgcgtggacatcatgcgctgctgttccaagctacttaccaactgagctagcaggtattgatggttttgttgcaaagatatatttatattaaaattaccgccgttacactatatttacaatgtaaatacactataattaaaaataaaacatttatttattatgatgtaatttttttatctggattgtaacttttctactacttggtgtaatttctgttgttgttaagcccagtagttaactagtgtgtttttttcttcctttttgctagcgtcagataaagttccatggtattagagcaggtacaatagtaggctattagccagctataaacatattttaataagataaaaaataagagataagagaagcggactacagatttatagtcagctgcagcacggactctaagatgcagtgtgtgtatgataggtgtgaccatatattaatagtatagtaagcagctgttatattgtgtgaattgactattagatttagctatatataaattaaagctagtagtgagctatcctattaaacttactcttaacacccgtacttgaatttgatagttttaatctgaggcgtacgtagctatttggtggcttgaaaatctgagtgatttagcagccagccagtcacccgtgctttggatcagcgaacggcagccactctttccacatccccggatcaaccaagcgctgccttccaatgccacctgcgatttggttatttatagacgtaatggattaccacacaggtcctcaagccactgctgcagcgtgactctgctctagcacctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtatgaacaagccaacataggatcagtacaagcttaattggtatcttcatcctcatcacacacacaggaaattaaagagagctcatcaactttaacccatatgatttctctgcgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtccggcggaaactaagctagttggcaagccagcaagctcactcgtgagctctatacagaggagactcgattgatctattcggttttggcagctttgaacgttcgaatcgggccaccttgcattggtttcccctttcccagtttgttgcttcagtttttttttttcatcttgtttgtgtcaacatcagctgtgtatgtatgtacatatgtatgtatcaacataggttgaagagcatgcatatgtgaatgctagcaccaggctaatcatatgcacatacacatcgtaataaatatattgtacaaatcgtcaaaaacgatacttatatgtaatactatactcagaccaaacttgatacctctggtttccatttcaattatgtgtggtaggacatgcatagcattgttgggaattacttaattcgtttccatgcaaacagttcaaagatacacgcgcgcaaatacgggcgccctcgttcacatatgtaaattattatgtatacatataactctaatcagataaaattcaaaatgaactgcgagtccaagctcgatcatcctgaaattgcctcctcttctacgattctatacgtagcactcatttctgaattgaaacttttgtgagctttggcttttgatcctcgggtgttcatctattgatgcatacattcatttgaactatatttaagccaaacttatctaacgcagttgaattgtcgccttctgtcatttcaaggaaatttgttgctttctgaacctttgtgctaaagttggaattttagtccattgttttggcgtccaagattttttttcccacatcatgacaatttttaatttaagaaacacgttaaataataattttataatatatcctcatagatctatttgcaaacatatagaccccacaaacaaattatttctgtaccatttgcaattccaaatttgccaacattagctaatagtagtgtgttgttctgatttagttcaaaaatacctgctaacgataataaaatttaaaagggtattccgtcgcaaacctgaactgtaccaattttgaataatgtactccctccgtttcagaatgtaagtcattctagtatttctcatattcatattgatgttaataaatctagatagatatatatgtctaagatttattaacatcaatatgaatgcggaaaatactagaatgacttacattgtgaaatggaggaagtacataataaatgattaattaatactgaacagagaaacaaaagttgtcatcatcttaatagtcctttctcagtgtccaactgttcaggagatagggttatgataatactagaccacatatgtccagtttcaaaggataggttcataaactagaccacaagtgtcccaactacaggattagataggaatcaacttgtgatgcctagaagacgtacgtaaatgacaaggacgtaggaaaacacacggttcattccatgtttctgggtagtggacatatcatagataccagcataggaagtcacgcatttgcacaactataaccatcctaattatacattatatatatgaaaatatactaatgatattagatgaacgaaaaatctgttttcattactgtcgagaagtaatcctctctagcgggtggtcgtgagacccctctttgtgagttcggccgggggagatggcgcgatgatcaagagacttccacttgagatctaactactggatcgttcacgagtatgcatggaagaccaaggattatacaggttcgggctgctgggaagcgtaacaccctaccctgagagcccgaggggtgtgacgtggcaccccgagccccctcagccacctcagcgctatccgaggggcgggggaaggcgaggcgcatggctacgtgactaaacgggaaggatacttccctttactgtgtgtacccccgggcctatatcaccgacaattatagtcacacttttgtgcaaccacaaccgccatctatatttatattatttagcttgatttatatgttgtatatgataacaaatcacccaccataatatattgggaactttaaattcatatgataatttaagtttacataactttatcattatttttcactgtcttcaccgctgcaccagtcgccgccttttcaccacctccactgttacatgacccttattctccccttagttttccattggtgtctgttttatagcttaagcacatagatacatttcatcctgtatatttcaactaatacaatacattaaatcataagtttgaaagtcatcctcaaaacagagcaatttgaatggtatttccaaacattggttctgctctttaaataccaagcaaatcaaactgactactaccaggctagaataagccaatcaaattggtgtcacaggctgtttgctatgctgatcttttcagcttgtatccaagcgtcaaacagttctgaatgacccaaaatctgttatgccagtagaatattactcagtcttccaagttaagagtcaaacaaaacagggaaatgagaacaaaatttcaactattgtacttctgtccaccatgtatccaaaatttcaactatcgtacattccttttctcgaacaacaaatatgtgccgattgtagcaagtattgttcagcatgacactgatgttgtctgaagatcttgattcatctgagataaagatcgaagaagttcagacttaaaaacaccagtacgtaatatacaatatatctcagatgaatcgtacgcaatggctattaagactttgtccatgattcagtcttcaaccaagaccattccatgtatatattttccaataccagtttcagttattaaaatccatagttgtggaagaaacatttaaatatgcacattccaactactccctccgttccctaatataagagattttgacattttacttgcactgtttgaccactcgtcttatttaaaaaatgtgtgcaaatatcaaaaacgaaaagttgagcttaaagtactttggataataaagtaagtcacaaataaaataaataataattccaaaattttttgaataggacgagcggtcaaatagtgtaagcaaaatatcaaaatcccttatattaggggacagagggagtatttagaagaggaggtgtattcgcactcataaattattgatgttaatgggctaacgacagatcattttaatcaagatttcaaattcagaaacgggcagtactaccataagtttgaggaaattgttcattagaaggattgatcaccttacggcattgcatgctaccttacagcattgcatgctattcgctgcagtcatgtagcaattcaccaacaccgccatcatcttcacagttgcatgggagaggtggggggcatgtcttgggcagccagaaaacatctgtgagaagcagtaatccttgggcctctactatagctatcaagaaagtgcagaagcaatgaacatgctatgcatggcctgccatacgttcctgatatcagttttaaattccttggtagattgtacttgatacatactcttagtttccttgggctaatgaggcaatctgatgactcattgtagacagtaagctaatgtgattacaaatatactggtcaagtggtcattatgaaaaaagttcatactaaaaaatcaaatcatggtcaacgtttatattagtcaacctgcatgtagtatcttctacttcgtccctttcagttacaagacattttgactttagtcaaagtcaaactgtttcaagtttaactaaatttatagataaatatagtaatatttataatactaaattagtttaatcaaatcaattattgaatatgtattttcataattaatttgttttgggttaaatatgttactacttttttctataaacttaatcaaaattaaagcagtttgattttgaccaaagtcaaaacgtcttataacctgaaacagagggagtactaaatacctcgatttaacagttctaccttttttgtaagaataatatgactaattattatacttgttgtcacatttgccatttgaacttttgttaaacatatcaaatgcctaggaatgcatctcagtatatcaaattaggtacatatacatgtattgatatgatttttactcaatgacaactgtccagacattatgtttcttaataagtaaataagaatctggtaccaatttcattaatttacttggcaaattatgtagtagcttacagtaactgtttgtcacaacatcttcatcagcactgtaaatttttctatgtaaaatccatctaatggagcaacttttttgattgattatcgcaaaatgttaagagccatcatcagaacatatgcagtataatatccctatttaaatagattcttgtgtcaattttgacagtttacctttgaatcaagctgtagcgttgatgtgctgtataatcgcacatcactgaaaacgtggtagacattaacagccgctggttgtggagaggagcaagaggaaggggtcgtcgttgccgtggctgtcggttgaaatgctgtgcagtgaccagatttagttctcccagacctctgaatggcgggatccagaggtgcacgccgacggggatgacgtcggggggtgcacgagaaggatagcttgttccacccctaaccatccatttggggggagggggggggataggaaaaaagtgggggaagtagagacgcagcgacaccggagaaagaggaggcgacactagctagggaggaggacgcgatgacaggggatgtggaggaagcggcggtgtgggtgtggaggaggtggtgaaggcacggtgagcgcgcgcggagcaagagcggcgtctcagcctcctggcttctccatttaattcggagaaaaagaggtatttttgttcatggaacattgatagagaaaaaagccgactattggatttgaaccgatgaccctcgcattacaaatgcgatgctctaacctctgagctaagtgggcttacataacagaaatagtgtaacaaatagaaatatgtatagtataggaaatccgtaaaatgtcatatcttaattattaatcttagctattaactagttcgaaattggaagttctacttagaaaacaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatatacgaaaacataataaagagaacatgcgaatttcttgtattttcagtccatcattatagacattttttgagatattttgttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctcacaactagagacgaaccgctagactacatagagtaatgaatccaacgattcaaaaaaaactaacagatggaggaaattgcacaagaaatcctggtctcaaagaaaaagaaaatggggatatggcgaaatcggtagacgctacggacttgattgtattgagccttggtatggaaacctgctaagtggcaatttccaaattcagagaaaccctggaattaaaaaaggggcaatcctgagccaatccatgttttgagaaaacaagtggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaatgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagtggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgttttttttattaataggtttaagattcaatggaatacatttcttttttattatagtatcggcaaggaatgtcgattattaactcgatatttaaatattattaaataggctttctttgtacaatgcataggactgacccctccccatttccaaattttggatattgacatagatacaaatactctactaggatgatgcacaag

SEQ ID NO: 58502 - DNA, 8651 bp, Oryza sativa
ggagtcgccaaggcggagggcggaggcggagaaggcgaagaaggcgccaacgtggtgaaggcagtagtcggcgccggtgcggtcgaggcaggaggcgccgaggcggcgggcagagccggcgagcgcggtgactgtgagaagggagtgcggggcctgagggagcagtggtagggattctagggttttttttactgggcttattgggcctctaggcctattgggccagttcggtcatctcgggtatttcggttaacggagcccaataaccgaaatactcgaaataaattcggtcttttgctagctgggaccgaatagctactcgaaataaattcggtctcggtcttttcggttcagtctaattcctgcccaccccctatacgtagtatatattattccacatacttacatagcaaatgccaatgcacaagctgagattaactgccagatcatgtaactcattaactcaatagctatattatatttacacgatataatatatgtggaaggagattaattattacgagatacattgccaattaaaccagttgtacatgatttgaggcaagattgcataggtaataaaacatgtagtgcatgcatctggcagccctgttgtaaaaatattcaaaagtatactacaagtcacgacaagattaaatagaaaagttcgtataatataactttttagtaagacgaatgatcagacataataataataataataataataataataataataataataataataataataataataataataataataaatcaacggtatgatttattttatttaagaaaacaaaacattcatgaaactttttggctgcgaagaagaatatataaattggcgtttttttccccatcatgtcctagtacgtcagccggtgcagatgggcggtggatgaggcggcggctggttgacggggaggaagacgacgcgagggcagcgcacggcgatgtcgtacaccctgctgtagacgacgccgattttgaaggacacctgcgcggtgacgacaacgttgatggaaggtgttgtgctgatgagctgggaggcgaggaggttcgactttgtgttgaggctgtcccccaccaggagcagcgacgccttgatgctcgcccgctgcgtcgcggcggcggccggcacgtacgacgtgccgttgccgggcagcggcgtctggagcggggcgcggtacatctgcagctgcatcttgtctttctgtatcgtcttcgccaccaggtccacgaacaccttccggtactgcaccatggcgcggctggtggtgctcctggcggtgacggtcaggttcaggtagatgcccgtgtcgttgctgccgatggcgatcttctgctgcgtcgctctcgccaccgcgaactcgacgtgcaccggccggaggatgacggacacggttatcaccacggcggtcgcggccacggttccccccagagctgccagcacgatcaaatggcgccgggcttgccaagatgatgatgctgctgctttattgtcttttcccttctcctcctcatcatgatgatcacccatgcctagctagctagctatgatcactatactctgtgtgtgtgtgtataagctagctagctactagctcaaatgaaacgggactcatcagtagctactacactactactatatataaacgtatgcatgtattgatcgatcgagcttaattaattaatttacagacgactacatatatactccatccgtcccattatatgtgcagccataagttttcatgcccaacgtttgaccgttcatcttatttaaaaaaaatatgaaaaaaaatttaaaagttaagtcacgcataaagtattattcatattttatcatctaataataataaaaatactaatcataaaaatattttaaataagacggatggttaaaattggacactgaaacccacaactgtgcttattatggaatgagggggagtatatagtatgtacttctctatatcaacgcatatatatagagagagaaaatactaacaaaatactacgaatctggacataccatataatattaggtgatgttgaggaaactccaaattggatgcctaatcatctctaaaaaaaaatcggacccggtcaaatgtttcagttaaccaccggtgaaacattaatataagttatacatgatgaaataaaaaaattagccactaaaatatttttctgtgaaacacggtaaagacaaacgttgaatcatatcgctattacgtatgaaacatcgagggttaatagattgaaacatatgctttttttatcggaatatagtcatgtgatatcttgttgtaaagatttaaatacaacgtagaatataacggtgtgatatcttgttgtaaagatttaaatacaacgtagatcgaatataacggtgtataggactgtataatgaagagatagcaagacacaagtaggttgttggttatagggttggagcgctcgatcagatcggtcgaccaaaccaaagcgaatctcgagtagcattagttcctatatttatgaaggaagggaatagcatcctattttactctagaccgacaaccttcaacttcaactgtcaaattatgtgttggccattgcattgagtacccgaatcggaataaagtcttttattacaaaagttgaacaatcagaataaagagtaaacggaccatggaacttttgctttgctatgctgcttttgtgaaaaaaaaaatgctccagggatactcaatccattatcttctttttttttttacttagtcacatctataacatcgatcgtacacatgttttacgaaagttcttcaaatcgagcgcccgatgcgggcacgtatgcatcgggcgcccgcacctcccacgccatccccaccacgcaccccaccacatgcgccgttgcaacaaatcacccgcaaattacgaaaacgttctattaagggaatccgtttcattttttgttccaccaacaatgtttcagcaagtatactcgtgttgtttcactatgtatagattaaatgttccagtgaattgaaacatcattttgctatttgaaacattgtttctatatatggtgaaacagcttcaaaaccgttgtttcatacgttatatcaaaatatttcatgaggtgattcggttgtgtttgaaacatttttgatctaattagtgaaataattccgatctacttggtggaacagcgctcaatttattttaaaaaaagatcgagcacccgatttgtaggcgccttgcatgttttacattgcctttttttatataattacactacatatgcatgcgcaaacaccattacactcacacaaacgaatacaacctctaacacatatttataaaactataattaaaaatgtattatctttttatggcatgtatatctaattaaaaagtctatttatcccttaagatgacgcccccttgttttttcatgacaccttaaaaagtcataaagaaattgaaaaactttgccgcaatatatcaatatatatatatatatatatatatatatatagagagagagagagagacacacacacacacacaatatgagctggcgtgatgtgtgtctcatgcacacccataatgtgattcataaccaatcaaccataatgttattcggatccctagatataaccgaaaccaaaaatataaaggtctatgggtttgtacaggatatggattttcatccctcaagtgaatatcccctcgttatttgtatgtcatctaaatagttataaaaatgtttaaaaaaattgacaacatatatagattaatatgaaatatatcactccataaacatgcaagaccaaattcaacttctacaagttgcaacaaaaagaacaaattaaactgaaaatagttatggtacaatcccatttatatttattatttttgttataacttgtataagttgaattttaacttgtatgtttgtggagatgatacatttcatattaattaatctatcttgccaatttttttaaaaaaatttattactatttagatggcatgtatgaaacgagaggatatccccttgagagataaaatcactttcctgtttgtacaacccaataaactagcctaatggtaaggaccaaactatgttttaagttgtacttgtttattattaattacaattgtgagactaaacctaatactacctccatcctaatatgtgtcccatgcatcctaccctccgttcatagttagagtttatcttttttttggacagaataatatctatcaatatttttttttggggggacagaatagtatatatcaacatttagggacggagcaagtagcttctttcccatgcatccatagctggaatcagatgctatatatattaacagaaagctagcttgggttccatagatagaagctagctgaactgaagaagtagtacgtagctagtgatagtgaagctagcttgggttccgtagatatccatatatatttaggcatgagcacggcatcggcaggcggcggagcgaaatcttcatcgagctggagtagtagtacatttttccggtggatcaaggcggcgaggtacgtagttgcggtggcggtgatcgtggcgatcgtggtgatgatagcgtacgccatcaagatggtcgggcgagagaggccgctggtggtgagtgtgaccggtcatacggtgaaggtgcagcggccgtcgaacatgtccgggaacctcaccttcgccttcaccgtcagggccgccaacaccggcggcttcggccaaatatactacaccaacatcaaggcgttattggccggcaggagcgcgtcgtcgccggcgtcgccgacatacttcgtcaaaacgggcctcttggacatggccgtgataccgcggctgacggccgtctcgcagtccttcgtgatgtccggcatcggtgccaacggggacgggacgatgagctccaaggatctcaggccctacttcatggacttgtacaagggcaacaccatgcgcgacgccgtgctccggcttaacggcacgctcatgaccgagatctactccggctacaacagcaccgcccgcaccgttgtctactgctgcgagcccatcttcgtcggcgacgacgacgacgccccggacacgcctgagagaccctgcgtggagcagaacgaccattccatcgacatgacaaataaaaaaaacatgctaagctgcgagctcagctagctcgatccatcattaattattcgatccttatctatatattttcatactaattaatttcttcgtcgttttattatatatttaattacgtacgtatgttccgatgtatccatctctcctgcctctctctatatatgcattccttttgcttgccgtttcctcactttacccacccattcaattaatgaaaatggcttcattttattcacgctaccagtaatatttctttttttccctctctatctctcatttttatataaactagaaaaaatacccatgcgttgcaacgggtaaacaagagcttagcaataaattaaaatattaggatcactatacattataattgaaaaggttaatgaaaattctaacattagaatcgctatatatagattataattagtgaaaatcttttctgggttttgggccgaaagctttccttcctttttagccctaggcaaatctactatctccctctgtttggcctgcttcccttcaaccagggagtagtggaaccgtaaacccaactcgcaccgtccactaccatcttcaacctcccgaagatagtcccatacggttgactgtcacccaaaatctcctgaagatagaaccatacggttctgtcacccaaaatttgttgatgatttttgaaccactcgatctactctttcccctttttttttccaaaatcagagcgtaaaactcgtgataaaaacgactgggaaagatcaacgtcatcattggtaactgttaaacggagattaaatccagcaaattaaagccgagtcgaaagtaaaaatcatggagaaaatgatgagggggagggggtgaggaatcgatttttgcaatcaaattggaggagatcgaaatcgatatggcggcggcagaaggcgtgcggcgaacatatcggattaaaaaaccggatgagtaaaaaaagcgcacgggagaaaaaatagcgacaaaaaattgatgaaaaaatcaaaagcgcccaagaggcacgcgttgaacagatcagaataaaaaaacagacaaaaaaaaccataagagttagggcgtgggcaaaaaaaaataaactctttcgtgtgctaaaaaaaagtcgggaaaaaaactggtgccaaaaaaaccaaacggactttttctttttttgttactttttttagtcggaccttttttcctttttttacagacgaagaaaatttattgttcttcttaagtaacgtagagatagagattgaaaacaaaacataaaattaaagccgattcaaacatagatgatgtaccaaactactagcaaaaatatctttaatttttataatattagagaagagatatatatacactccctccgtcccacaatataaaggattttgggtggatgcgtgtgacacatcctagtacaatgaatttgaacatatcatctggctagattcattgtactagcatctattacatccacccaaaatcccttatattatgggacgtagggagtatatatgtcctctcattgtttgcatatcacgcaaatggttatgaaaaaaatctaagaagatgtattaacatgtgatatatcactccacaaacatgcaggttaaaattcaacttctacatcttgcaaatttgttttttttttgttacgagatgtagaagttgaatttgaagttgcatgtttgtggaccaatatattacatgttaatacaagtcaatagtattaactcatctagggtttttacttctactaatttaaatataatatatagttttcctatcggtttagtttaaaagaacaccatccattgatttaaatattgacatttaaaacaagggaatgcctataccacattcaaaagaaaatccccctcaatttcaatcagattttggtctctaatatttgtgctgccatagggaaccttatttctttccgttcttccccccccccccctacatagtcttcttctcccaaattgcgttctcgcgtacgatgcttctgccacctcctccccaccccagcgcgccacccatcgcctagccctcaccggtagtcaaaaggtacgaacggcgctgacgaggcccaccacaccagccacctaccccttcccaactctctcttttctctctctccaacttccattgctaacccaccaccctccttcatccctgtggctctagcattgccactggcgcctcggcgcccgcccgtgtccaccacccaccaccgagccgctgcctctccgaccattcctttaagtctggagaaaccccctcttccctatcccccaaccctccttctacccccacccccaactctagaccctaacttggtcagggtcgccaccatcggtcgctggagttcatcaaggtcgccaaagttggagaagaagcccacttgagcacaaatcgtgaagcagatgtgaatgtaaaaaatttgcaagatttggttctcatttttctgtcaaatgtagtttagcaattccgttaaaacaatatatgcatgcagattcctctcgctctctcgtcgcatagattatgtcatcatcgtctatagctcaatcaactttcaaattacgatacaacattttacctatagaagtcttaaaaaaaggaacaattattaaaaagttaaacatttgaagttggactgtatacattctaggacagtgtttaattaaagtggtacatggtagtactgttactactacctgaaaactcggagcttataatggtagcttatgagaacttggacaacttgagcctcccagcctcagtgcctcacatctgggaatatagagataaacatagtgtgtctaaaccatatgtcctggtactagtaggtccttgatgttttgccttttttaatttggtcatcatatactaggattctttttgagactttgtccctttcatttacatcttatcataccaaagtatggtatatatgtgtaggatttctgtacgtataatactccctccatcacaaaatgtttgacgccgttgacttttttaaacatgtttgaccgttcatcttattaaaaaaatttaagtaattattaattcttttcctaccatttgattcattgttaaatacacttttatgtatacatataattttacatatttcataaaagtttttgaataagacgaacggtcaaacatgtttgaaaaaatcaacggcgtcaaatatttagggacggagggagtatatttttattctttttggaaagtatacagctttatagttatatcaacatgcatggttgcatggaccattgcaacaatacacgggagggatatatgcggagcggagcgagcaacacctagcttacacacacacacacacaaagcttgctaccaacagtgtgtaaagcgaaaggtttgcaacacaagatgtgcaacgaaaggcagcgtgagtgtggatcaggggcggatccaacgtgggtgc

SEQ ID NO: 58503 - DNA, 13686 bp, Oryza sativa
  unsure (1)..(13686): unsure at all n locations
aagaagattctcattctgattcgaaaagaagattttgcacttgatttatttaaactataaacttgcaacttaaaagttgcatacaatttcgagaggaatagctgaagagaaagcaaaattacagcattattcagatatcgcccaagtgcgtaagccaagttcgaaggcgtattttagaagcagcagcgaaagcggttttgtcgtccacgcgtgctctcccctttcgaaccaaagctagttccctcttctggtcttggaaggcgagggaaacctcgcttgcagcggcggaatgtcggccgaggcggcggcggcgaaggaggaagaaccgtgctgcatctcccacgcattcgaccgcgccgcccgccggaaccctaccgggctcgccgtcatccatgcggcctcctcctcctcctccggctccgacagcgagcgccaatttacttgcgccgacctcctcgccggcgtctccaccctctcccgccacatcgccgcggagctcagctcgtctacctcccgccaccgtgatgaatcgcctggtgagtgagcggtgacttggttcgtgttttttttaattaactcgtagtttcgtcctctgatcgaagggggaatttggaaccctaggctgttcgggtcgccccgtggaagccgccgcggcgcctagggttgtgggggtttacgcctcgccttcggtggagtacatcgccgccgtcctcgccgtgctcagatgcggggaggcgttcctgccgctggacccatcgtggccagaggagaggattcgatgggccacctcgtcgtcgaatgcggtgctcgttgtatcatcagggggtttgggagcagctcatgtgtttgcgagcagctcttgctctgttattcacatggacgacgacttatggcaagtgtttgaggatgaaaagggtgggattggtcgagatgagcttgcttggccgtgcaagtacaagaagccgagggagttctgctacgtgatgttcacatctggttccactggaaaacccaagggtgtttgtggaacagagaaaggtaacgtcactgcaccttgcttctggttcactgtttcttctatgctatcatttagaaattttgcttctgacatggcaaaggaattggttgacatgtctctagatgctcttcttgagaaagagtagtttagtatactgccgtcatggctatcttatgccaatgtttacaatatccaaaatgctagcctaagcccaaatgtttactatgccaaactgcaggcatagagtatctgaaattacatggtagcaaaaatatatgttaccagcgaaacattaaatggctcatgtttttttatcttttgctttgtaatttcttatttaaggtctgttagattgtctttctaggtttggattgggcggacagctcattaagatctcttattttgctattattccttaggtcttctgaaccgctttttgtggatgcaaagatggaaacctctatgttcagatgacctgttattgtttaagacatctgtcagctttgtagaccatctgcaggagttcctttctgctgtgttgacttgcacaacacttgtcattcctcctcctaatgattggagagctaatccagcatccttggccaacttgattaaggttacctagtttaatcattgttttggtggaaatattgctattcttttttaatgaaatagtaggggagagagagttatgctttcattgtccaatttgtcttctccataaaacattatatccaaggcttctgcttgttgaaataaattgcagtagcgttcgggaacagcatctctgatgaattttgcaaatatagtcctttttgtagcagtcattttgaaattttgaattacaatttaatggggcaaactaggatgaaagtggactgtgcacatgttggcacggttgtacactaatttgcgataaataggcttaccttttcattttccttacattttcgcaggtaggaattttttttttctaatacaagttatatttgcttaattgtgtccaaaagtgggtaaaatttaatgtatattagtacatttttgtcctctttcaaatatcattggaaagagctactgctaagagatatagttctacattattcttcttccgaagcaaaacagtaattttaggatgctaccaatgttgtcagaattggtactatagtttctggctcttgtctattttagattcaattgctttgataaaaaagtagcaactcatataatgggattttcatggtaaatcaatacatattacgattatagctattacgccatgttcttcttggtgggcctgattttttttttctaattttttcttaggcatatggtatatcaaggatgaatttggttccatcattgatggagataatactaccttccctggagaaaaatctttcatggggacataacccgcttaagatgctaatatttagtggcgagaatctatccatattgttgtggaagagagtgcatgaaattctgccagagactactattgtaaatctgtatggaacgacagaggtgagaaaattaaccacttgcatttcatattatgttatctttgttttaataatgtattcttataatcatatggtttacaccatttatcttactggcttctggcgatcaaaatcaacagtacattggccggccatctggcttgacttctcctaaaataaatattggtgaaaactgatttgtaccacatcttttccatgtacacagaattgagagcatgacttgtgtcatctttactattgttagcataaattacagtaaaatattcttgcaatattaagcttgtgaccatgagtggtaattcatggtttggttgcacatcatttcctaaccatcattttactgattcctgttatactaaaactttaagggagttatgatgaagagcacatgtgccataagggttgagtagttaaattctcttacacctttttattcagcatgaatcaaacttgatatttgcttcatgataatttaaattggtcttgaattatgatatgaaaattgaaaaggtacagttagtgttccattctgaaacacgtgttacggtgttaggtaactcgtgtagcaatatagcgtacttatcattacttggtatatgaaggccatcgaactgtgatcttgaaactagcatgtttcatttatgctatattggtcctgttctcctcatgcaaggagctgaaatggcagtggtgatatttcttctttagctaataaaatgttgcgcttgtgattcaggtttctggtgactgtacattttttgattgcacagatctgcctatacttttaaagcgagaagaattaactagtgtaccaattggatttcctatttcaaattgtgaagtttgtattgcaaccgacgccgaggtagcagatgaaggagaaatgcatgtcactggagcatgtttatttgctggatatttagaagagtccatggcgagtaatcacactgaagacaatggaagttcaacatactacagaaccggtgactttgctcgacgcttaaagagtggtgaatttattttccttgggagaaaggaccgtactgtaaaaatttatgggcagcgtttttcactgcaggaagtggaatctaccttaaatgaacatccagatgtcagtgctgctgctgttacttttcaaaataatgaatttctggattttagggcatacctggtgcttaagagtagcgccgcatctgtggaagactgtcagcggcgtaaaagatacaaatcttttgaagttatcatgccatcaattcgaagttggctcataatgaagcttccaccagccatgattccaaggtttttccttcccatggaatcattacctctgacttcttcaggaaagattgattatatgaagctatcaagcttgaagtgtgccttggagtcctgtgaaactgaaactgaaagaattacagttaatccacatttgcaagttatcaaaaaggtctgttcaagcactctcttgtttttaccgtctactctactgttaattttgtttctgtttgtttctctttggagctattgtattctttgagtattcattattataatgatcattttttactgatgtcatctcttatctactgtaggcattttctgatgccttacttgttgatgaagtttccgagtttgatgatttcttcaccttgggtggtaattcaatttctgctgcgcacgtagcccacaagctggagattgacatgaggatgctttatatatattccaccccttctaagctcttggatgctttatttacaaagcacggttgtttactttcttctagtcatgagcctcaccctaagaagggattggacatatcttccagcatacatagctcatttaatccgatcgctacaagtgtagatgataactttcctgaagtaaaagcacatataaatggagatggagagtgtgcacatgatgccatttcagggaattatgcaaatgaagtagatggccagcttaacagaaatgtgcctttatctaatgatagataccagacaaaatccctcttgttggatacatgctcaaatgacagaaacagtgtcgatgtcagtccatggatcttgaatttttgtttagtaaagaaatggtctattggacgttgcaatagatttatgcatggatacgaagataagctgcaaattgaagatgtttgctcatatgttccctacaacaaaagaggttatcttcaggccctttggaacattcctctcggttcatgtgttgacgcgtcacctttgcttgtctccaacaatggcatgctgagtatatttatcgggtcccattcacacagatttctctgcattgatggctgtaggtgagttttccttgttgcaaggagttttttttttatcttaactagtcattgtttcttttgcttttcctgatttactttgaagttgaatctagaacaatctaatgtgccacatacgctctaatgttcttatgaaatggcatgttgtgtatttaatataaagtaatttattattgatttgtttcattttaatttgattcaatgaagtatttaggttctgacctttgcatactaactgttgtttgaacttgctcccaacataatatgaagtggttctgtgaggtggagtgtcaaattggaaggacgtgtagagtgttctgctgctataacaggtgacttttcagaggtaactcaacaataaacaccagcacgaattcacttagcattcttgcagccagttcatggtagtacatcttttgggcaggttgtagttggatgttataaagggaaaatctacttccttgatctgttaactggaaaacaagcttggaccattcagactgatggagaggtacagctgctgcaattttctcattcaagacatcttttaagccttatagtgacatagaagttgtactttcatttcagaataataccgaaatgacgctgaactgattattataaattatagatatactcctagtaaatttagggtttcggctataatccctgttatattttcatattattgaagtggctatactgtaactccctaattgctaatggtaaataataagataaggggacatttatgtagattgtagaagttcctcccattaagcatcagctggaaagatatatagtggcaggtgtctatctcttcttaaagaaagagcatccaaaaaggtgccttcatttaattgatttattacggacagtactttatttttcgtgaaatcaagggtttgtactgcctaataagtcttaatgtcttgctatattgaggcttatgagtcctttttattgagtttatttcagttttttcctactattaactagcaacatgctattgggtgttacaacgaatgcaagtaaaatagtaaatgcattagaagagtgacacacatgtctacgcatatctagccatgcaagttggggatggaagtaggcaaagcagtctcgaagttatgccatgactagttattagttctgttggattttgttccaacaagttcagtatggctttgatgctgaactttcgaaaaacaatatgctattattctcctggtcactatcacctcacagaatgttgtcactgttcatgtctcacaatctcagattgaggtatctatcttcttgcaggtaaaaatgcaaccggctgtggacatgataaggaacttaatatggtaccattttactgtttcatccatagtacattagtactcgttatcctttgcactttatactttttctctggtctgatcaaagcatgtttgttccaataatagcctctctactttcaactagaatgtggtagtcatgtaagggggcttatggcattctagtcttagtctagtgttttgtcatggcaatacatatgtttgtctttgacctcttaccatacatccaattggtggtgtctcgactaactttacaggatgatgagaggaaccaataccaatagtctctcatcctatgtcctattcgatcatacagatgcatacccttacacaaaagatgagattcagcttgtagttttttattaattctatgtggtttataatctgcaggtgtggctcttatgaccaccatttatatgcgttaaattacaaagatcgttgctgcacttacaaaatttcttgtggtggaagcatttatggttctcctgctatagacatggtattcttcctcacagtatggttatttatttcatctaggctatccacaaatactttgtcatctatattgctccttgcagacacacaacatgatatatgttgcatctacgagtggccttgtgactgcaatatcacttgaggtgagttttagtgtgataactttaatttagggaaaaaatacagccttttccttctcatcggtatttctttccttctttgggttccatgggagatgtctttgtgaacttggtgatatcaacgaaaacatcattagcagcttaatgtttgaagtattcactggtttgtggtttctttgtggtaacaggtatcgtcatttaagataatttggcaatatgaagccggggcaccaattttcggttctcttgctatacatcatcatggtggaaaaggtagtcctcaaacatgttgcaatgtgcattgatatccttcaatatgcacttacttgtgtttttattatatttcctcacaaaaaaagatttaaagaaatgcaatatgtacagcgtaccacaggatcagtgaaaactatatcatatgtatagtttggtagtatatgtgtgtacacggatcaaacatacttttatgattcgatcaaatatatacttttatggcatgcagtttttgctgatgattgtagttgcaatttacagttatctgctgcctggtgaatggtctggtgattgcattgaactcacatggctctgtcgtttggaaggtgcaacagctttatacagtacagttttgcaattgaatgacacatcatggatgtagttgttgatcatctgtaaaatactagtggaaattcattattcgtatttggtcaaacttataagcaggtgtcattagagcacatataaactgagtacctcttatgatagctatggcagtatgccactattaattctgctggtgccagcaagtggtgggttggataaatgggttagaaaatggctcccatgttaggcaaatggggttgggcttgggtctagtgccatgtgagcaggaattggtgtaatgccagatgatagtttggttggttaggcttataaaaaaaatcaagcttagattaccaaagtaaatccagttttattgtggtgtgccctggtgctttctaaacacattgatgttgctttcaacaatgtagtaactaatttttaaaaccacaggcatctgttggtggtcctatttttgctggtgcatgtttgtcatctggccttcctactcaggtatggtatcaatttatgtgtcttttcattgactaatgatcaaaagttacatctgtagcttatggagttccatgtgaagtgtagtgaaaatcttttacatatatgtcatttgcaggtgttgataccttcccgtgacggaagattatactcttttgatactgtaagttttgatctcctgaattttgaacctcttatgtgagcagaactttagcatagagtaatgaattatgcatggtattgcatgaatgctgcaccatacaataactctgtatttaaacaacagtttcaaaatatatttggtgctcgtgttttcaaacacaacacacccgaattacaattactgatcattggacacctctcactgccatgctcctgtacttgtttcctgatgctaatttagccatttcagggagtcctcaacgtaagggtggtcaatgaaactaattttagaaagggattatctgttaattaaaacagaactcttcaatcgttgaactgtgtcataatgtgtttctaaataaccagaaaaacaaaagggtatcttcacaattgattggtacctagcaatttattacaattctgattcccatcttttagcaaagactagcaaattgcatgtgcactgcaacagcaaaaaataagtcatgttgtgcacactcattctttgaagaatctgcaaactggccctttccaattccttttaactatacggattacttccctacatacttatcaggtcttaccaaacaaatattaacatcattttgcttagacatgcttcttgtgggggccgtttgaatttagtgagcacgtatgtttcaccgaggaggaggccccatatgtcagcgatataggtggtggtggcagattcacttccgccaccactactaccttttaaagtagtgtagaatacaggtagtggagtgatttttttttcttacagacatctggtgctcttctttggaaatatgaagttggagaccctattaccgcatctgcttttgtcgatgaagtgttaacagcaacctcacctggagcatctgaaaggtatttcatatattgataacatagttacgcagtgatcatgtatcaagaaaatgaccacaccttttcttatatatagattcgcttgtatctgcacgagttcgggacaggtccatgtcattaggattagagctgatgctaaggaagagaaagttaatggaagtatttgtaatgacttggtgcaaggatttgctgcaatagatcttcctggggacatcttctcatcgcccttgatggttggtggacgcatctttgttggatgcagagatgatcaactacactgtctcacaatcagctcatagcttcaagccgaataattggagggcagatagtttgcttcgcattgctgtaccgagagctcagctagtcagcatcatatccatcctgctatgattatacaacgagaacattttccctcctggtaagacgcacatcatttactgttctgagtgcaatgtttacttttgaagtagtcttctgaactagccaacaatggaagaattgcagaagctgctggtcttcctgcaaattagcaacagtgaagaagtgcaaaatgaaacaggacgacgtatggactccggtaactaggcacaaggttttgaacgtcaaaaattcaatttcacaacatgagtgttttccccatatgtaaaaccacttccgttactctgcagggctatcaagcagccgctgcttacttcagttatgcattcttaaggctgtgatttgaccaaacaaactacacactcaactggggtcttgttcagctttgccttacccgggcagcttggtttagggatgcaaatggcccgtattaattaaggcctgttgggtttagaggaatttcgcgggaattttgaaggaattgaattgtttgctgtgtaaatcatgtaaaaatttctgcttttcgaaggagcccttatcgggggaatccttgctgcacgggaccgaagtcaccgaacctctgctgtattggtggtgactgagatgttgtgcagtatgccaattcgtccttgtgattcagattaaccgtaagctctccagttcaaatggtcttctcgtgggcctctgtttcaacagcattttgggtagtctctactcaaatccgagtaccatttgcgacaacgcgctgtgagttcgttaagttgctcccaaaaatccaagggtagggtccgaatgatactcaatgtgagtaccatttacgacaaaaaggaaaagttaagttgcacccgaaatctaaatgtttatgtagtagtatagtatacactagtaacttgctaaccaactcgttcgcaattcacaaagtgctaaagggtagcacaaagagagagtagaagcaagcgaatgcaaaagaattaaagaagcctttataagaagagaaggccaagcttgtgttgggttggctaaggtagcagcagtccaaggcccaccaaagcccacaccaaatagaatagcagcctctctccatctctctcacacactcaactcaactcgactcaaccaagccaggttgaggcggcgcggcgaccaaacccccacacccgcaaccacccaccacccgccgccgatgcccggcgggccctcccgcgccgccgatgcggacgacgacgacgacgacgagctctcgcgcctcctctccctggccgaggccgacctcgaggccggccgcctccgcgccgcgcacaagcacgcccgccgcgccgcccgcctcgacccggactccacccgcgcctggctcctcctcaccgcggtctcggtcctagccgccgaagactcctcccaccgggccaccctcctcttcccggactccccccactccaaggcctggcccctctcaccttccgccctcggccgccactacaaatccctctcggaatccgtccgttccgccccgccctcctcttcccccgcggtctcttccgccgtcaagaaggcgctccgccgcgccgcngacgcatacgccgcgctcgccaaccaggccgccgcccccgtcccgcccaccttttgaacggcgtgcgccggctcccgcctcctccatgagttcgaccgcaagtacgtcggattccgcctcatgtgcccctcctgccgccgcactttcctcgcctccgaagtgccccctccgccggaggctgaggcgaaggcggagccagacccgctgccgccggctaagaagaagcccaaaacccagaagcgtgagatgacgctcgccgagatgcagctccagctctccaagaaaagagcaaccaacaactcatccagactcgacgaggatgacgacgatgacaatgacgatgacgatgacgatgatgagggagaggagcagcagcagaacaacgactctgagatgatggatgtggaggactcagacttctacaacttcgacgccgaccgctgcgagaagtgcttcaagagaggccaggtgtgggcattgtacggtgatgatgacggtatgcctcgtcactatgcgctggtggagatgattacaccagggggccgattccgtgcacagataaggtggcttgatctccagccagatggaggggaggggacgccatgtggggagttcaaggtcgggagaacggttaccgtgcattcagtgaacatcttctcgcatcaggtcgcctatgagagggtggcgagggaggtgtaccggatttaccccaagaagggctcggtttgggcgctccatggcggaaaggatgccgattcggggaggccaaagtatgagtttgtggtgttcctcagtgggtacagtgacctttatggtgccagcttcggctacctggagaaggtggaaggtttcaggagcatctttacccgccaggatgtcggtcgcgatgctgtccagacccttcacaagggagatatggggaaactctcgcatcagattccggcgaggagagcgcccaagggtgaaggctcaaccctgcctcctactgattgctgggagcttgaccctgcatcattgccttctgagttgctgcatgacaatcagcagaaatagccgatgtggtaacttcgagaaagtatcttagctgataggattgttcatactgtagaatttgtcggaggtcataggtctgtggtggtctgcctagtgaaatgatccggtgatgcatttgcttcacctgctttggatgtatgttcctccatgcttatggctcctcgtcaaggtagagatttagatagcgggatacttgtacctgatgctgtgttcaattccaccatcaacaactttcagtgcatgaaatgaatcatcttttggtattgatggtagacacttctctgttataacttatatgaatgatattgaggaaattactctgcaatgtccatactatctgttgcatttcaaccaaactagtgtctatcgtggtgagttttgtgcatataaaagggtgtaaatttttatctggaagaagcaaaaagcaatggtggttgcatctagcaagtggtgccgggaaggcagtagaaactgcttggcgtagtccagtttggacagtgaaagtacaaccacgatggatgaaatgttgtgtgccggtcaatagtagcatacttttaagtgatgctttgttcaattccaccatccacaaattgcacttcatgaaataaattatcttttggtattgatggtagacactactcttatcacatgaatgatatttgaggaaattactctgtaatatccatgttttaggtagcattttaaccaaaccagagtttttcttcttctgaaaggtgcaagcgtggggtaattttcatcgagaagaagcaaaactgcaaaagcaatggtggttgctctatggtagtattgtgcaagttttgctgagagaaggcagtagaaactgcaaaagccagtttggaaagtgaaagtagaacgacaacgatggataaaatgttgtgctgatcagtagtagtagtagttgggagtactttgtactagtagatgacatgatttttcctcttttcttcagtatcgttttctttcagttgtgacgtgtttttgaaagctcacaccgctgtacggtatagttgacccagccagtatggcgtcagtcaattacaagtagtcacacccagaaaaagaggcgaatactccttcagacaataatgattctccaaaaatatccacgtcagaagtcacaactgaaagcaatgctagctaaaagcaacactcgaacaaacacagcaagaattggtctttgccttgcaggcagcacaagctctgaccgtgtcatgcaacactttctctgctactacaccgtcagagaaatttccgtgttgaaaaatactaagccattcttacctgctcgtaacgaccaagtgtaatgaaaaggaaagcatcaagaatgatagtactactgcaaagtgaaggattaagagtaggcaaatgcaatacaagtagacagcgcagttatgcagaatggaagagctccaaagaagtgcaggagtgcaactctgaacttcctagtctccgaatttttgcaattgattgatgttcaggtccaaacagaacctcttctcattttggcacaaaaacgaacaaaagaactagtatcatgcatgattcataatagtatcatcttcgacccaaaaaaaaaagaaaaacctaagtaaacataggtaaagaatttacttgtccaacagcaaggacaactgctactgggaccactcttataattcatcatacaaaaggttcatg

SEQ ID NO: 58504 - DNA, 8913 bp, Oryza sativa
atacggattatctcgaatacgaataagaatcgaatatgaccggacacgaatacggaaacaattttttctcggtacacgaaaaccaagttaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccgaatagcactgttcactggatatccgaattattatccgtatctgacggaaatcccgataccatattcgtatacgtatccggcaaaaaatatccgtatcagaactatccgagaattatccgatctgaaaggtatccgtattcgtttttcgccggagcggacggaaactatccgctccgttttcatccctatttggaagttcccaaatgactgcatgggaccactttacctcgttctcttagagcaagtttaatggtatagctaactattgactattagtctatattatagctaacttggagtataatagattaattataaggttggctctattttttatattctctttttctttccctcactatgaatttaatgtaaatatcttggaacatgtgtatagctagctcttgcattagagccaacacccctcatttttctttatctctctcttccacgtaaacattggcatatagcccactattatccttgctcttagttgtactaaatggttcaattttcgatttgttatactaaaagcaagtttaatagtatagctaattattggcttttagtctatactatagctaacttgtataatagattaactataaggttagctctatttttttattctctttctttctcttattcataatgtaaatattttggaacatgtgtatagctagctcttgcatgagaaccaacacccctcacttttctttatctctctcttccacgtaagattatagttgacatatagctcactattatccttgctctaaattgcatccacacatctctcactatgaatttaatgtaaatatcttgggacatgtgtatagctagcttttgcatgagagccaacatccctcacttttctttatctctctctttcacgtaaacttatagttggcatatagctcactattatcgatccttgctcttagttgtactaattggttcaattttcgagttgttatactaaattgcatcaacgtatcgatcaaacctgcagtgagctattgatgtagattatagtttttttatacaattattagtgtgcggtattttctctctctaaccttttagtccatgaaatactttttttcaatcgcagactcaacttttcataactaagatccagactagactagctagcatcatcaacagcgcggtgagtttactagccattatgcatctgaaaaaataaccactagcggcaggagggaggcaagcctagagtagttagggcttgagctctaggcttctccaaaattataagtaaattaccatgtaattttagagaaaataaataattcattagttgagtcctagctaggttagtcctagtgtttagtaattatttctggttttgccactaaccaccaggctttagtaaatattgtagacgttgtgagctgtatagctgtcgtgacgttaattctgtgggtcaaaattcactcgctgacatattgaaaggtagatccggctccttgtgtactccctccgtctcaaaaaaagaaaccctggttttcgtgtccaatgtttgaccgttcgtcttatttgaaaaaattacgaaaaaaattaaaaagacaagtcacgtataaaatattaatcatgttttatcatctagcaacaatgaaaatacgaattataaaaaaatttcatataagacggacagttaaagttggacacgaaaatctatggtttgccttttttttgggacggagggagtatgttaacatatattggcaaatgtggtgtagcagaaaggaacacctggccagctgcccagctcaaaaggagctagctaggatacagaacggatccgttgtcaagctttggggttaggaccattaattatattggttccttttctatcttttccgaagcatcttacaaactttaatttactttgtgtacaccttaattaaaagcttccatccgctttggatcttcaccatctgatcttgtgaaataagagattttgccactaagcaatgattgtaccatctcactttttctagttctggataaaccaataattcagagtttccgataattttgttcatctcaactcacaatatataatcaactaagacaacatgcaatgcacaatcacacgaaagtgcattatatattcatctcggtcaatttgttcacaggaatccacattgtttcttctatgccctagctacctatattaagcgcttcagtcctaaggacttctttgtttggtggcatatgtaccaatggtatatttcaacctaaatggtttttgcggttgcttttgttgatgagttccatggtttctccccctatgaaacgtagactcccagcccatcccatagcttccgaggtatctagctaattaagagaacttcaaagggaaatttaactattggccactattaggtttgccaattatctaaatacccttattagatttgtccttattttttttacccctctaaagtggtggcatcttaactatttgtcacttttgcccatgtggtatgccaacatagcaacacagtgtaaaaatcgacgtgggacccacttgtcagtctcacagctctccccttcctctctctccggtctggctagccccgtcggctgctcctctctttcccgcggcgaaccatgtcggtggtggcggcggcgtgccggctcgtggctgcggagaaggagggggagccgagcgccaccgggagtccgacctcggcagttgcgagtgaactagctagatggattttcgcttgtgaacccactgctctatgataatgtgttagtaaactatatatcttcagtctgtgcaatctttgatcgcacttgcactatattgtgtttctctgtaatgttcttgtctgcttatctttgatcaaatagtcgatagaaatgttcatgtataacccacctttttctgagtttttttcctccttcaaaaaagcggttgcaagtttactgccgaggaagagagggtggtgatcgagttgcaggcgcaattcgggaacaagtgggcgaggatcgcgacctacttgcagggcaggacggacaacgacatgaagaatttctggaccgctcggcagaagcggctcgccaggctcctgcgcgggcctctccctgctgcacgatcaacagaacagcggcaagggcaaagcgtcttcttcatcttctctcgcggctcacctgaagcatctaggcccccgattgttgattttggtaattaatgacaagcattatttgtggactaacaatttccttgagttatattttttaagttaggttcccatattgtgtgcacatggatgattacggtggattaaattggatggcgcaaagctaaaagatcgaagacggtaaactagaggccttaaattttaaattgatcaaggagattgggcgatcaaattttgctagtttatttatagctttgtcgtactatcaagaggggttatgacctaaacaaagagatgatcaaaatgccacattaggtcatattgcatttggcacactttattttatcaaaaaccctgagtttccgcctgggccggtctgaccgggcgtgtaccgccggtctgactgcaggcatggcgccgatttgaccggccaggtagcccggtctgactggccggctggatgccagttgggcgcctctggatggccgatccagagccgccagagacgcagccggtcagaccgagccgatggcggtctgaccgagccgtggccggtttgaccggcaactctgctgcggtctgaccagccatgtgtgtcaggtgtattaaatgcacggcaacggctagttttctagccgttgcagagtagtccggtctgaccagccactatatgggggtctgatcggcactgcagtgaggttggggatttcgaccccaacggctagtttttgtgggttgggctatataaatccccccaccagcagcaagggatctctcttggcacttgcttcacttgcatacatcccttgcacactctctcacacactctagagcttgtgttcatctttgtggtgtgattgagggttgattagccaagagtcaagtgcatttgcttcattctagagctagtgtggcacttgaccaatctccgagccgggtcatcgcttattactcttggaggttaccgcctcctagacggcttgtggaggagttgcccgatgaccactccgagaagattgtggagaaggcccggcaccgtttgtgagtggtttggagttcaccaccttcggagtgaaggaagaactaccctagtgatcgaggcttgggtagtcctctccgtgggccgggtcccaccttgcccaccccttgacgaagggggtgtgcggtggcttcgtggttgagcggtagagttgggctcgtggttgagcggtagagttgggctcgtctcaacagggacgtaggaaaccggcaagtttccgaacctcggtgaaaaattctgtctcttgtctcatttatttattgcatttacatttgtacaatttactttattagagacatatttgaaccacttgcaccctaggattgcaaaacttaacttagttgcttagttagacttgtcccttaccaagactagcaacttaggttatttttgattagatgttaatttttataatcgcctatttacccccctctagtcaacatcgttgatcctacaagtggtatcagagcttggtctctcttgattgggctttaccgcctagagagaagatgtcgaacgaggtgaaccatgtaggaaaggctcccatgtttagtgacacaaattattctacttggaaaattaaaatgtctactcacctcaaggctacgagcttccatatttggagcattgtggatgtaggttttgttatcacgggaagccccttgatggaggttgatcatcgcaaccttctactcaatgctcaagcaatgaatgccttgttcaactcattgagccaagacgaatttgatagagtgagcaaccttgagacgacttatgagatatggaacaagttgagtgagatacatgagggcactagtgagtacaaggatgcaaagctccatttcctcaagatccaatatgagacctttgccatgttgccggatgagagcgtcaatgatatgtatgggaggctaaatgtgatagttaatgatctcaagggtcttggggccatctacaccgaccttgaggtggctcaaaagatgcttagagccttaccggacaagtataagaaccttgtcaccttcctcatcaactcggacatgtcaaggatgacacccgctagtcttttgggcaagatcaacaccaatgacatgtacaagttgaagaagaaggagatggaaaaagcatcaccatccaagaagactagcattgcccttcaaaccgaggtggaagacaagggaaagggcaaggtaaatgaaggcaaggatgacttggatgaagagattgctcttcttactagaaggttcaatgacctcttgggaagaaggaaagagagaggaagagggtcaaacaccaatagaagaaggaatagaagacccaacaagactctctccaacttgagatgctttgagtgtggcgagaaggggtactttgcttccaagtgtccttccaagggtgatgatgaggacaagtcatcaaagaagaacaagagtggtggatacaagctcatgaagaagctcaagaaggagggcaagaagatcgaggctttcattggtcaatgggactcaagtgttgagagcttcgattctcaatccgggtccgacaacgagagtgatgatgatggaagctccaagaagaagaacatggccggagtagctatcaaggaggctccatcactattctctccattttgcctcatgccaagaggctccaccaaggtaacatcaagtagtgatagtgaaagtgatgatgatgttgatgatatttcctatgatgagcttgtgagtatgtttgaggagctccatgcttatagtgagaaagagattgccaagtacaaggctctaaagaaagatcatgcttctttggaaaccttgtatgaggagctaaagacttctcgtgagagactcaccatttctcatgagaagcttaaggaagctcatgacactctccttaccactacccaacatggagctcacattgatgtttgcatatcttgtcatttgcttgatgatagtgcttcttgtcatgctatatattttgcatcatctagcatatctacttcatgtgatgatcttatggatatgcctagctctagctctgtgcttctatttgtgatgtttcacttgtggttgtgaacaatgagctcaaggagcaagtggccaagctcaacaagagtttggaaaggtgcttcaagggtaagaccactcttgacaaaatcttgagtgagcaacagtgcatccttaacaaggagggacatggattcattccaaagaagggtaaaaaaaccttctcaccatgctcctcgttttgttaagagcaatggtaagtattgccataagtgtcgtggggttggacatatggcaaatgcttgcaccggtggtaagccttctaagacttgcatgtttgattctcactacatgcttaggaaggttcatgatggtcgcattgttgctagatatgtgggttcccctatacttggtggtaaaaagaattccatttgggtctccaaagctttggtctctaacctccaaggacccaaacaagtttgggtatttaaaagagcttgatcttcttttataggtgaactactacaccggtggaagccattgggtgcttgatagtgggtgcacccaacacaagaccggtgatagaaagatgttcaccacatttgaagtaggaggcaaagatcaagagagagtcacttttggtgataatagcaaaggaaaggtaattgggttaggtaaagatgctatcaccaatgatctatcaattacaaatgtctatcttgttgaaccactaaatttcaatttgttttccgttgcacaaatttgtgatcttggtttgtcatgtactttcaaccctcaagatgtgattgtttctagtcttcatgacaaatcttgcatcttcaaagattttcgttataaatatctttatttggttgatttcaactcaagtgaagcaaatttgaaagcttgtttggttgcgaaaatttctttgggttggctttggcataggaggctagcccatgttggtatgcatcaattgagcaaacttttaaaacatgatctagttgtgggcttgaaaatgtgaagtttgaaaaagacaaactttgtagtgcttgccaagccagcaagcaagttgcatgctctcatccttccaaaagcattatgtccacatctagaccattggagctcttacatatggatttgtttggcccaacaacctataagagcatcggtggaaatagtcattgccttgtcattgttgatgattattctcgttatacttggatgttctttttgcatgacaagtctattattgccgagcttttcaaaaagtttgcaaaaagggcccaaaataaatttaattgcactcttgtgaaaataagaagtaacaattgttcggaatttaaaaataccaatatcgaggactattgtgatgatcttggtattaagcatgagcttttcgctacatactcacctcaccaaaatggtgtagtggagaggaaaaattgcacattgattgagatggcaaggactatgctagatgaatatggagcttccgattccttttgggtggaagccataatgtaacagccctggacccgaaaacggtattgtgtccatcatctcatttagttggaccacacctacactgcaacacaccgcatttttcgtactcgcttgtagcgcccgttccgtcgtggcgcctagcgggaaaattatctcttaaaaaccctaattgcgaaatttgtttctttgattgttgtctagtgtccgtgccatctcaagatctcaatccccgatctatcgtcgagttcaattccgaatcaaatccctccgcaaaagtttagtttgcctccccggggttcgatgggccgaattccgctcggcccatctctctcccgggctctctctctctctccccccccggggcgctcctcccccccccgtcagcctcgctcgcacgctgctcgcgcgtgcgagagccgccccgagcgcctctctccctccgctccgctccgccccgcccgcgcgccgcgcgcgcgtgtgcgcgtgtaccgccgcgccgagcgccccctcgctctccgtctccccatccctcgctgccgctccccgcgtgccgttgctcgcgcgcgcccggtcccgccagcccgcgcctgtcgcccgagccgcgccgttcaaaccaccgcgcctcccgttgttttcccgcgcgcgcgtgccgagtggccgaccgctcggtcgccgccgtcgtcagcgcctgcccgcgcctgtcgccagtgtcgccgctccgctccaaaccgccccgccgtcatcgccgtcgtcatcgcccggcccccgccactccgcgcgcaacccgccaagggacggaggccgagctctccctttccctctgccgcgtcgccccgcctcctccttttcccgaaccggcaaaggggcaagccccctttcttcccct

SEQ ID NO: 58505 - DNA, 65586 bp, Oryza sativa
  unsure (1)..(65586): unsure at all n locations
caattagctttggattgcatttctgattggcactgacagcaagataatacaaaatggaattgtatgctaatagaccgtgagcatagaggcaaaccatctgttccaagttctgacagctgaaataagagaacttacgcaaaagcagcgtatccagcaccaacatttgctgaagttagaagcgcggctgctgacaaattatcaagtccacttggagccacagggttcttaatatccccatcaacctagtaataaataacagaaaagcaacagtcagtcctgatgtacactgcagtatgtaaatatattggttcaggtttaaaaaccttatcccattttgacttcttgtttggcctagcctctttctgtacgccttctcccgatatcgaaaccaatggtgcaccagcagcagctgctgctgatacagcagctgtaaaagatgcaatgagcactgaaacatccaaaatacaaaattgacagattggtatcataatttcgtttgtatgtactatacctgcaattttcggtattgccgcactaattggagcttgtactcctccagtgataaagtcaacctttccactctttttcttctccagttcctttctctcaacttcacgcttcatatcagcttctgtagaaaataggaggctcgtcatgcctaggatatattcttgcgcaagtcttagaagaaatttctcaagaaagaactaaaacattcactattgactccacaggcataatatatgtataaataactaatctccaagttcagtttatgagtgaagaaccacttcgcgaggttgtcctagatcaacaattcccatctcaacataagagcgaccattcaccaaatcatttcagaattgtccaatcatctactagtttattttgtatgcacatgttgctaacacaacaaatcaagcacattgcaagaattccaccctccccccagaatagacgcaagctgcaggtttacaagcatatcataaagaagattggaagttactttgaggtttaaaaacacatcctacattctttttttttcccaagtgaagctgtattctaatgttcaattgtttgtcaaaattgcactatataatccacaagtacagcataatggataaacctcgactataacataccgatctcatcatagtaatcgcttctatcgtacccataaggatcaaaaacatctttactgaagcaggtccctatctggtcaatttcttggtaccgcacagcatgctgcaaaaagtctggattcctgtagtcctttctattgcgcacttcagaattgaagctctttccagcccttttgtacgcaaggaacttgttgatcttttgctgtatccaaagcattggaacataaataaatgtttaatgcaatagccaaataaatagattgtatggatgtgcattctaatttctaagcagtatgcatgtcatgtgaaaggccatgctgttgcagtgtgtttacaggacttgaaaagagaagcatatgtcaaactaaaaacaacagaagggcttcaaaatatcgaccttttgttcagaaataataattacaaatgagcaagagtcattagctagataaacaaatttacaagcatgtaataaatcaaaaggagaacaacgcatacagctatggcacagccagatctcaataataccatgaaaaatgcatgaaatggtttctggggtatggcttatgtgagcaggagaacaaatttattctagacaatggagtttattaaatccaaaggatagtaatatggtcccaagggagaacaatgttctgcataaaaatgtgataatttttttacatggaagtagaacatgtaggaaatattattttattaagaaggaaacctgtagtgctgcagaacattttgcagtcacaggaggaggaaggaaacgactcagaggatcatcattctgcatgttatcagcagcttcttccacctgaacatcttccatttctgctccagttacactcattgctgcagctgcccctacttgattctgttcaggtgcatcgttctgctgagacatttctgatcgtatatttggggtcagtatgtgaacaatacctgagagagtcttttcttcataattccctataggagagggataaaatataaattagattatatctagattgcaaatttagaggttataataattcagtttcatcgaaaaggtaaaacgagaccactaactcaccaaaatgttttctagaatggccagaaacataatatataatcaccaaaggaaataaatctgtcatgatattaagagtttcgtccatggatgaacaaaagaaatgcatgcattcttgttctgcacataacattttggtactgactactaacacacgactacaaatgcaaaagatcttgaggcatgttattgtggtatatctgtaaaacaaggttcattctttgtattttggaacctacatgtttctggctgaggtaattagcaaataatgcatagcctgattatgtgaaaacaaaatatctcaaacatttattattttcaagtgtttgtctatgttttcagctctccacctttcttggatatggttgtcaactacaagtaaacaaaccatttgagcacaaacatgttttctgatatgtgctctgtcattgatgacatatcctaaatagtgctaacgttgtgataaatctctactattataaaaattgaagatgtttttgccggtactttggtacatcatccgtgtatgagtcggttttcaagttcgttcgcttttggaaatacaaatccgtatttgagtcggtttttaagtttgttcgcttttggaaatacaaaaggaattgtataggaaatctctttaaaaaactcgcatgctacttgagatggtcggattcctaattgcagctcatgattttctaataaaatatatatatccaagcgaatttaacagtgaatttcatcttaaataaaccatataacaataataagattaaaatagccttcacccgttgcaacgcacgggcattttttctagttgatactaaattacataaccgtcaataccgagtatgcgactgatcataaatccttaaaatcacaatttctgcatactagctggacatctcgatttgcactagatattagcacggtatgctgaacatagcacaatacaacaaatacagcaggctaagagcttaccctcagcaacctgagcatccaaacccgatctgtctatgccattgatctccccatcctgcaaccagaccataacaacatcaattcaggaaagttggaaactccaagcagcatcactaaacatatacgttgctagctctacctcctgctccggcgacatggccgtttcgtcatgagcgtagtccacgatagcaagcgggccacgccgaggggggcgcggcaggtcggccggcggcatggccgcggcggggcggagcggggagggggacgaaatcgcgaagggcgaggacgagcggcgcgaaggcagcggcgggagccccggcgaggggtaggggctggctagggttctgcggccggccggatcctcggcgaggggaggggatgggggcgccgaagaagcggcagcgttggggttagggtttgagccctcgccttcggtctgaggtgacggcgacgaggaggttgcggcggcgggcggcgaagggggtctgggctcgtcgccgtcatcctcttcctcgtcgtcgttgtacatggagaagagagcggctactgccttggtgtcggacgccatggcgaggcgtagagggggtgggggtcgaggcgagaggttagatttggcgatttggggagaccggagaagacgagtccgaccgtgaaggattcgcgaatgaaacagccgccgtatgggttctcttacaggagcttcaagttggtgatttgtgggttcgaacagaacgggccggttgatgacgatggatgggccttgaatcttcatggcgtcatggccttgaatctttatcttcatcttcatattcaggaaattcattgatggtacgattcaatggaacgaaccaaaacttgataaattttagaggaattttggaggacttgattcctatgagatacatttctatatagttatttgggataaaggaatgatcttctagggtttctttgaaatttctatagaatgaaccattttataggaattttggagaaaaaagtagcatgaggtttcttcccatgatataaagttcctgtccatacttttttaggttgtgttcggtagcctgtgttcccaacccatctctctcgtttttcgcgcgatgcttttcaaacttctaaatgacatgttttttttcaataaagaattatataggaaagttgcttaaaaatcatattaatctatttttcaggttagtcttagctaatactacctccgttccaaaatacttgtcgctttgaatttttgtttgtaacttttgatcatctgtcttattcaaaaaattatagaattattatttattttgtttgtgacttgctttattatcaaaagcattttgagtattacttatctatttttatatttgcaccaattttttcaaataagacaaatggttaaacgttacaaacaattcattatacgatagtacttaattaattatacgataacaagtcatttcgttttccgtgctagagagataggctccctaccagcacaaacgaacgcagattatggtatcttcacaatcctacgttccaaagcagccttaaagttttcattcagtttcatgagtagccaaataagcctccttgtttggaatttggttccaaatctatataacttggaggtaaaatgaggaccatgttattcaattaaatctaagatatctcgttaaacaccaatatgttgagaggttttatttgcacagatcttacttatgcattgtatgaacgctctatatatacatgtatattagtttggttgcgttcgaatcttctatagatgaagactaaaagtgggtacgcaaaacgaaaaatccattagcgtgtgattaattaagttttaattattaaaaacttaaaaaatggatttatatgatattttaaagcaaattctatataaaaaattttcgcataaaatataccgtttagcagtttgaaaagcgtgctaacggaaaatgaggaaaaatccgtatctttatggagttagaacagggccatggtgctatgtataattaaccatgcaaaaaaataacgactttgtaaatagcaagctgacaatcatcaacacaatggttatggcatcttccttcaaaatttagacattttaggctgtcctttgattacaattaattaaacttgagttgaaaaaccaatgtggtatgattgaaatgcatgatcttcacaggtaattgatatttaaattgtgtaataagagtttacaagtcattcctaacaaaggaatggttcacatatctaactactgaatataaacaaaaaaaaatacaaattcaatgcttatgaccagaaaatacaactttacatgttttcttttacaattggcatagctctagtacataattgttaatacgaatcattttgaaatgtggacccaacacaatttgtgtaggcatttatcttttgccacgcgcgacttaacagttttacagctcagatagagaacgttgtagcttcttccaagatgataactcgtgtaaggaaaaatagaagtagattgctaaatagcacagttgttaggatgaaaagtgaggcgagtagatggggagcttaatgcaaattaaaacaatgcggtaaaacacatgattaaaggaataacactggcgttgctatgagcccacgagtaaaatgagtgtctattgctatggcagcatgttctctcgacttaagtgctatacttcttgatataaataactcataaaataaagtcataaccttgcaaaaagtaacagtttgacatcttcacaaacaagggattaagagagtcgaatccacgagagtggagcataacaaccctagtatataggagatatcaattgcattactcaatactcatgcctctgattttactaaaaatatatttttttaagaaaaaaaacacattagaggatgtgaggttccatattaatagagcagaaaaggttacaagattacaactctaaaaacctataatcacggaaaaaaaacacaccaacagtcctgatgattcctacccaccaacttgaggaaaaaaactaacaccgagctgggacctcgcatcaaatagtgtaaaatgtatgtgatttttttacatgccttttgacttttcttttctaaaagggtacatcaaatataattataccaatataataggagaagctttgctacataaaattaacttggtgcactcccatagcattatcagagcaatgtgaaaaatgaacacgctataactcaacatcgatcaatttaatctaaaaattatcgagttacctgaaaaaatcaaaagaaattgttcttcctttgcgtacaagttacgaagcgagcttcgtttgataatttctttttaggttaaacagagtaaatttcataatacgacatatatcactactacaaaaatcgtttttctatacgagggggtcggtaggttccatgcgggccgcttgtggcggcgcctgcaaaaaccgcccccccccggggtgggtcgatgagccgcatgcgaagatccattatcgcatgcggctgcttaacacagccacatgcgataataggtttattttcgcatgcggctggcttaagggaccgcatgcgatgatcggccatatatgctcctccaggcccgagcttgaccatttgaaaacgaagctctctctctctcctaaagcaagcaccaattagggggggaggttttcaactcgaaatttttgcttgaactctatacgaaaggtgaagaactctctctcctccttcatttggctccatttttgttatatttcgttggtggaaagtggagttttttttaatattttgacaaggtttgttctaactagtttttgcaaaatctagcttcaaaatatatgttttgatgggtaaattttgcatgtaatcacttgtacatactagttcatgtattgttgtaatttttttgggagacaaatgcatttaaacttttgtatgaaatacctgcggtctatttttttatctgtaacttttttgcctttatataattagatggatcggtcgtcatggatgtatgagatgcggagaacgtagcctttattaaggaagcacctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacatggtttggacctatcacggggaattcgccaatccggaagatgacgatgaagagttaagtttcgagatgaatgaggcagagaattttataatcgaagacatgtcccgtgaaagaatggatgtcgatgtttccaccgatagtgatgatttcgatggtggttttgatttagaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcagacacaagttttaatgatctgatgagtttgttgcgtgtgttgcttcctaagcctaactttgtaccatcaaacacgtatcaagcgaagaaactcatatgtcctttatctcttggtgtagaaaagattcatgcttgtaagaatcactgcatattataccgtaaagaatatgcggacttggaatgttgcccaacgtgtggcacaagtcggtataaaacggggaatgggcccgtagattcagagtgtaccgatccagattctgataagggtaagcgcggaaagattccctcaatggtgatgtggtacctaccaattaaggaccgcctgaagagtctgtactcaaacccgactgatgctgagttgatgagatggcatcaagagagccggaagatagatggtatgattcgacatcccgccgatgctcgcaagtggaagacatttgatgtaaaacacccagaatttgcaaaggatcccaggaatataaggtttgcgttgagcactgatggaatgaacccgtttggtgacttaagcagctcgcacagcacatggccagtccttctcacaatgtataatcttccaacatggatatgtcagaaacgaaagtacattcttctcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcgtacaaatactggacatcgtctttgaagacagtgtacatgcgacatcgacggttcctaccacaaagacataggtaccgtaagatggctagattgttcgataatacagtggagaatgacactgccccagcagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatagttagattactggaaggacctagagattcgacatgcaattgatgttatgcacctcgagaagaacgtgtttgatagcaccattggcacattgctggacatcccgagtaaaacgaaggatggattgaagtcacgtaacgaccttatagatttggccatacggcatgaccttcacccagtagtgctgccaaatgggaagaccgagattcctcctgcttgttactcgttgacacttgaagagaaaaaagccttttgtaaatgtttacaaggggttagtgcctactggtttcgcatcgaacatcaggaagctagtatcaatgaaggatttgaccatttcgggatacaatgtgcatgactgtcataggttgctaacagtattcctaccaattgctataagggcagtcaaaccagtccatacaaaggtggttataacaaagttgtgctactttttcaatcgaatttcgcaaaaggtatttgatcctctggaattaggtccgcttcagacatttgccgtcgagactgtatgccagcttgagatgtatttcccaccatcatttttagatatgatggagcatttgatcgttcacatcgtccctcagattattgaacttggtcccttatacttacatcagatgtgggcctatgagcgttacatgtcgatcctcaaaggctatgtacgcaatcgcgctcacccggaaggatcaatgttagagggatacacaactgaagaggcagtcgagtgttgtatagactacataaaggatgctaatgccattggcattcctgttcatcgacatgaagagagattatctggaaggggtactgttggtaggaagcagttcttcgataatgattacaaaaaggtgtccgcggcacacaacagcgttcttcaacaactcgctatcgttgagccattcattgagcgacacctagaagaaatcaaagcctgcttcccagggcggtccaatgattgggcatcaagagagcacaagcgtcgctttcctctgtggttcaaagatctaaacctgccagttggtgattctgtggaggaacttactttacaaagactggcatgtgggccttcaagtattgtcaattcatggctaggttacgacatcaatggatttaccttgagtacgactacgaaggacatgaaaagcaccgcacaaaacagtgggatccgtgtcaaagctattgacacgagtggagaaaagaggtcgtattatgggaccattcaagaaatatgggaactggactatggcctgaacatctagatccctgtgctccgttgtgaatgggttaaagacacaacaggagtttccgttgatgactacgggctaacgatagtcgatgacagtaaaacatgccacaaggatgatccatgggttttagcagagcgtgtggctcaagtgttttatgtgaaggacccttcagatgaaagaaaaactattgtcatatccagaaagcaacagatcgtcggcatcgacaacatcgaagaccccaatgattacaaccagttcgacgatgtaccattgtttactgatcttcctgtgcgaattaagaaggttgagagaacaatcgatgaagcgaatatgtcgtacgttcgagcagatggtgttgccaaggttattaagtcatagttattttgtaacctttagttctcattgtgttccaaatgtacgtgcatgaatttaagtcccccttatgttgtaatcattagcatgtaacatttggttacgagttttgagcaattttcatgagttttcttagtgccaaaaaaatttggaatgtttaattgtggcgaaatattgggaatatatatatatgtacagttatttagaggaaagaaaaaatatgagtttttttggtaaaaagatatttccatgcgggtgacttaagccagccggatggaaatatctttttcgcatgcagccggctttacggcccgcacagaaatatctttttcgcatgcggctggcttaacggcccgcatggaaagataattttcgcatgcggccggcttaagtcgcctgcatggaaagatcatttttccatgcgggctcttaagctgcccgcatgcgatgatctgcgcctatatatagggagcgcggggagccaaaattttctaagtcccggcgcccgcgaaaccctagccgccaggctgccaaaattttctaagtcgccgtcgccgtcaccgccgccaagtcgtccccgccaccgccggctcctccccgaagtcgcccctctcgccatcgccgtcgccgccgctaggacctctctaccccctcgccgtcgccgtcgccgccgccaagtcgtccccgccaccgccggctcctcccgaagtcgccccgtccctcgccaccgccgtcgctgccgccaggacctctacccccttgccgtcgccgtcgccgccgcacggacctctcccccctcgccaccgccaagtcgttgccgccggccgccaagtcgtccccgccaccgccatctcctccccgaagtcgcccccctcgtcgtcgtcgtcaccgcagccagcacctctcccccctcgcgcgtcgtcgctgccaagtccttcccgccaccgccggcaatacctcctccggtccaaggtcccccggtaacatttacttttaaaaaaaaagaaatgtgaaatgtgcaattgtggattgtttaattgtggatcgtggattgtgatatgtgcaattgtggattgtttaactttgagaatgtttaattgtggattgttaaattgggacttatgttaaatggagatttatgtttaaattgggacttatgttaaattgggacctatattaaattgtgacttatgtttaaattgagacttatgttaaattgggatttatgtataattgggacttatgttaaattgggacctatgttaaatggagatttatgtttaattgggagtgatgttaaattgggacctatgttaaattgtgacttatgtttaaattgtgacttatgttaaattgagaattatgttaagttcggacttatgtgaaatttagttaaattgggacttatgtgaaattaagttaaattgggacctatgttaaattgagatttatgtataattgggacttatgttaaattgagatttatgtataattgggacttgtgttaaattgggacttatgtcaaattgagacttatgtgaaattaagttaaattgggacttacgtaaaattgggacttatgtcaaatttttttatgtcaagttggaagatgttgagcgataaggttccatcgaacgcaccaatagcgcctcaagaaggtaacgctcctcaaaaatccggtagcaacaagcagccagacgcttctagtgaagaaatgtggcgcacaccaagtgacccgtttccaatggaaataacacaagtcgcccctcgcgatgatgatctggactacatacctatggaacaggctgtaagtgctgaaaatcgttagccatgtattatttcctaactacgatgtgacatgaacctaatggtgtatagagttacctattctgtgcagatgttagtccgacgccactcgaaacgtaaagccgggaggaacaggagagaggaagaagtttagatggacaccgttacatctgcacctgaacgtacggagacatctacaagtgcaggcgggagtgggaaaaaaagacgtggtgagagaagcaagaataaattaccaaggaaacttacaacgtgattgctctcgatcaggatgggaagcccgtcgagccaccgatagtgcggtccaagtttagcaacgcatgtggcactctagtcaggacgcgttgtcccattaatgtcaagttgtgggaaacggtggacgacaacatcaagacatttctctggaatgagttgcagaagtattttgtgttccctcctggatcagaggtcagggggagagattacgcacttaaaaagatgggagatcgatggcgacagtggaagtccgatcaaaatcgggattatgttcagaagaatctcccaccgtttacggattatggacaaatatcgcaggctgactgggatacgtttgttgcggatcatacaacagctgaagcattggctttgaggaaaaaaatgtccgagctcgcgaaaaagaacagatatccccatagattggggtcgagcggatacgctggtcacgtcgatcaatggcgggagatcgagcaaagatttgccgctgccggcaaacccctgctggtagaccccaaggttgaacgtagcaagaactgggtttgggcgcgcagcacaggtcaagtctcggataagggagacatactattcgaggctccagacatagaagaagtgactactaatttgcagcagatagtcgagaaagaaagatcagtacagttcgccccacggagggagcgagaccagcttactgcggcgttggggacggctgaacactctggacgtgtaaggggtttgtcctcaaagacgagttggaaggtagggtttccacaagacgcaccaagttataagaagagagacaaatacaaagaacaactatcagacaaaatctatgcgcaagtgaaggaacacttctactcgttggcagctgaaaacccgacagcctttccaaggttattccctaatggccagcaacccacacaatccgcacagcaaacaactaatgtacccaacagtgtaggctcagtgcagacaactcccttccctgtggatagtataactggaccaactccgtgcagtctcgtcgtaccaatcggccgcgctggaaagactaaggaggttgcaatgggtttagcgatacccggacgtcaattccacaacacggcaatccctgaggattacgcaagggtacaggtcgccaaggtccatagcgatcacgtttccttggaactagacatacctgcacctgaggggattgaacttcttggtgatgcagtgaatcagtttatcttgtggcaccgcagagacataatcctgaccgcggccgttccagcagcagaatcttcaactccatcctcatcacaggcaaggacagctgccgctcctgcaccaccgtcgcctcctgaaccaccgtcacctcgacatccgtcgtcaccaccaccgcttaggtcaccgcctcgccaacctacaccaccaccctccccttctcaacagccgcctctcccggccccgcaaccagttcaagcctctcccacctccccagctaaacagcatgctcccccggctccacccttagttcaaacctctccacctacaccccaatctgctctggtagaacaagtgcacataccggaaggtactacatccgaaccgaagtctaatcctttggaacctcgtcgtataattccaaagttgatatcgacatatgacccaaaggagattgacaaggataaggagaagttcatgtttcagctttcaggaattctgagaagagaaaagaacttgctcacgtcatgtcagactcccagaagtcagtactagcagcccaagatgaattgcaatcatggttatctgccgatgtgcctgaaacttatgagtatggcaagccattcttgccaacatatcttatgaacaatctaccctgggaaatgagggcaatgcacgaatggtatatcaaggcatataggaagggtctcggtttcataagcatcgccgtcccggaaggtgctttcatgagttgagtggtcctaatgggatattttttttatctctttccgagacctttacgccctctacaagctagataaaatggacgttaatctcgttgcggcattctgtctgtaagtctgaactctttattacatgttacacgtatcattccaaacaaagaaaccaaatctcattacttctttattcattatacagtatgcaattccacgaagctgatagaactggagcaaaggttggatacgtcgatccaacaagaatatgcaaaacacgacacaccgtagagctgagagaggactgcgagcaattggttggcaagacccctgaagaaaaggaagaatatgtgaagacattgcacaagaggaagaagctagaagtagcaacatacttggcaatagcaatgttggcgcacgccgacaaagatgtcttaatggtcccgtaccagttcacgtaagctttctcttctttttgtttaattaatttatcttcttcggaattttctgtctccaataagcctatcttatatgcagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagcagctatccgtcaggactggctggccggtactatcaaatctataccaatacaactaattatcgaacagtacatatatactaaatatatttactgagatcggtccccataattatatcgcagtgctacaaacaaccaccaggaaccaacttgtgcggttattacgtgtgcgagatgctcagagtaaatgggaggtacaaaacaaccagtaaccgagtaagtcatcgaactcttctctacaaagaaacccatctcgcacacacttctcactgagtaccattttattttcctttctatgcacagatccccgaaatcccatatattgcataacgattcaatgacactactatcttgaacgtggccgctgacctctgccgattcatccgtcgcgatgtctgcaacgcaagaggtctcttctacgacaaccagagtgaattcgcaatggacgacaaatttaaacctctcagagagtgggagaaagaacatatgcaatgacatgtacactacttatacatatgatgaaaaaactgtggcacttgtattatatatttcgtatgtaaattacgattgaattaatggttatgtattatatgtttgttactgcggcacttgtcttatctcatatgcttactattccgaaatacgataataaatccctcaataatttaatattaattatgagacacatctcaccaaaaggctagaataaatattatttgagctattcggaaattgaatttcgcatgcggtctacttaagacgcccgcatgcgaaaatagattttggnatggggttttgttaggtcgaccgcatgggaaaatatatcttcgcatgcggcttcttagatggaccgcatgcgaagatctattttcgcatgcggccgtcttaagtgaccgcatgtgaagatcgatcttcgcatgcggctgggacggccgcatgcacaaatggtgatctttgcataccatttcgcgcatgtgggccggccaaccgcatgtgaagatcgatttcgcccgtatgcaaaaacgctttctgtagtagtgtattttgatcaaaatatcgcaaaattgcatatttttaaaacatcgtatcataagactacacatatagtgaagattttagagtttatattcatagcactattgaggtaacaaaagttgtagatttgtgatatgttaaatctatagttttgtcctatgattcattaaatttgtagttttgtaaaaaagcatggtgtttaatatatagttttgtgatacacgtttttaaatatgcagtttcgttatacacgtttttaaatatgtagttttatgatagattgatcaaactacctgtaattactcacaacttgtacaccacgatccacggattaccctcttgaaactattgctcttactagtacaaagcaagtcaccatatgactattacatgtcattgcctctgttggaggctaaccttgggcttcgttcttttgttgtctagcatacggtttaggaacaataacaggagacacacacacatataagtggcgtagctagaatttaaagtaaaagtgatccatctatatataatatgtcaattaaaagggtggtccactatacaatttttactatattaactaggacatatactataatttcaaatttttaggtggtcagtggaccacggtgccacctagctggctacgcccctgacacatacatatatagttttgttttccttacaaaatggacagactcccttttaaaaaaaaacctatgtgttttatgtggtcaaatcttatagagtaaatttcacaaaaactacaactatttagttaaattatcaaaaaaaactatatttttaacatgatgtatcacaaaactacagattcaacactaaatttatcatagaactatagacttaggctgcgttcgttcattggagataggggagattgtcactcgtttttcacgcgcacgcttttcaaactactaaacggtgcgttttttgtaaaaattttctatagaaaagttgctttaaaaaatcatattaatccatttttaaatttgaaaatagttaatactcaattaatcatgagctaatgactcacctcgttttgcgtatcttcccaatcttcccaattctctctccctcaaacacacccttaaggtggaatgtcgcaaaactacggattcagtaacaaaaatatcacaaaaccacatatttattattaatttaatcacaaaacatggacatatataactcaaatatagcatgaatgctaaaggtttaaaccccaaaatctgaaattttgtgataatctatctatctattatatactaaaagtccattaaactttctacaaatcgctcctaaaccgccacatggcaactctacaaacgctcttaggctgccaagtagcatttaaaacatctaatcattgattttcatttaatctggtggacccatatttttaaccgttagatctaaaaataccaaatatatttaattcatctttagaattcagaaagccacacatccacgtcgatcactcgcgtacgtgtacgttcatgtacgtacatacttcgttagtgtacgtccttccccttccttcctttctttttattttttctttttctttttactcaaatgagataaaaactaaataaataattttagccaaattaattaaatagggagtagctaatcttataagcactttacaacattattatcttaaatttattacttaggtattaaaaacttaatatgtagtatacaatatactttgtcaatcctagcctaaaatatcaattattgtatatcctcaatgatccccatatatataagttttatacataagtcactatttactaatcaccaagtcatattacttacgaggtattcgtgcacaacgcacctaacagctggatagctgatatctaatgagcatgtatgtcatcaaacaccgatgataaagggcaattataagtgtgcaacgatcaacaaattataggtaagtagaggatgcaactaatccaccgcaaacaatagttgactactggtagattgtgactatgagtaatagcatttctatactcatgcaaacgcttctaagatgtcatgtgatgctctaattagaaataatctaagaaaaactgtaaaataaaataaaagtattattcatcgatttacacacaaaatcggcgatccattatttttcaaccattaaattagatctatgataataatccctctgtctaaaaaccatctaatcactccttacgtacatacacaactcctatgtacatacctatgcaagatatataaaaaggaagaaaaaagaagagtgtgtatatgatttgtcccatatggttgttttctctttctttctagatataaggtttcttttctaaattgagcatatacgtagtgatcactccttgccacaccgctgtctcatgccacccgttgctccaccctcttcctgtcaaatttttaaggaaaaaaaagaagagtgtgtatatgatttgtcccatgtggttttttttatctttctttctagatctaaggtttcttttctaaattgagcatatacgtagtgatcactccttgccacgccattgtctcatgccacccgttgctccaccctcttcctgtcaaatttttaaaaatactttttttactaacaatttaaagggcaatcacatgagctcatataaatgtgtgcatacgcacattatgaatacaaatacgcacaccctattcctataataaacaaatatttgtccgaaaagaaaaaaaggaaaaaaacaaacgttcatacgtgagactactattcgctagaaaaaacatacatgtaacaacattgtatctcttttttatgtcgtccccagcaaaatagtattaacatttagcacaaataattttaataaatttatccaatattaatccccacaaacatgaaatggtgaattagatgtataatacaagaaaaaaaattaaaacctatattaacttgtatgttagcaaaggatcacagtttgagcaaatttttttacgtggtccacaccaccaaagctattagatttttcgaattagagtccaatgagcaaccctgctaatttttaaaagagaaaattatatatataccactaaaatttagtagtatcgattaacaccataaataaattatgtatactctatataataaatcaactcaagacataaaaaaactattttcgtcacctccattttctctcactcataccctgaagggtgccaagcatgaatctcaactggctacattatagtaactatggcaagagtatgcattattgagctgaagtcgttttacccaaactgatataccttattttaaactgttagatctatatattaaaaaaaacctaccgattgatcaggccgtcagagtgcgtatgtacaacacatgtatccagttccctcctcacggatgaaacgaacctactggctctcgtctctttgtttccttaccacaattaagttaaccactgaataaaagaagatcctaaaaattaccccgaaaaaatatccaccttatttttttaataaaactggtagactaattacttcataccattagacatctaacgactttctaccaacttaattatatttctcaacttgtataccaggtctatttacctatacaaatatgtaaagctaaatcaatctacaaaggtacaaataaatctgtctatgaatggagctcttttttattactatatatctccgtcttataatggatcctaaaattttatacccactctgttccaaaatataacaatttttagcacttacgatttgtcccaaatataacaacattaccaccaacattcccttcccaactaatcataactctaaaacttcttatattctgggacggagggagtagaaatcaaggaggaatgaaaaaaaaatactaagatacccatcattaaataaggctcattaaataaggagatggttagtgtaatgttggataaaaattaaatgaagaatggctagatggaacgagtagtattaataattccttatattttaggatataaaatttaaatccttcgatttatggatggaggtagtagaagtaaatagaagtacgtgagtatttgtttaattagataaaaatgtcatattatcatatttttaatagaaaatttcttatattaatatatcgtcaaatctacgaagacatatttagtatacaagaaaaaaaataaagtttaaattaagatgctaaatatttttaaaaataaaagcatgtagtataaaaatgatatttttatatgaaccagctccattattgtgatatatttttctcataaatttaagacgacgtgatgcaagtaattttagtttacaatttgtaacaacccgtcctttagaacaaggcagcccagcctccatccaactggcacgcttacttataaatatcacctcacttacacttttattctcgcttcgcataaaatagtcaacccaaaaataatatggttgaagggacaatgcatcacaggttagctacactcttgcttaaatagcaagatagtactactactcatgtgcacacaatgcttatagacaacacatgtcaaatcctttaaataaaaaatatagaccacatcctaattgcactaggatttctaagacaccccctcaaaggatccgacgttcctgtcggtccaacttatctccatagtcacatatgcatatagacaaatatccagaaacatgtcccctcttaacgcacatccgtacgtccagtgatcgaaacaagcttccaaaacaatcccaaaaaatattgataaacacagatttagaagagtaaaaaaatattttttttttgaaaaaaaaatcttatacataaatattcatcacaaaatttcaaacaccattaaataaggtgcccgcgcatttgcgcgggctaccttcctaatttcattagtaaatctatagttatgcgatatttagcattaaacatgtagttttgtgaaaattaattgttaaatttgtagtttcgtgatacatcactttaattgtatagttttgtgataatttagccaaagtatctgtagttttttgaaatttactcaatttcataaaatttagattcaatgaatattctaggttggaaaagtgcagtcaatcctatagtagtactgtgattttgccaaattttatagtcaaagttcctcatcactactgtcgagaaaagttcttccatggctccatgtcaatgttcagaacatcgcaccaaatgaagcatttcctagtaggccataatctgtccatcaatcatttgcataaaatggtttgattgtagtgactgcaaaatggaatctggttcaggtctccaaaagtcgaagtaccttcgcaatcaatcatgtgagttgctaaaacaacccatccaaatttcccagttagtgtcatttctgacttattatccgaatatagttgctgcactaactgcggccgctacaaatccaatgctcttgatatttctgcagagtccctgtcatgcgtggctatatactcctattaggcaggtcaattcgtagccgggaagaaaatgacgaggattcccgatactgcttgtcccgttgcagaagccacaggactgacgccgacgtccgtgccgtagttagaccgtgccaccacgtccctttcggcttatcggcccattccggtgcccgtccctgtcgctgcgtatctaccagaactccagagccgtaggtgctttgctcgagtcatgtacctaatcctaaatggtctaatggcgtgtgcttgtcttggctcgtactccagcctgcatcttcacgcgtaatttgctgctagtgtttacagtgctcctgcagcttgggttttcagataaaacggtttaacactccacgtacttgccagcgcaggatgatgctccaagtgttggcaaagtggcaacggttttgccgtgacggtgagctagtgggagaccccaggatttcaggttccgtctcctcgcgaccgcgccgcgcgtcggtgcacgccaccgaccgccttcggtcgagcgcggcgcgcgtctaccgggcgagggcgaggccacggccacgcgccgcctccactccacacttccacaggcccgggtcccccttccttcccggggatggcgccgcgccgcgcgacgccggcattttccgttttgtttatgctatctggactggagcatcaagtacggccaagtgtgtggaaaaatcgcggccaaaccttgggcacgcctcgcgcccgcgcacccagccgggacgctccacctgtccgctcggggcatcgcccgtgcaccacgtcgccaccgcgcggtctatccgattcaaaaccctcgcgtctagaaaaaggcgatatgcggggacgctgcgctttattttaagcaaagaaaatttattgtactggtgctttttattagtgctagtattactcgtactgctgtattttcttgtgtatagtacatgtaccgcaacggtagtactgctgctgctgctagtattgtactgtagttttttttttctcagagaaaagaacagaaaataagagaacggaggagaagtaaagtggctgaaacggctcaattaagcacgctttcccgagaggccgagacgtacaccatggctgacaatgcggttcaggcatgttaagtcgcgttttgtaaggtacgcccttggagaactgggtattcacataatcacgtgaagaaccatcaagcgtacaacggctctggcctggctagttaaatttccccatttatgaaggtgaatctggtactcttacacaatcatcgaaggattttacatgttcaaaaaggagcatcatttaacgttgttcggcattgttatcttgttatagacattcagcattgtactatcgtgttatagacattcaatatttgtcaaaatggacggaagaaataagtggagctcgaaacagttttgggaatttatgaggaacgccatgctttgtgtacacaataagatacaacagcggagtaatgatgtgtatacgaatacgacttgattactatatcgattggttagacgacgatgatgttagcatccattttcattactgggagaggatgatgtgtatacgaatacgacaacataggtagccgattaggtattgaaacctaaccgcctaaatacttgatcaaacaaaaaagttgtatctgcatcgcacggtatggcttgaatggaacatcacaagttatgaacttacaaaatttgactactctcgaatcaaaaccgcaacaaatgtatgaaaatcagaaagatccgcattaaagaggaaatcattatgatatttaatactagctgagtaatccctacacgacacacaatccctacactctacctggctaaccaacaaattccagtaccaaagtaatcaagccaagccagctagtattgcacctcggtgtagcgtgagccgtggccagtccctcagcaacaaatggaagccaccttggatgtttgcttataatggccactaatttactggacagctgttatacttcaatacctccccgcactttctgtttaagcttagcttgataatttgtactcacaccgagtaccagcaaagaaaaacgtaactcactggcgcgcccggagttaaaacacgaagatcactcgcaacagccggtcgagatgaggcctcatccccacaaagtattttctacacctagatgctatgcatgtaatttaaatagatatataaaaattttataaaatttaataaaatagtacatgataatataagacactatgcaaacatgcaagtctaaattcaatcgatatatgaagaaacaaaaataacaaattttgtctgtacggtacgggtactattcactgtctgattttattatttttgtttctctagttgtagatccaatttagtcctatatgtttgtgtatagacttatatcatcacaaacaatgttactaaatttttttaattttttttataactatttgagtcgtatgcaaatgataggtgccatagcacctaggtgtgaaaaaaattttccgcctcatcccaattcccaccaatacagggaacggcgagggcttgatcccataaaacaacacgataaaaaaggcgaaaaatctcccccctaaaacgcgacctgtgcggccctgggcggagaataacccggcggcggcctacggcgatataaaccgtatattgagggagcaagccgtggtacagagcagaggaggggggagagagagagagagagagagagagagagagtcgtgtgtgcgtgtgtccccggggttctagctttgggatgctgatggcgaccgtctcgccggcgcggagggagccgacgccgcaggcggtgcgggcgtccccgatgccatcggcggcggcggcgttggtgaggagaggcggtggtggtagcggggggacggtgctggggaagtacgagctggggcgcgtcctgggacagggctcgttcgcgaaggtgtaccaggcgaggcacctggagaccgacgagtgcgtggcaatcaaggtgctcgacaaggagaaggccgtgaagggcgggatggtccacctcgtcaagcgcgagatcaacgtgctccgccgggtgcgccacccgaacatcgtgcagctgttcgaggtaatggccagcaagaccaagatctacttcgtcatggagtatgtccgcggcggcgagctcttctcccgcgtctccaagggacgcctcagggaggacaccgcgcggcgctacttccagcagcttgtctccgccgtcgacttctgccacgcccgcggcgtgttccaccgtgacctcaagcccgagaacctcctcgtggatgagaacggggacttgaaggtctcggacttcggcctcgccgccggccccgaccagttcgaccccgacggtctgctccacacgttctgcggcacgccggcttacgtcgcccccgaggtgctcaggcgccgcggatacgacggcgccaaggcggacatatggtcatgcggtgtcatcctctttgcgctcatggccgggtacctccctttccatgaccacaacatcatggttctgtaccggaagatctacaatggggagttcaggtgtccaaggtggttctccaaggattttactagattgataacgcgccttcttgacgcaaaccccaaaactaggatcaccgtgccagagatcattgagagcgattggttcaagaaaggatacaagccagtcaagttttacattgaggatgacaagctctacaacctgtctgatgacgtgctgaacttggagcctgctgatcctgttcccccaccattgggtttggcacctcctgttcctccacctccacaaggggatgatcctgatggttcagggtctgagtcagattcatcagtcgtatcctgcccggccacattgtcaactggggagagccagagagtccgtgggtcactaccacgcccagcaagccttaatgcatttgatatcatatcattctcaaaaggattcaacttgtctgggctgtttgaggagagggggaacgagatcaggtttgtatctggtgagcccatgtctgacattgtaaaaaagctggaggagattgcaaaggtcaagagcttcacagtgcggaggaaggactggcgggtgagcatagagggtacacgcgaaggagttaaggggcctctaaccataggcgcggagatatttgagcttacaccctcccttgtagtagtggaagtaaaaagaaaggcaggtgataatgaagagtatgaggatttctgcaacatggagttgaagccaggaatgcagcaccttgtgcaccagatgctcccagctccaaatggaactcctgtgagtgagaaggttgaaaggtaatgattctctcctgattttacttatatgcattgtagctaaatagggaagcaaggattttgtgttgtttaacatgcgcaaccgggcagaaagttaaattgattgatgcttcagttccaataattacataacaatgtttcacttcttgactatacatcctgtatttcaaattgagcgttcaagagtttgtttgctaaaagttaattgatttttattcatgctatttgtttttgttaacgtatgtttaattcacaatcatgcctattgcctaataccagtatgtagaaggaattagatttccttgcacggacacaatttaaagtaggaaagccttgcaattgaaaacctcgaacaactggaacttttattatttctagagtggtgaaagaatgctataggttttgctgttagattttgccaaccattaactagcttgcctcctgcaatccaatttcacagcgcttggataatgcgtatgtctggaaatttgctgccacttgaccattgcaagtgtgcttcgtgaaaagaagcaaatttgaatggttctaatcatcctagtttgtggctgttaaactgattatagattgttttgtttcattctagagcatgatttggtttatctaacatctgtgctcttttaatctatgctacgaactcaatttttcgtaaaatctttcccgcaccctattcttatggactttttagcttgtgatagattgtataagataaatgtcttttctagtcatcagttaatgaaaacattttcgcttgtcttatctatcttttggagttactttaaaaagtgattatgcactgttctactgcaccttagcttgtaaacttcctgctcttatttatttttctttatgtttccattttttttggataatggaattcaatccagtattgatgatgattccatgttaccccagcatttattggtgttgaatgtttacatgtgtcataattcatattgaaaaaacttttgaaaacaaatatagaaaggaaccgccaatatcatgtccttctggtttccccattgttgttatcaccaacttccatggattggcattgtgctgcacatcagcatatgggatagaatgggagcttgaagggaatgcttggcagtacctccgagtaccgaaatgtcatttttacaaagaacatgtgcttcactagattttcagcatgctaggtaaatgttgaaagtgctgtataggtttattatctggtgtagctccctctgacatagtaataacaggttgctttatgggaaacctggtagattttatctatttaatttggtgaaaccatgaaaatgcaaacatcatggctgagacattgaaaattacaaaacagaaagggcgcatagcaacaccatatactattcatgcaaaccatttctactattttaacctgtgagtttttgatggtttctagtttctttttacattcaaatgggctctaattcctgattttaggaggttcctttcttttcagtttcattgctgttattgataaattatcttttttttcattaatgataactttatactttgatggatctttgttgaacacttaatctggtgcacatgttagccacccaccattataggagaacacatgggacacatttaccttcagaggtaaggagggttatgtgcgtaagctgtgcctcggaggtagataggtgtgtttccagaagactttttgttacatttgtcaacctaattttcctccatcggagtagtacattctgtactgcgcaatactagcatcagttaggaaagttggttcaaatatgctccatggtacgtgggtgtacctggagctgttctgtagtcttgttttgaatcttcaatttaccttgaagaattttgcttttgccagtgaactgttatagtccatttgaattgtttgaaatgctactacaaccggaaactattgctttggttctcatagttcagaactcaataggaaatagaagtctattgctgttattacatacaagtgtgataagactaacagactgacatttgattatttccttcttgtcctgcaggtcttcaagcttacaggctcccctcaccctgaagttgataggaacagaaggcagcatgagctagagacaggagcttccatgcagttgacagggagatctcttttaccggaccaaacctgaccggtctggttcccgttgatgagctcgtggttttgataactagcaagagttctctttctctggatggcctaagatcgtttttaggcaatggatcgagacagtggatgtagatactccggttgtggatggtgcccaggtgggcgtttaaagtggatgtagataccctggttgtggtggtgcccaggtgggcgtttaaagtggattgtactggccagttttctctcgacttagcggctgtgtgcatctgcggtttggtttctttggcagcatcgaataattttgtggtaaccatgattctggtcgggggacagttgattgaggtatgggagggatatgcatgagccgggcatgtgccgaccgattggattccgaatcttccattcctgatgccattagcccattattggatgcgaggtgacagatttgggcactgcagtgcggttggttggttggggcctgtggggactgggggtcgagattacttggacctgctgtgctgcagcggctttggctgaggtcaccgagcacgtgagagcatcggtgggtggcatggttggcctaccccggcagtggtggcggccggctcgggccacgagagcgccgcgccgtttgtggtggcgcacggctctgcagtcggcggcgggcccgttgttgcgcatttccgtgataaagatcaccgtggtatgtcgtattctgttatacaatgctctttttgtggattcgaacttcgaatatggagttatggacacgggtggtcatcgatggagacaacagtggcgaaccggcgatttcatatggctcagtgagatgctttaaggtacataacaatttgaggtatgcattcatttaatcatgacatggcatgattaaccttggatttgtgtgaaagctatcactataacgacctgtactcttggtgatattccccaccgtgccaatttcctggtatctacactcctcaacggatatgtcgtggaaatgcagcatttctaacccaacagatacagggatcatatttcatcctacaaagattatgtgaaagagatcagcataataatggaaatacgcttaaaaagtaaaatcatgaaaattccatgtgatagttaggatcgacaatgacaatgattataatcatatcacaatataagatatagcctattgtaatataagaatttgatgctctgttttataatgttactacctctttacttcttgtttttgaattattctgcctccacttttctttctaagagtaaattgtattttatactagctaaagcgtagcatgtttcgctttgcactgggtcgtttagcatatactttcactttacaccatgttgtattgaaataaggttcacttaacactacgatacatcatgaaaaacaatttcatgaactttacaaaatatggaagaaacgtttgtgtaacatggtttcataaattttattcatactttacagaatttcctcgtaaatatatgacgcaacctagtgtaacgaaacttgttcagatgtactctggtataaagagaaaatatgtttacccattacaaagtgaaataaggtacaatctaccaagtgcaatttattcttcttttaacagtcaggttaataaaaaaagagagcatatatcacttatatgcttggggtgaataaacataatggtcctgtcatttcattttgtcgaattttgggctcgtttggttctctgccattggtaaccttgccaattttttctgcaacggcaagaattggcatagccaaaaaaaaggtagtgaactaagccaaataatttggcaatgttaatttctttttgctacaaatcaaacagtagataatagtagtttttttttgtttggttgggtttggccacaagccaaaagagcctactactatttattatcatttagttcaaacaatactttccccctcttgtagcaacacccttgtgatttatgagggtcgtgcctcacataaaaaactctcggctcacacacacacaagaaaaaaaataacatggccttttaatgaactacactcaattttttggttcgtacttcatcacataagatttacgggttgcaaaaggctcgaaaagccaaacgagaaacactaaatattttcaataccaacggtaactccagcttaagcaattgtagtagctcaggcacttttgttaatagcatttgaaatgacttaggcatggaaggcacagtgacgccataaaatgagatggaacggaagtgaaatattcgaacattgtattttcttaccccgatacactaatctagtttgtccttctaagtcctcttctatataagagaactatcctctcaatacgctaatgcctacatgaacatggaccaaaccgtctcacgaagttatgaacctagctcacgtaccacattaatagaccaatggccctcttaatttttcatttagccataaatactactactaaatttagtgttttaaaataaggtgattttaagaaagagatacgaacctacaaagttactcccgctatgttagaaaatagaaactagctaatgccttctaaaatcaacaaagtttttgtctgttttttttcttccaaaccgttagaaaagaatccaacatcgattcatagcctcagaactcgctgaacaacattattaactttaatccaactttacaacagaaaatcagctacaaagtatacaagcctaccactaagaaagtaacaccttctgacttttaaaattagccacactactgcttgcacgacatgcttgcccgctacgccgcatgtgtttaggctagtgcgctctctctatctctctcacacatacatttatgcacgtattgcctactctgtctctctctattcctcctaattacttaatcaacaaatttcaaatctttttaaattatatttgatttgtgatgattgcaccattatatttagtgcaattgaatctttataatataataaaaatctcatatgattacatttctgatgaaaagtatatatgttttaacgatgaaattcaatgtttcatgtgtgggatacaaatgtttcaattgaaatcccactatgttgctaattttttacttgattttatgagggtttttttaatgtttcacttgttgggacttaatgtttcatgtaatagtttatcagtgttgcaaccggtattttttttgaatgttgaatctcttcaaaacatttgatcaagtgagctaaaatatttaacttggtgataaaacaattttctgtatgtgctgaagctgtcccaacgcctatctttgttcagtgttctttgtttccttcctatgcaacagcttaccatttagccaagaaccacctagcaattcaattcaattccattagtcaacaatcacatagcaatcactagttttaatttgatattcacctaagtgacttcgttaatctcaaaatatactggcacactcgttagatacacttatagggaatgcatgtatgcacatgtctatgagcgtatatgtcgatactgtgtttcgaagaaaaaaaatcatccaacaacatttgtacctctaaataaactttagtctcactttgatggatcacataggaatattttggcaatctattatataattaaaggaattgaaaaaggagcctccacgttcgctctcatggcctagaaattctcacattaatcggagaaaaagaaaaaaccagagtccatatagaaatacaatttagaaatagctgaaattcgaaattaaaaaataaggaatattagaagaggagactagagtccatatagaaatacactttagaaatagttgaaattcggaattaaaaaataaggaatattagaagaggagtatagagtccatatagaaatacaattaggaaataactgaaattcggaattaaaaaataaggaatattagaagtagagtatagagtccatatagaaatacaattaagaaaaaaatagaaatttggaattaaaaaataaggaatattagaagtagagtatagagttcatattggaatttaaaaccaactaaaattcagaataaaaaggagcctccacgttcgctctcatggcctagaaattctcacattaatcagagaaaaagaaaattcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttattaatataatgagaaaacatatatgctattatatgagagaaaatataatgatgctagccgcgcaatctgtgcgggccaccatgctagctagtttccctaaaagaatattgacttccaatttactatgtttattacaagcctatccactaagaactaacacatcctaaaattagccaaagacgcctcgtttccttcctctccaacaccactggccaacaatcccctagcaattcctagcctcagaacccaccgaacaaatcaaaccccaaaaccaatttgcaatggtcgatcatccaccgtctccatctgtgcacggagggattcattgtccctccggccaatttcccggccggccggaacggcggaacctcgcccatgatcacttgaaacacctcccttgctcttcatggccatggagacgacgagccaagattcgcaggtgatcatggggcggtacaagctcggccggctcctcggccgtggcacgttcgccaaggtctacaaggcctataagttggccaccggcgaggccgtcgccatcaaggtgttcgacaaggaggcggtgcagcggtccggcacggtggagcaggtgaagcgcgaggtggacgtcatgcggcgtgtgcaccaccgccacgtcatccgcctccacgaggtgatggctacgcggtccaggatctacttcgtcatggagtacgcgagcggcggcgagctcttcacccgcctctcccggagcccgcggttcccggagcccgtcgcgcgccgctacttccagcagctgatcaccgccgtggagttctgccacagccgcggcgtgtaccaccgcgacctcaagcccgagaacctcctcctcgacgcccgcggcgacctcaaggtcaccgacttcggcctcagcgcgctagacggaggcctccgcggcgacggcctcttgcacaccacgtgcggcacgccggcgtacgtcgctcccgaggtgctcctgaagcgtggctacgacggcgccaaggcggacatctggtcgtgcggcgtgatccttttcgtgctcctcgccggctacctccccttcaacgaaaccaacctcgtgatcctgtaccggaatatcacggagagcaactacaggtgcccgccgtggttctccgtcgaggcgcgcaagctccttgccaggctgctcgacccgaaccccaagacccggatcaccatctccaagatcatggacaggccatggttccagcaggcgacgtgcccgctcggcgacatgtccctcgtcgcgagcgcgccctcggtgctgcttgccagaaaggaagccagccagcagcacgacgacgaggaggacgatgggtttgcacgggagaagaagaagcggtccaatgtgatcatgtcgtcgccggtgatcgacgtgaggccctcgagcatgaacgccttcgacatcatctcgcggtcgagagggctggacctgtccaagatgttcgacgcggaggagcgcaggtcggaggcgcggttctccaccagggagaccacgacggcgatcgtctccaagctggaggagatcgcggaggcggggaggttcagcttcaagctgaaggagaaagggagggtcgagctggaggggagccaggacgggcggaagggcgcgctggccatcgaggcggagatcttcaaggtggcgccggaggtgcacgtggtggaggtgaggaagaccggcggcgactcaccggatttccgggacttctacaagcaggagcttaagccgtcgcttggcgacatggtgtgggcgtggcagggaggtgattcgccgccgctcgtgccggcggcggggaggaggccgatcacgaagcgctcttgatatgccgactcgatatcgaattttcacgttgtaattgatatgctctctgcttattgatctctcgtacgtgtttgtgaagggtgatgggtgaaccaccgtccagctgatctgtgagtttttaaaagcacgaattacatttacgttggcattccgctgtcagattaaactaatcagagtttcgtaggacgtgacattccaattcttcttctttttttaaaaaaaaacatgatattccatatcctcttttttagctgatactgatatctcgctgatcaaaactttgaagtagtgcatagaaatatttcgtagaacacagctatcgcaaatgtcatttttatttctaaaaaaagctcatctcggcaaaaataggattcttcccggctaactgttggttcattttgttgttagattctagggctccctcatgtgtggatctagaggtgatatgctcataggaataatggtggttgtattagagagcgaacaggagagagagaagagggagataggaacccatactggcgtcggtcttggagcttaatgtggccatgtcaacggtgtggcggtgtgagggcgtcgctaaggacggtattgtcggtgtgggcgacggcggcggcgagactgtgagcagtcccctcacttcagcgcggtcctaaattgaagggtattctatggggagtgtgtgtacacggcgaaccttggatcgcgtgccccggtagctcccccttttattgtgtgctacgtgagaagagcccacagccacgaaacggctagcgccccgatcacctctggagttcgcaactaatatttgtgtccttcaggaaaattatgcatccacgttaatatatcaacgtttctgttataatcacgtgaatcatttctattttagtcgaaacatggtttggccattttatcgaaaaaagatttgtgtacagaaaaatattactgaaatcaaacgtagactgaaatcctggtatattttaaggtggccgttagtgtctaaaacggtataacctgtcttttgaggttaaaagttctaaacctgcactgtcaattttttctttcccggtttcagtacgagcaatgatggattttttaaaatatattttaaaccttttaaaaatttcttttatgaataaatcctttagaaaaacttattccataaatgtgcccattttcttggcaccagggtcattggcgccgagattattgtctcagtgtttatctcctagcaccccatgataaattagttgcttatacgaaggagatcagtgtcaaaagacttattttgaacatttttagaaaaattattttacaaataggttctcggtatccttctcttaagcgtcgatcctctacatctcggcagttaggacgacgaggatgtcaagatataagtgtatcctttttgaaataagtttttcttatacaactattgatgaggacatcctctactattacccgctggcaaagacgtaaaagtcgggtggcgaccatgtgagtctctgaataatcccactttggttagattgggaggaggaaaccaccttaaaagggagagccacccttcctctattggactagttttttagggagattgtgcctttccccgagtgggtgtgactaagaactgttggggtccgggcaactttaagttattgggcctccgccgacgtcttttacttgcttagcttgggaggaggaagccaccttaaaaggtctattggactagtcttttaggcccgagtgagtgtgcctaaaaactgttggggtccggacaagcttaagttattgggcctcggctgaccccacttggactggattattatcaactatttataaaataagttttagaaaaccaaaacataaaaaatccagcgaggtaatatatgtgtgtgtgaggaaatgacttgtgcttttctctactacttaaaaattttaaagtgtttccgctgtccataataaaaataaaaaccagagaaaaaattttcgttcgagattaaaaaaaaaatgcccgtatatgattttcttatctgttgtactcgcgcaaaaaaccagttaacgcacacacgcgctcgctcagagtaggacccgtgtggcatgtatcccgatctcctctctgggccagctgggacatctacccacagccctcaactacaagtctaaaataggtcctccttcgccgacctgagccaaatgggcctgttgcccctgaccacaccacacagcttgtgcaggacgcaattatcagttcatgtgcatgcgtgaatgcggtgaaatgatattctttagatgatttcaaaaataaattattctatattctttctatttttatttttttcataatttaatataaatcttttcacccaatatctcagaccatatggaaattgactcttctttgagtatagtcccgattctccctattcatcaaggttgactctaaatcctcttcttcattcttagtaccttaataccttcttttgacaaatttctttttattcaaatttagtttaaaaacccttaccacttttatgaattatggtctaagaaattctccactattgtcctataacctaaaccaagtgattccaattttattggaattaattgtcgacccatcctttgattcgaaacctatccttaactttcttccaaatccaaattccttcatttcgatctagccactaatttaattcatgtggcttgataccctctttggcacaagaataatatttttagaataattgctcttgtgctaagaaggatatatttttattttccaaattaatctccttttagcctcaaataattttctaaatccatgtcaggtagtttgtggctaaaaatcctatttatttcctctcgctgcctctcttgggccggctaggccgatctgggtcgagagaagaaaagggagttccggcccaatttgaaaagaagatttttagaattttgcagataattaagggatggagtttgaattcaaattaatatttggaaggaatttaggtggctaacttttgaaatgaatctatttttggagataactttcaaaagagatatttcctaaatatttgagtgcaataatgtggtctaaatattaaagcactcaaatgggagggaggcgcacggcgccacagcccagatcaggatacagagcgagaggcgagagccctcgacctcgtagaagggtcgagcagctgtcgcggcgagccccgccaaccataggcacgcgcctatacctacgtgacggttcattggacagtgtcctttcccggcaaaactaggggtgtgactggaactgaactctcaagaaaatgtctctcgttgtttacagtttacatgttacttaaataattatgaaaaattttaagaaaatgtattaatatatgataaattaaataaacatgtaaattcaatttaacttctacatctcgcaactaaaaaaataaaataaattatagttaattcatgtatatttacagttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcggaagccaggactaggaccaaacaacacaggcgcgacttgggaactaggccgaaaccctaaaactcatcgtagctggcttgctcctggaagaactcctcatcaacaggatccgcttcatcttcttcagcaactgagggggggggatatttatatagagcaagggtgagtacgggagtactcagcaagccatgggaattaagtgtttaatgcaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccagccaacaactttcaaacggccacccgggccaacaactttcaaacggccacccgggcctagctgatcccgtcagctactgatttttcaaacatcgaacccctttccacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccagaaagcctaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccgatacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggaggatcaatgcaacaaattaggtatgtccgccaaactgccttgcagacgggacaacagattaagtgcgatcctatcagtgcataatatttttcaagcaacataattaaattttaaatataggatcaagatgttcaaaggtggcttgccttgctcgagatctggagcttgatcctcgaaatcctcgcactacgggtcttcgggctccgaaactacacgcgaaacggggcaactcaataaacggcgaaaataaagccctattaatgacctctaagcgtgccattagatagatctcgagatttgaggaattttggaagttgaacggagtcaaacggatttacggttgggaagatattgaatttctaagtttattggatttttggtctaaaggaaaaggatttaattaaatcctttttggaaaagaaaagaaaagaaaagaaaagagggagggaaaatagacttttctcgggcggctagggcgtggcccaagagaattggggcggtccggccgagctaaatgggccggccggcccaagacggtcgcgcgcgcgggagggaggagagagagcccgtggaccgggctcaccgcgcgcggtcccgggtgggacccgcttgtcagcggctcggctcaccgtgcggagggagtacgtggcgcacgcgcgcgggcgggggagggacgcggtgcacgcgcacggtctgcggaggaacggatgccgctggcccacgcgcagtcttacggttcgcggtggaacacgcgcacgggaggggctgaccggggtcggcccgtcccgacctcggctgggctggcgccgacgtggcgcctacgtggctgccacgtgggctggcgggaggtagacgacgacgccggccggaacggacggcggacaacagcggcgagcggcggagcgaaccacggcgataccggtgaaaacgagcacaccgggtggttgcacgagacgaggggagacgagccaacggctcggattcgccggaggaagcttgacggcggcgaatcgcggcggcggcaaccggcggtgggaaaaggggaaaacggcgacgaggtcacgaggggccgattcccggcggtgagagcatctacgcggccacgggaatccgatgctagcgtcggattgggcggagctacgccgagcgaggctggcgacgagcgggtgctacgaagctcgagcggcgacggcggcgagcacacggcgagcgacggcaacggtcggggcggcgccgactagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccgaagtccccttccgcgtccttgctcgtgccggctcctccggcacgcgcaacgacgaacgacgacggcgaacagagcacgggggcggcggcaatggcgcggaggtgaatgggagaggaagggaaagggggaggctggggtttaaatgggcggcaatgtcggtttgggaaccgacttagggcggtcaaggcgcgagctggcgctcagcgcttgcgtccaaatcggcgacagggcggtgacgccggcgagagggaaaaaggaggaaaaagggggagagataggggggctcgcccctttcttctttgggaaaaggaggagggagcggaggcgtcgcggcagagggaggagggaggctctgcctccgtcccttggaggctagcgcgggagtggcggggccgaggcgatgacgacggcgatgacggcggggcggtttggagcggcgcgacgtcacgggcgacaggcgcgggctggcgcggcagagggtgacggcggcggcgaccaggcggtcggccactcggcacgcgcgcgcgggaaacaacgggcggcgcggctgggcacgcgcgctggctcgcggggccgagcggctgcaggcgcggcagagcagcggggccgggcgacgcggacggcgcagacgacgcggctcgggcggggaaccacgcgggcacgcgcgcgagcgacggcgcgcgggggccgtcttcgcgagcggggagctcgccagggagaggagaaggagagcgaggggaagggacactcggcgcggcgcttgcgcacgcgcgggcagagcgaggggaaagggaggggcgctcggcgcggcgctcgcgcacacgcgcgcgcggtgcgctggcggggcggaggggagcggagggagagggggagagggagcgcgccgggggaggggagagggccgggggagagagagagagagagagagagagagagggagagcgggagcgcgccgggggagaggagagggccgggggagaggggaagatgggccgagagaaattcggcccatcgacccggggggaggcaaaatagacttttgcggaggaattgatttgggaagggtttggattcggaattgaactcgacgatagatcggggattgagatcttgagatggcacggacactagacgacaagcgaagaaacaaatttcgcaattagggtttttagagataattttcccgctaggcgccacgacggaacgggcgctacaacagtccaaattattttttctgtgaaacttgcatgtttgcgaagtgatacatcacatattaatataccttaatttttttggcatgggtctgggttccggtcatcaactcgaacggtcaatgttggctagatacctgcatcgttatacgtcacaagttggggtggttgaacaggaaaaacaacaaggcaggcgataagtttttctttctagttagtaataaagaacttttggggtgaaatccgtagatctacgaaggaacgccaaaagcgaaggcagctctctgggtccctaccgacgctggggtgcacggagaaataaagaagtgtggaggagaaacagccgagctcattcccttcgcttcctgggccttcgtgcgtggcgtgagttggaatcctagaaaagatcgattgagactctctccccggttccacgaagatctctacgtacttgtctagtccaggacaactgggatgattgagcaccagtgatttcgtatccggtcaaaatcttagcagccaaagcttcctgtcggaaaacaggtacgattcactagaataccctaattatttgagtggcataaaaacaacaagtggtactttcaagagttcaaaatccactctaggacataggaggaatcaccatggagattttttcatataaactgttcattggataagacggtcagctgccatctacgacatgaaatgataaatgaagaaagaggagggtgtgtttagttcacattaaaattggaagtttagttgaaattggaacgatgtgatggaaaagttagaaatttgtgtgtgtagaaaagttttgatgtgatggaaaagttggaagtttgaaaaaaaaagtttggaactaaataagggccaagttcaaatgggcacaaaatatccaaaatatgataaaacgtgctaatatttaagctagaaaccttaagtagcaaacagttagcgggtgatttgattttgatctatacttcaaaacgaagcatcgaatccactcgttgaagtagattgaatctatacgtacagcgcgatttatttttattttattttaacgaactcggttttatttgtcccccgattattcgcaccgactctgtttctgttgcattcgatctcccgcgggccgttgccgcgaagctaggtctctaggaagagatcgccggcgattcgcgatggttccgtggcgccgctcctcctcctcctcttccgccccttcctcgcggcccgcgcggcgtcccgcccgcaccaatgcgagggtctccccagacgtctcgtcggaattgtcgccgttggcgggggaggagggggcaggcgaggagaggtggtcggcgttggtgcccgaccttctggcagatatcctgcggtgcgtggaggccggctcagagaggtggccgccccggcgcgacgtggtggcctgcgccagcgtctgccgccggtggcgcgacgtcgccgtcgccgtcgtgcagccgccgctcgagtccgggaagatcacgttcccctcctcattgaagcaggtgacgaccgatcaataccctaacttcaacctgtattggattgccgtctcgttaaacttggtggatgcatagacaatggtccgttacttttgattcctgaactcgggaatccatgcttctcccattgaccccatccaatggatcctaaatccctaatgcattagttctactataactcaatatgagtaattggatggtattttgtctattaattctcaaataatctaagaatttttttactttgtaccttggggagcaaaaggtcagtttctctggacagcatgagtaaagcagcttccagcttgtgtgttccaatttatcagaggatcggttaaaacctcaatctttcatcattcaaatgtaaagtgcatacggtctctctttttaatatctatttatttagttgtttgctatgttcagtttgggaaactattgttgctattctgataagatgtatatttataccaatgctatcgctgcagcctggaccaagggacgcaccaatgcagtgtttcatcaagaggaacaagaaaaactctacctttttcctatatcttggattaacacaaggtaagcctgcatgcagttttgttatctcttacttaaacactatgcagaaaatattaactcttggccatgtttttgctctatctttgacaaatgatgccacaatggttataatttttgaaaagaaaatgttagtagatcttgtttcagaagaaaggatgtaatgttttattttctttactgtgatcattggcgaaggtgtcatgcatctatgctgaaggttatttgtgttcgaataagaatgacaaggaaactttctattccctgaggcttttagactgaactgaaatacagtgagggttacgaagactctgctttaacaaccttttagtgttatggaccgtttcagggaggagtttcatacctgcatgtttatgttttacaatggccatcatggtgagatagttacaaatggacattttgttctgacgcttgaataaattgacatgcattgttgtgtaaactgtattatctttttttcacgtccaatttctttatgggtggttttcctgttctagcagaactaacagatgatgagaaatttctgttggcggctcggaggtgcaggcgtgggttgcataaggaatatgccatcaccattaactctgatggtctcttccatggaagccagtcatgcgttggaaatctaaagtgaggcctagccgctagtaattcagtaacttctattctcaatttttttggtcaattttatattgcaaataaattgataacaattttcctgggaattccacgatgctaataatgacttcgcaatttttgtatttaggtctaatttcacgggaacaaagttcaccattcgtgattggcaaccaccatatgaaggtgctaaggcgttcagcagcagatccggtcgctggtttggaaacaaacacagatgcccactggtttccacgggtgatgtagaagttggagaggtatcctataaatacagtttactcagaccaagaggtccaagaagaatgagctgcagtgttcagtgtcccgtcctcaagggtactgcagtagatccacaagacggaaaacgacttagcaatagcatccctagttcattggttctgaacagtaaagtaccaagttggcatgagcatcttcagtgctggtgcttgaattttcacggccgggttatggttgcatctgtgaagaacttccagcttattgctccagtcgaaccaggggagccgtcggataagacagtagtactgcagtttggaaaaattgacgatgacgtttttacaatggactaccggcagcctctgtcggcattccaggcatttgctatctgcctctccaactttggcacaaagcttgcttaactttggcacaaagcttgcttaactttggcacaaagcttgcttgtgaataggtagctccatgcacttattattgttgtagtatgattttattgttttcgttaccagtaacagaatttatttataatactggctaggaggatgtctaaaatgaggctaacatcctacattacagtctttgttgcccattctgaccattttgttctcgtctctagccatgtcgtctaacaactccgacaagagatatagcttgtgcatggttacgggagttcatcagcactttggagctaatgcggtcaagatcgttgatgtgctgaaaagaatagtttgagtagtccagagtgaaaagatgggataaagggttttcaaagtgaaacaggccgaaagtgtaattctatatgtgaggtgttgccgtatcatgtcataatgcaacgttgtgcttgtgtgtttgggatcctattaaatctgtatatgtatccaggatgaggaagacttgtaaatctgcagtcctcagtgtagtcatgtatgactgcagaatctttaggtgcgataagactgttactacaatcttctgagtggcattctatagactgtagagtggaacatttccttttcgccaatgacagatatatagtttgtgcctaatggatatcgactcatcaagaagccatttccttttagtgccaatacacttatacacgtcatggggttcaaatagttaatcttcccaattcgcagcatagaacgttcagagaaccaaaactttctgacaaaagaaaaacgaccttcagattagcaaagctttctgaacaaaagacgactctcttccggagggaaattagctgttaaataggctactgggtccttgtacaccgatcactgatgaggacacatctccatttctgcgctttgcggaacatcctcgcagtgaatatcttcatcgcacatgccagcattgtcagaatccgtctgcatctcgtataacagaaacaaacattcagcaatgcgatatggttaacactaaacactggcgcggaagacatgtttacctgcaaagccgtggtccggccggcgctccagcccagcagccggccgacggcgtccgcgaacgcccggtgcgccatcctcctcccggcccgggcgaccgatccggcgtgctgcacgagcgccgcgcagccggcgaacctctttgcccgccctggcgccgatcccctcgcacacgaggcacaggaaccggcccttctcccgctccgcctcgtagaaccccctcaggcccgcgtccttctccagtagctcctggaagaaccgggccacattgccttcctcctcttcctcatcctcgtcgtcgccgtcgtcgtggtcgacgtgctcaccgaagaaggcgcggcaagcctccacggcggcggcctgcggggacacggccgccggcaccggcggctcccgagggggttccgccgccggcgggccccagccacagccccaggacgcggagggctcgggttccgggggcgggtcgcacacccacggcttgtccggtagcgcggcgcgggatggggaggccgcagcggcggcggggcggggcggggcgccgaggggctcccaccgctcgagatcgagggcgaggcgctcctgctgctttcgctccttgcgcttgcggcgctcctcgcgcttgaaggccgtcgacttgcccggccggaggagtggctggcggcggctagggtttggagcgagggaggcgtcgacgcggtggggctcggggtccatggccgtcgcgccgcgatgccgcctgccgcctgcggctgcgggtgtcgctgcttacgccttacgggccaagtggacaacctgggcctcggcctttttcccatgggggaccaaatcgagcgaagcgtggagagcgtggtcgagttcgggacagtgtcactgcttcgatgttgtggagctatcagatgttctgttcttgaaacgtgacagaacggatgtgtcaactcctgcgtatgcacgccctgtcacgtcatttaggatacacattttgcttggctatgcaacaactaaacgttggcacatgagctcacctaataaagaaactttactcgaaactatatagattgaacatcgaaaaacgaaaggcacgaccgtgcaacaaaagaacaacgggtaataatatggcagcactgagttccaatggtgcaatgtgtagaaaaggctagcaacagcagaaaatcaacatcattgcgtccttgacaacatgaatttaggtaaatctcaccatagatcattggatgggcgttgatacattcaccatttcaaacacttgcattatcatctattgttagttacattgaaaatgacttgtaattgtattttttttatttctttttatgtttgaactcgacaagattcacacatactgctccattgtgtctcataattcattattatttttgtccatcgtccattaatattataccaacgccatcccttgttgcacttacaccaccaactacgattttcggttcagttgcgttctctctaattatagatggaggagatgttcacgttgcttttctcttttaaaaaaaggaagttcaaagttaaagaaaaatgtcacataataggctatttcatatgttattatgccagatttgccagtataccatttcatcattaggcattcatatgttgcactatatcatttctagcaaacatgtttcaatgcacaagccataccgttgaaaattctaaccctattttctatatcccgttcgattttttattttaaaaatagcttggttcctttaatattttatcataattaacctgtttgtttgtgtcggtgatatgggcccggggtatcaggtttagagggaggaggctgccccccgatgccacgtggccctcccccgaggggagtcaggcctgaggtaggacggtggccactccttcccagagactggatggaggaggctgctctccaatgccacgtggccctcccccgaggggggtcgtgcccgaggtagggcggcggccactccctggccgagactagagggagaaggccgccccagacgccacgtggctcccacccaaggggggatcgggcccgaggtcgggcggcggccgccccctcccgtgactaggggtcgggctcccccgaccccctctctaggtcaccacgtacggtgggttaggtgtccgtcttcaggtgcccatctacccgcatttatggcgtcccgagcggttgcgccacgccgcatttaatgtggcgtgcagtgcactcaaccggtctgtgaccggtcaaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcaccccccgtgtcaggcggcaagatttgatgggccccatcatcaagacgacgtgtgcttggcttcccaagttaagagacaagacatgtatttaatgcaaagattatcatacttctccactggagctaggttaggttgttgggcccatgtggtaaccccttgaggtataaaaggaggtccaggcctagtgatggaggggggaacttccgagcgaactcgcgcttggtgatggagggggggaacttccgagcgaactcgcgcttgggtctcgcaaccccaagcactggtgttctacattcaatcaatcctgcacaggagtagggtattacgcttcatagcggcccgaacctgtataaacctctttggtctgatcgtcttggaggggcctaaccccctcaagaccacacagtttcgctcaccaaatcctcgaatctcacccgctgcccccggttccctggtggaggagttcattctccgacagtttgttttttttttgttgagaattcacccctatgaacacacgcacgcaaagcacaacgccattaaatcctgaaaaattcgctcccacggagagtcgaacctaggatctaaggtgctactgagcctcttataaccactaagctacatgccctttcgcaattaacttgtttgtctgactaaacatcactctctcaaactacttcccaaaacgttttttgcagttggcggagcaagaaattatcaaagccaaaggctaagtagggctcaactaatggagtattttcctcgaaaaattacatggtgaattaagagaatttaagcatgattatggaggcaagcctagggctcaacccaagcagccctaggctttgcttgtgcccctggcggcaactactcatttctgctcactctcttctgcttcaacttcctccgtcccaaaaaatcagagattgtttggggcatatcagagattcagagctgttcgaaccgaactgaactttatatctgtttatgaaagaaaaaataagcatgcagggacattgaaattcaaattactttgatgattttacctactcctacttgtctggacatgtaaactgaagttcagaatagttcacttaatacacttaaattgtaggcttgctaatggagcatgatcttcccgaactgccaaaggccatctcacttggcaatatctcctaaaaggccagttgtacaggattgttaaatggatgataagagtatcgcaaatggcaaaacatgatgtgccattattagcgagtagaacacgttgcatccgtctactgtgcagtcaggatgaagtgcagaaaatatctatcactaactaaaatagcactagtagtgtcctaaggtgaaccgcacatattcagagcagtagatgactaccatctaatattatgcccagtgccatggctactctaatccctgaaatcagatacacaagtatgcaccctgtcaggaccaaatgagtgacgatgattagcatttgaatcactttggtgaacaggtgtgcattccacctgtagttcccccttttcaacaagagggcatcttggtccagatcgtgtgtcaagcatctaggttgcttcgttcatccgaggataccacttactacaacacctcgaaagcttgacaggttttcaagcttcctgctaaatgctaatgatatagtagtatgatcaatgcgaaagagtcacgagcaacgtggcaaatggaatagccggcattccggcaacaatgtaccaaataaaactgctgtctatcatggcatggcaatctgtacatgaaccagacaagacaaatgagagtattactggaatcacatgagaaaaagctcagggaggatatacatttgagctgacatgagaaaaaggcatggaagcctgacttcttgtgccattttattctatgatacatgcaattacatttgatgatcaactcaaccttttatggactaaagagtactacatgatgtatggactgtaaggaagcaaacagaagctatgctgtatagatatgtgatttacaacagatttaagccaacgccaacttaccttgagttcacagagtacgcaaatatggcatgcacaacgacaattacctatgtactggtatacaaaaaagctgctaatagccaagattgcgacagcaaactgaggggggcatccagggaaaatttgggcgctggcagatacatggccgtgctgtccttcaaggcattatgaacagatattggtcttgagggaagacatcatatctcagcatccaatgaattaggcctttctaccacctaaaacaagcagccaaaatgaatgttcagcaatggctctgtgacaattggaaatataagcaaaacagaagaaaaataagtattacatctgcaaatcttatctgtcgtggcctaggaggtttaacattattctcctttggctgaattgaggcccagggagtttgtttcttcgactgcaattgaattccaagaaaagatggcactggtggtttgcttgttacggatggtaaagtgcgagaaagccaagattctgaaggtgatcttgggactggtaatgggagtagagattgcaaaggcatatcccttttggaaacactactatcttccagatgaccagaagttttcccatcatccaaattcactgatcttaacttttcagaaggtgctaacaacgtgcattctgtaacttcagagaccctttctgtcaatggatcattatcttcacctttcccaatagggtttttcccgacaatctgttctccaagctgagagccacacccaccagcatccagtgatgtccttgaatccagtaacagaaccgagtggctagtttctgagtcaatatctccacggtgatccattgattctacatgcactggtctatccagccctgagctaatggagcttgacccctttaaactactgcggtctgatccaagcaatgaaccacgatcatggtctcttccaagtgagctggaaccattactactactcattttgtcttcttttacccctgttccaaaagactcatctgccttactcgatgatgacaggacaacatccctgtaatagggagacataccaccacctgcggaatgatggaatggtgaagacccattgcccgcctgcgagtcactccagaacgtcagctggtttgattcacttgtcagcttgctcctcccatcctctcctggacgaacatacttctgctctaatttgtgcttgtatacatcctcccaggactgctgcaacacaatatacagtgagatgttactcatccctagcactaataacaagtagcataaattctgaactcatgaaatggactgtgtaacatgtatctgcatcagtaccccgttggaagcacacccaagatgcttgttttgtgagctccgggcaagcggactcggcgcccctcgtcccctgcctttggatgcgaactcccggactctcccattcccccgcggcttgccacgcttcatcgcaggcattggattcagaagtaacaatgaacccttcacacagagactagggagcaagccacatcccttggaggcaaaaccccgggtgctatgcacatcatagtcatcgtcgtcgtcttcatcttcctgctcctcacgtctgggatagctgcaagacaaataattgggaggcaaatgctggtaggggagctggacgggcgtcctcctcccgggatcatcgccactgcttccactcgcgttagacccagctgcacgcgcaagctcgcggccagaattgctcgtggcgctggctgccccggccttccggaaggtgtactgcggggagcctatggccaccgcctgcgcagccgggaggaatctatccatcatgatgccgcgtacgcctgcctcggcgccggcggcggcacgggaggtgggctctggcatgccgctgaggccgctgacgctgcagttcacggtgaaggactccgtcctggagagcgtgtcgagcgcgtccgagaacctctcctcatcgtcgtcgtcgtcatctcccttccgcagtaccgccgccacggacaccacctgcttctccgtcacttccttcttcgcctgtaacaccgccgcctccgccacctgcgccctcttctcatcacgcgccggcgccggcgccggagcgccagtccgggaacaggcgggggacgcgtccacgccatggagtatccccacatagtgctccccgagggcgtcgtggtatgggctcccgtcgatctcatcctccacgccgtgctccagcggctgaggatgggacgcggtcgtgggcgacggcggcgcgcggcgggtgcggacgctctttggctgcccgggccgctgctcccagacgaagggcaccgcgccggggtggcggacggggccggagttgaggtcggccttgtggtagggcagcgcgtcggcgtggcgcaccgaccggagcggcgcccccaggtcgatccgcttgcccccctccgccatcagacgatccgctcgcatcgctcacaaactacacagcgaagaggaggcgaagcagggggggacgaattcgtccgattgcttcggccgccgcggacgggagataggatctgcggcacggcgtgtggatggcggcgggcgaacactagaaaaggagaacgcactgcggtttcggtgcggtgcgagcttacttgctctactcgcggcggtcgtggggcaaacagatcagccgccagcgaagccgcctcctccactccactatagcgagtgcgagcgcgagtgcggagtgactcggcggggcgcggtgcggggggtggcggtgctcgcgcgtgaccgcgtgagtgtgcgatgttattgctacgcgtgcgacgagggacggtgacctgggggcgcgggcgggcgggtgacgactaaaaattgtagactttctgcgcgatctgcctaaaaagttgatgcgagcatggcagggggcagctacgagtatttttctactactaccatcactgtggctgccggaacatgcacggggacgggggccagggctgagctgcctcggtgcgaagcccgtggcattactgcgacggacatggacgtggccagatccgcgttcacgcttggcaggtggcggagttggcagaaactggttgccatcttggatgcctgcgtgtgaattggtcaattgggttagatctcgttttgtttggtcagttgtagcaaggaactagattcggttgggatcctgtttactataagagcaaggtcaatagtacagccagctgcttactccaattttgatccatcgcagctataggtaacattgtagccagtaaacacaataatcaagctatactactatggctcacacagtacaagaaattttattttaatctcccttctatccgcactctctctctctcctaatcccctgttctcgccggcgattgcttcttaggaactaggcatccaagctcatccatggccaaaaagatgaacaaatttatggctatatacacatccgttttgtactatacatctgctcatctacatggaaggaatcggtacaaaacaatatatacacatacgtatgctactacttcgcttaagctatctgatttttctagagaaagatgttattctattttctccatcagaaaatataaacagctcatcgtgcaggctcacgctgcccgtgtagctggggatagagcaaacgggtcaccggagccgagctcgtcgtccggcgactagcgttgagctagccttctgcacgcggaacggtggaagatagaagtgaagcaaccgggcaaaccatcaagctgattcataagcacaagacctcagaactcaatccaagctttgtgctctcttggtctctctcttctacttgctctccatggccacggtagacgagagccgcaacatcgaccgacgagggcaagggcaacgacacgatggtggcagccgtggccgaggcggacgaagttggcggcgacagctgcagtggacaaggtcggcggcagcggcatacagaggcgacgagcatggttgacaaggacgagggtagcggtggtcgtagtggacaaaggcggcagcggcggcggacgcggacgtgcgcgacgatggcggcgcggccctggacttggacgctccgacgcatgcaacggcgagtagcacgggtgcatcgcttgctacgggcgggcccacgtcctcgagccatgcgtacagccgggcgactaattagtcgcccgcttgcgccctctcccctccagctcagcagaaaatcctacatggatctcctatcgcctattattgtacgacccgataataattggtttgttggttgtggattgattcatgtttgtaattaatttagcctttaaatttcaaatcaatctagcatagaatgatgatgtgtactgctaatccgtcaggcaaacgcatagtcgttctactgctaaaatcatgccttgtttagtttcatcaatataaaaaaaacggtgtttcgtcgctgaatcaatatttctactaacatttaaaaagtttcgcaacatggacaaaccaactacattaattattaagttccaacaacttaaacattaaaaaaattataaaatcaaaacttaccatgtgcaagggagaaaacattgattttttaagataatgaaaagaatcttggtctttacatcaaagaagctacaaccgaagaaaaaaaaacagtgataggggttcataatgtcaattaccagaattactccttagcggttttctctattttctcaaaaaaaaaacactcatatccgactaaaaacgatgaaatttgaataggttttataaaaaactgaaattcaatgttatttttagtttaactgatgtaccgagtagtttgtcagttcgaacagggttgaaatctcaaaatttggcagaaaaacgaccggtttttcttcttttttttttagggaacgaccggtttttgttggttttatagtgtctggccctggacgcacatggtgatatattctatgatagtggtgatgagttaccgcgtcagtgtgaggaagaaacagtattgacatggtgagttacttggctactgcatgtaagactgttacttcaaaccataggaagacaaaactgcttgttctgtttgggattactccctccgatacaaaatagaatttaaattttgttcaaaaatgcttgttaactttgaagcattttttgtcacgtcaattatttctaatttaaatttttctcggtcatgtctctaactaccttttcactctcatccagatagtatttaataggggtacaataatcatttctcgtaaaccttaaattttacaaataacctggaacaacaataattctataacagatattgtactacttgtcaaaactcaactcgatacgccatgtaggactgtccgccgcatcaggaaaatggctgtcatggcactgtttctaacctacaacggcctaactatacgctggtaggtactgcgtcgcaacatttttcgttatcgcctagtatgagtagatacaatgtcatcttcgtcattttcatcagcacgtgcaggtcacttcagagcaaaacccctttcattgacagcatggagtgaggattgaggaccaagggtgacgagcgcgatgaattttgtggcgatcgatcgacgacactaccgagctaggggtggagaaattaataaagaatcagaatttagaaatgcccattagtccattacgttgtacatcaaggtgcatgtggttcgtttgaaaaatgaaaatcgcgctggacaagacgaggcgttgtggatcgatcgcttgaatcgtcgacgactccggcctaagcaaccagatgaaaagtggtgcgttcaataggctgttgactaataaccagtagttgactaaaaaaaaaagagaaaccaaatgcatctctccctcatccatcggttgcacagctggaggcttgcagcatattaataccgagactgtctatatatttaccgataaattatttttttcaaatataattatagtgtaattatattgtatatgatatttttttgaacgatacggtatatgatatataattacagtataatatacgtgtaactacgctataacgggatgtaattttgaaaaaatcgcgttagcacgcaacgataatactaacacgctgctcgcacggagcaaagtatgtgggatctgtctctcacacgttaaggtggagttattattcaatcactctgttgagaacaagcccgcaagatcgttgcctcctgaatctgccgccaaagcatgagccattggccaattgcacgttgcatctgtcgcctgcgaacgtcaaacaaacagaatcacgtatccggaggttaatccaacggttaacaaaatcgataaatttcgaggaggaaatttgtcgacacacatctatcgaaaccgatcggcaacacgcgtcacctgtgttcatgcccggcggttcactcgagcggcattgcaattgcagcaagctagcccggcaggaaaaggaccaggcacaccttgcatgagtgccccgcgggtcaccgcggtctcgcccatgtgtgacggtgtgactgtgtgagccgatcgattcggcacgtacgtacgctgtacgcccgcgcgcacgggacgggagaaggaccatgaggagatcgaccgaccgaggtatcgtgcgcttgaatcaaccggcaaccattcgttcgctcgttaaacctgtcgggccacgcggtcccggccgccgggcgccgtccaccaccacgcatgcatcccgttcccgtcccggcgtcccgcccccgccccgtgagcccacccactgtccgttccacctctcgtcgcagcgccggacgcctccgtcttctgttctactgccaggtctgggttcttcttcagcagtgtccggtagtttcggttgccccaccgtcgggtacgtacgtctgtgagttgtcatgggaataaacagctctgcgcctagtctgcctagtggtgcaccggtactactggtaccacacggagagagagagagagagagagagagaatttactctgcttttctcaaggagcacggaccgggcgaaaccgatccgtgcatgcgaagtgtgaactcctcccccgagttcaagtcaccctgtatttttatcctcaagtcaccgtgtatttcaccggggcgaaaccgatccgtcgatccgtgcgtgtgaactctcctcttttgaagtcatcgtgtacgctacatcacggtcgttgtacaaaacgtagtctttctacaaggagtttgctcgagtttcacgagagggaaaagaaattggtcgacatgcttcgttttttgccttgattatcaggtactgttcgtgttccctgatctcgaggaagaaagttttatgataccccctgtctcttaggttcgaagcaatatgaggcccggcgactgttggggctctagatctctccagcctgtgatcatgctgcaattaaaagggtcatagactcttccttgtcacgaaataagtatttcattttcctttttttttcctaacttttgtttgcagacgccgcatgtgccaacttagcaaatactacttcctcgacccaatgtagtagtctgtagtactacttcctcgacccaatgttgtttaggccctgtttagtacctaaatttttttctcaaaaacattacatcgaatctttgatacatgtatgaaacattaaatatagataaataaaaaactaattatacagttatggaggaaatcgagagacgaatcttttgagcctaattagttcatgattagccataaatgctacagtaaactacatgtactaatgatgaattaattaagcttaaaagattcgtctcatggtttacaggcgagttatgaaattagtttttttattcgtgtccaaaaagcctttccgacatccgatcaaatatctgatgtgacacctaaaaattttcttttcacgaattaaacaagccctaattgtatcagacaacaaattcattactaaatcactaaccaattttgcgttgtacaatgtcatttaaaagtgacaggaacatgcccattcagatttcttgtacttgaacctgcctattcgggtttaagtccctgactcgagacgtgtgtgtttgatattctctcagtgaaaagcgatacagtgtcgacataaaggtgttttcactatcttaagacatgccaatctatgtcttatatgaatagagcatgagtgcgtgcgtgcaaggaaacagatgacatgatccatgatgcattgtatcagcccatatggaataagtgtactatgtctccctcaatttatgccctggttgaattggatccctcaaccgcaaaattgggtatagcccgtcctccaactcataaaaccattgcaaatcaactcttcggatggtttgagagacggtttcgtccgacgtggcatccttaaccccttgactagctgaggcagcacatgggccccaatgttagtgccttgtagtacccaaagtctactttacctcccctgcattcttccttctccagccgatctcctgttcgtgcctatgcactgtagtgccgcctctccttccaaattagttgcagaaatcgattcctctcgatctcctatcctttcccccaccaagaaaaccccatcaatattcgtgttaaatcctgcgaatttggttcgttcttatcctaacaaactcaagattaagcctagtttcctatcgtcaaatcccgtttctagcctggtctccctctcctccacctatgtatagcttgcccaaggtctctcttccaattccaacaaccctagtccaagttcttcccatgccctagctgccttcctgcgcttgctctctcttcgccgaaggccaccgctccagtcgagccgcgtcgccacatccgtcgttgcctaaggtggctatcgccaccgtcgggtttgcaagacgaaggagaagcttggctgcaccttcgcttcgcttggacatcgccgaaacaccgccgtcgacatcaacccgagggcactgccttttcaagctcgctgtcggccagcggccactcttgtcgccgctcgtcatcgtaattgcgtcgataaggatcgtcgtattcccctcttctcacatgtgccctcgattttctccaccgcacccttgttcactgtcgcgccatggccaccgccgcgcaccaccaccgcctttacaaggcatttacatatggggtccacgtgctgacttagcaagtcaacggagtcacatgccacatcggacataattgtcccccaaaccgtccgacgagttgatttgcaatggttttatgagttggaggatagattatacacggttttgcggttgagggacacgacttaaacaagggcatgagttaaggtagtaaaaatagacttatttcattccttatagctaaatacacctatgtctgtcggcctcaagcccacaacgagtaatacctactgccacgtctttaaataggccaggccgtctttcattttcagcccagaatctgggtcacgaatctagtttggccctgatacttcaactcgactgaaaaggaataagttcatctgaggtcccttaacttatcagcgaatccgattttcgtccttcaactagaaaaccagatacaacaagtccctcaactgtcaaaatcggtgcagattatacccctcggcggtttggacggctgttttgactgacgtggcgcctacgtggctaatttgacttggtctttgtctgatgtggcgttgacgtggcgcttacgtggcaatttgatccggaaaaataaaaaactcttcggacgtatgtcagtttcacatagaaattaattaaaaaatattggggcccacatgggccccacctgtcatcctcagccctcatcttcttcctcctctctgcttcgctcgccgctctcctctacttctaccgcgcgctcccttgcacgccaccaaccatccatcgcttccaaaaacccaattgaattcaaccgcactgcgccaacaacgcgcgcgcgcgagagcgagcataacacgaacggaaaccagccatgaagcggtagcggtgacatactgacattagcttgggtggagcgtgcgaggagcacgaggcggtggtgagggagctgacgcgcaggcacgagctgacgacgtgattgcgggcaggggcaggggcaggtcgaggccaccgccacattcatcctcggggaggtctcccgtgccttcatcatctgcctctccatcatggccagcgcctccccgtctacctcgccgccgcggctagatgagacgccgccgccggccgactcggccgtctccgtgggcgcctcgccgccaccactaccaccacgcgcggcaagagaggacaacgtcccgcgaaagtgagttcttcgcacgtgctgtactactggaagcaaaaataaatgccgcagaatgtcacggtctcacgtctcaccgcaacagattcaagcgaggtagagagaaagagagagagttggagaagacttggagaggaggaagaagaagaagaacagagaggagagcagaaaagaacaagcagagagattggaattagattgaattgtattgtttacatgattcgatccccttttctctctaacctgccggcttatatagtaatgcactaacaagcctctctccctgacagtggcccagcctctatctactgggtccacacactcttaggaaaacggatactgggttgtgcctcacgcttggatcgcctaacaggctgggccgctgcagtttgatttgaatccagcttcagagaacttgccgccgtgacattccctccaccttgagacgaagcttgtccccaagcttcagattgaggaaaacgaagacgcagctcttgagcattctcccatgtgacaacatgaggatcatcccttgactgaatcctgggcaaagaaggatacagtgattcactgggcgccaaagctttcttgagttgggaaacatggatgacaggatgaatcagactagtggccggcaaagccaatttataagccacttctccaactttggccagaaccaggcatgttctggaacaggtaatggttgtaacattccagggtatttgacatgttctgactttgcttgctgacagatagaacaagaattcacaaactgcatcacagtagaacgtaagtgaggccaagcaaacaactgtttaacccgttgataagtgacatgtataccagaatgaccccctactggtgcagtgtgaaggttggccaaaatcttttgttgaacctgaacattgttaccaatccacattatgttcttaaagtaaagaacaccatccttcagagtgaagtctggaacagcagctggactaatacacaatgtttgaaccttactagaagcctcaggatcagacatatagccatcaaccacctcttgaatccagttaggaataactgaggatatagcagtaagttcaaacactttatcagcagatggacagcgcgataaagcatcagcagctccattttcagtgcctttcttgtaaatgattttataccgcaagccaagcagtttagttaacgctttatgttgccacggagtagtgagtcgttgatcatccaaaaaagatagactgcgatgatctgttctgataaaaaactctgcatgggcgccaatgatccacagctaacatgatagccaagctttctttctcataagtagacaacccttgatggcggggacccaaagctctactcaaaaaggcaacaggatgatttttctgcattaatactgctccaatccctttatcagaggcatctgtttctacaataaaaggttcattgaaatctggcatcgataatactggagcagtgattaaggcatgcttcagagcttgaaaagcctgttcagtttcagcagtccaaatgtacagttggcccttcctcaacagattagttaatggtttactgagaagtccataatgtcgcacaaatttctggtaataaccagctaaacccagaaaaccacgtaactccttaacagaggtaggggtaggccaattgctgacagcctgaattttatcttcatcagtcgaaactccattaggactcataatgtgacccaagtaagccaatctttgttgagcaaaggagcatttgctcttcttgactttgagctgatgtgtagtcaagatctgcaagactatctgaagatgcttgacatgctcaggaagagtcttgctataaatcaaaatatcatcaacaaaaacaagaacaaatcttctcaacaaaggagacagaatgctgttcatgcaactctgaaatgtggctggtgcactagtgagaccaaagggcatgactctgaattcaaaatggccatgatgagttttaaacgctgttttgtgttcatcaactgactgcattcgaatctgatgatacccagctcggagatcaagtttggtaaaccactgagctcgtgacaactcatcaagtaactcatcaataatggaaaagaatttttgtccttatagtaaaaccattaatatgtgggtattcgcaccaaaaaggcagtgtaccatccttttttttcactaccaaacctggtgatgaaaaagactagacctaggctaaattattccttttgttaacatctctttaacctgcatttcaatctcatccttttgggcaggtgtataccgatatggtctgacattcactggcattgctccaggaagaagaggaattgcatgatcaaacattcttgaaggaggtaatccagaaggatcctcaaatacatgggcaaattgagaaagcacttgttgaacgacagaaggaatggattcctgttctgaagtttcagagacagcacataactgaatgaggtgagagattgcttgtctgtccttcaacttctgaaactgctgagaagaaagccgtgcacattgctcaatttctgacacaattccttgtaatgtcacagattgatttttccaagaaattgtcaaagttttctttacccaatccacttgcataggactatgatgcattaaccaatccattcctaatatcatgtcatagcttcccaaattgaggaccttaaaattagtgcagaagacccatccctgagttatccattcacaattaggcacataagccaaacaagagaggattgaaccattggccactttcaccatagttttagcagttaaaggaaatacaccatcaattgcctgagccacatgagcactgataaaactagctgtaatgccagaatcaatacctcctttccttgtatatatcccaacatgcgcatacatcccacagattcagaaccatgcaaagcctgaactgatattgccattaacccttgactgtctacagcttcagtgccatcaacagaaacttgatctgacattgaatcaagctgcaatgtcgaaattaattcctgaactgcatgcaattgcactgtattagcacacttatgagtgggagaccatttctctgcacagatataacacaatccttgagctctgcgttaagcttcagaacagaaattttgtcagaactgtttccaatcttagaattattagcagctttgcgctcttctgttcgcatcatactgccaccagataacccacgattaggcggcaagggcaaggtcaaagcactcttgtaagcaggatttggtcggaactgcaacccagagtcactcttttttagatttgaagctgacaccgtagcagattccataattacttcctcttgcaaagaagcaattgccaatgttgtctccaaatctttgggctgttgaataagtactgcattcataatctcccgaagcaatccctcagtaaaacgatgagttagatatctcatattcaaatctgggtcataagctaaaagttgattcatcaactcatcaaacttttcataatactcccaaaccgagcccaattgtttaatgctgtccatttgtctaataagtgtttcatgcttgtctctatcaaacttagcagacactgctacacaaaaattctcccaaattggaaacctaacatgagccttagaggaacgcaaccaagatactgctcttcctgagaagtaaatggttgctattctaacccaaagccctgggaaagtgttattcacatcaaaataatgctcacatctcattctccaatccacaggatctgaaccatcaaacttagggaaatctaatttaggaaccctatggttatactggcgcccaaactgatccccatcacaatccccattcccgaactcaaattgctcaaaatttttcagagatgtggaaggagattcatacgtacccttgaccggagtcgggcccagggtggttgccactcccagtgcccttccccggtgttcatgaacttgtaggcggccactggccatcttgcttccgccttcagccgcagcagccgcttgagatggaatcggcggcgtaggcagcaacggcgccttcctttcctcgtctgtcaacggaactcgaggggaagacgtcgttgaagaagtttggttcaacttgttgacaagatccagttgttggtgaagttcgccgactgactccatctgtggcctccagtgactcacgccttggt

SEQ ID NO: 58506 - DNA, 19017 bp, Oryza sativa
ggagggcggcagggtctacttctgtaaatattttcaccggtacaatatttctataaatattaaaaataaaaaatttaaaatgaaaaaaattctcacatgcgcgcgatttgttgcttcatcatgtgggttttgttgggccagagccagcagcccgtcttgggtggagaaaaaaaagcccacaacgttttgtcctctgtaaataaaagcccacagtcctagaaaagttgtgactttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgctctctggtggggcggcaaggggcccgaatgcaaaaaagccagtcggggccggctattttgcaggcagccccttgccgccctctagccgggtggcaggcctcgctgcctataaaaggcctgctgcccagcccccagccctcattcttctctcctcaattccagtgaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttttactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggattgttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggtgagggaccaagtgctgaagtaaacgagacttctgtggaggaggtcaacgcacgagaggacgggggcgtagtagctctagtgggcattcaaccaggtggagtggccgacgagggggagactgtcggtgccattgtggataaaatggagagggaggattctgacaacgagcgtgtagaggaaggtgattcgtcagatgatgagacggatattaatccagaagaatgggctagtgaggatttttctgggctgatcgtctctgaagaggatagtgtgagatgggagtacaaagaaaatgaggttattcagggagcgatttatagtaaagcagaagatatgaaggaggcggtaaaacattttgcagtgtcacttcatagagagttttgggttgccaagtcgaaccggtcgcaatatgaagttcggtgtgttaaggaaaaagatggttgtccctgaagagtgcacgcgtataaggggaaatggaaggattattggatagtgtcagttgttaccaagcatacatgttttctacctggtgttcagaaataccacaggaacattacatgtgcatttgttgcatctgagatgtatgcgcatgtcattgataatctcacatatgaaccaaggtcaataatccgacacattgaagagacatacaagtatactattagctatgccaaggcctggagggccaaacagaaaataatagagatgatatttggaacttacgaagcctcgtatgacaatttgccacgcctgcttggtgttatcgaggaaagaaaccctgggagctcttacaaagtgaagaaattaccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctaaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcatcatatgggagctaatttcttcaagcaattcaagaacaaggagctcatgaacatgttcaagaggctgtgcaatcagaaccaggagaaaaaattcaatgagctttagaagagattagatgagttgacagccaaatgcagcgatcagcgtgcagcggctccatcgaccgccgttgctgaccctcctcaagctcttggacctctcccaacggatagtccaacattggttagaagaactggattggagattcggaaattttctcagtggattctgcatgaatcaaaagagaaatgggccaaggtgtatgacacaggtggtgctagatatggaataatgacaacaaatttggcagaagtttacaactgggtgatgcgcggtgtccgtggactgccactagttggcatagtggagttcattttacatgggacatgcaggtattttagggatcagttccaggcagttcttccctctatgccgaacaacagcattttgtttggagctttcgtgcagaaaaagctagaggagttgcgtaaaaaggccatgaaacatcgagctctagtgcaaggtacccaacagctcatgtttgagatactatgtcaagataaggcaggcaggggtatctaccgcaagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagtaagcaatatatcatacatggagcggtgagatttatagtttcggcatagctggggagttcacagagactaacgatgaagtactcaatattcctgacccatcgaagctccgaggtaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgcctggctacgtggtgtagttcttatgttctatgtcggcatgtggatttgcttgtaattcgtttcgaacttatcgatgtgtttatgtttcgccgtgtaatgccagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccactagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgatccgggcacggacgtgcggtgagctactcacagttcacgactcctttgtcgagaggtacgaacagtgttttactataagttagttgcactgtaatattttttataatgacattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgccgtgcggtgaggtagcccctaccctacaggacatatcgtacttgttggggctaccgctagcaggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcactgtgagtgtttttgtaccgaaatgacaatcgtattacatatttagtccgcagttaaggtgcctaacattttatcgacggcttgctggttgagcagctacaggcggaggccgacgagtactcctacagccgatgtttggaggcgtacttgctctggctttttggctgggtgatgttctgtggcggtcacgggcactcggtcgacaagggactcgtgcactacgccaggagcatcgccgacgccgcggtaggcgtggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgctgtcgtcaggtacgttgcatcgatcttatcgtattgttaagttaattgttaagttaattgtacatcacatcgatcgtctcgtattgcagcgccgatgggcccacgtccaggttaggcggtcgtatcctgagtttgttatggagttcgaccgccttctgccgactgacgtcgtgtgggagccctacagtgccacggctacccaggctcgtgtgccgttgggtctgtccacactctgcaccagggaccaggcgtactggatgactacagttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgaccaacgtttaggcgcggggattccggtacccatagaggagcacctgacgatgtacatgcggatggtggagtcgatgcgctcgattctccgagtgctcacctgtcatgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccaccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagtgtctcaggcagctgtgtcgacctcgcactcagcgcagttctggcagtacactgggacttcgtcacaggcagccggcacgtcgagtcagggtccaccactggaccatgctgggacctcgtcggactgcttgttgccttccaccttcctcttcgacatcactgacttcgacttcgcttcaggctcgacagaggacgtcatcggcccctcacagctgggaggcgcaccgccggtgcagacgcaggaccaggcgtaggccactccttcgcgggacactcgtgttacccgtgctgtgccaccggatcatttcacctactcccaggaccacgtgcgagcacaggcccggaggatcaagcatggttgcggcgcgtggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccgactttcgtcaatggctagacgccgaggtgttgaggatccaaactggtgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcgacagacccgcactacggcttgcgcatacatcgagtgggtcgatacagaaaatcccgttctcgacttaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcattgtcaggttcttcgttccataaatcctacaacattgggtcgaaggttctttgtttgtccaaatattcttgacgacgattttatggtaagaatattttgattacatgaatccttattttctcacaacatttactaactttgcttgctttacatctattctttcctcctaggaaccaccaaggagatgtcaatatagagaatggatagacaccagaagggttctaactccacctagccgtgttatgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctctctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtcccttgccgctctctattggggcagcaagggacccggatgaaaaagtacggccgcaagctctttatgggcggccaaaattgcaattagccccttgccgccctctgtacgggcggcaagggcctaatcgcaattttggccgatggcggcagatggcgcggtcgatccaccgtctgccacgtcagcttaccgcccaccattagggcggcaggggctatttctgtaatttttttggtcgatagattatttctgtaaatattaaaaaaaaaatctaaaaacgaaaaaaattcgaaaagttgttatctgtgcaaacaaaagccacaacccagaaacgttttgtcatctccatttggtttcttcaaccagaaatttgtggtctttctttgattgtcagatcagaaaaaaagagatcaaatccaggctggaagaaaagaagagatcgaccaaaagagaggagccaaaatagatggagaaagaagaaaaaactcataaaaatcatcgaatatattcagagagaaaaaatggcttcatctctgatctagatgccctgcaagcctgcctgttgcatggctgctgcaatgcactgctatgcatgattaccaaagccaccaaatagaaatctaaaaacaatggtggtgtttgaatcggctgaagatgaagattactccctccgtcctataatattacaacctaggactggatgggatgtttcatagtacaatgaatctggacatgcatctatccagattcgttgtattatgaaacgttccatccagtcctaggttttaatattatgggacggagggagtaagtgtttcacgcaaaacgaggtggtaataatatgtgattaattgagttttaattattacaaacttgcaaaatggagtaatatgatattttagaacaactttcatatataaagttttcgcacgaaacacaccgtttagccctgcttgcagtggaatcgaatgcagccaatgtgtaacttctgcatagggatgcagtactgaaaaatatggcaagcaatatgacaagcaaatatcagcattaagaacgatttctagtggttaggctatgacataaataagtgataaactgattaatatgtaccaaaattataaaaatagaaatcaggcttatttaggaaatgtcgacaaaagcgatacaaaatgttactcctatctactttgagatgaccaaatattttataaaattctatctacatgaccaagtagatagactaggaacactcacttttattttctgaagtaaacttcgaagtaatctcccactgccccgcacgctgcaagcgcttcgcccaatcgcacgcctctatgtccaaggcttatttgcctaatcgtgggtcctcaggtaggcttctgagcattatatccttgcttatctcttcttccgctccacctccgccgccgcagggcttgccatcagttgttgctgcgctgctttatcggcacgaattcttgtatttgctatgttttctggtcaaacacctaaaaattgggcaacttagaaattagtaacaaaatatgttagctttagtaaaatatggaacacaatagaaagatgtagctaaaatttaataactgaaaaagacaaaacaaataatatgattttatagttgctatcatttagatagaacaccagcttgattaatatgtgggaagattttaaaatccgacaaagacaaataagacaaacaccaacaaaatacaaaaccggtagatgatagggctatgacctagataatatgatttcatagttgttattaagatagcgcattaggttgattaatatgtaggaaaattataaaagttgcaaagacaaagacaaaatacaaacacaatacgacaaaagtttaaattgtgagatgctgacaaaacaaaaaatgataaaaaaattttaaaatacgttcgccgccattaaacgcatcatggtcgcgtgccgcgtcgacgcgattacaaaactggaatgggcttaagcccttcatatgaaattaatatagttttctcggtagaatgccaggaacaaagaagcccactaattaaaagcacttgggcgttggacctttttcagtgactttaaaaaagctcactctatcaaacgattaaaaaaacaataaatggatttaatcacaggagcaaaaatcatacatgatacaggagcaaaaatcgtaaagcagaaaaacttcatccatggccttgccgtatccatgaccataagtttcaaatccctcagacatcatctaatactttatctcatgaatgttatgcttgccatgtatagttctacaagctatcgtataaaacagtgagaatttttaattacagaagaagagtacaacatcaacccagtagggtaggtttcagtgatctcacctcagcggttatgcaaatacttgacatcagaccagcaaaatttcatccaaggccttgcctcaaccctcccaaaaatcttagcttctgaggaagcattcaacacattattaagcagtggcaaaaatatatcatcctagagcaaacatcaagttgttagcttcaaaatgaaatatgtctgagaaaacatcactgtcagaaaaccccaaacccagctagataaacataaagatccttgatccaacttaggcaagcataaatggtgcacgcaaacacctatgtcaaagcatctatcacatggaggaacaacactagctatgtgctatattcaacatgcttataaaataaaaagtaggaaattaattcctatggctggccatttatgtactacagaaactatgctcatttcatctaaagtatattgtgcaaaagaatagcctaacagccagataaaccaatagatttgtagtagacagtgaacatctgaattggaagaaatcaggatttctgaaattcaagaacacacacaatttttatagcagaagatggatcagcaccaagtttatagcagcacctttattgtaacagtgaactagtgtgtcgcatacatgatcagttccatgtaacaagaacttgccaagttagtgtactgcataccagaacttgacaaaataaaataaaaattttaaaatctgacaaaaacaaaaaacaaaaaaaaatacaaatatgaaaaaatgacttattttgaaacaaaacaaagggacaaaactacaaatgggacacacaaaaggtatttctttgtaaaaaaattttaaaaaagcccacaacgttttttccattatgtttgtttctgtccgattgttatatttttgctacatattaattaggttgatgcgctaccgatagtaactataaaatcatattatttactccgtttcaggttataagacgttttgactttggtcaaagtcaaactgctttaagtttgactaagtttgtagaaaaaggcaaaaacattttcaacccaagacaaatttattgtgaaaatatattcaattattgatttgattaaactaatttagtattataaatattattatatttatctataaacttgaaacattttgattttgaccaaattcaaaacgtattataacttgaaacggagggagtagatcgtagcctatcttctgttggttttgtattttgtcgtagcctaatttcacaacactgaaaattattagttcaattgaacggcaagtttaatggtggtagctatggctaaggagttcacacatatccttaatgaagagataatttttgtgcatggcataagaaaataaggattgtcactggcagtctatgaatgtatacaaagtgatttgagggtctatagagaagaaagacttgctgtgtaataactatttcatcaaatagaaattctagctcaaagttacgtaacatgttcgtcttatatacagacatcaggaggagagtgtctcaaacaagaacatgcatagaatatatgattagagcatacctaatcttaaaaaaagatatgcacagaacatcctcacacatatcctgtgattaaatctatttattctttttataaccgtttgatagagtgagcttttttttaagtcactgaagaaggtccaatgcccaagcttttaggctgtgttatttcccatgggttaataaaagctgtgttctttcccatgggttaatccatttttcaagtttttataactaataattaattaatcacatgttagtctgtcgctttgttttccatgcagaggggaggggttcccaacccctccaaaagaacactgccttagtgggcttctttatttctggcattctacgaagaaaagtatatttgatatgaagtgcttaagcccattccagttttttaatcttttgttgttgctgtttttttctggacgtgtctttcttggagataggtaaggctaatttttttctcatatatattgatatgatatctgtactgggaactaaaacatatttttttatatagattacacgacagacgcacatgcacacataccactacacacgcaacaccacactcacacccctacgaatacgtcacttaacacatgctttaagagacgaaaaccagtggcacatccctggtttcactaaaatcctgttgaaagtccacctgtatgtgcataatatttgtgggcattgctccatatacagtcaaagtggaaaggtagggataatgagtgagcactgcatttgctaagctctacattgagataaatgacataagtaatttgtatcagggatgttggttcgttttatatcattgggttgaaaaatgaaagtggagcccatgcttttcaaaaaatatcagcaccctcccacctagaggagctgatacaacattatcagtacgtaagcaagaccctatttagttggcgagacgaaaagttttggcgtgttacatcggatatatgtacacacatttaaaagattaaacatagtctaataacaaaataaattacagattccgcctgtaaactgcgagacaaatttattaagcttaattaatctgtcattagcaaatatttactgtagcaccatattgtcaaatcatggcgcaattaggcttaaaagatttgtctcgcaattacatgcaatctatgtaattagtttttttctatatttaatacttcacacatgtgtcaaacattcgatgtgacagagtgaaaaatttttgtttgggaactaaacatggcccaagttaaagacatgaatttcacccgacattgaatttcactgatcactgctttctgttcccgacatggcctactttatcaatcacaagcagccacccttattgcgagtaaagaatagtagtgactgttttgttttacaaaatcaaggtgtcaaattggcattatcaatgaatggtacctgacctaatgttttttcctgggtttcggatctgtgatgtgaagaaagctggatgtgtagctccggaattcaggtattgctttttgttcaggggtgtaggaatgtttagaaaacaaaaatctaaatgcactcgcacatacttcatacaggagttgataattgattagctaagcaaatcatgtggggattctgaagcacagattgaaaaagagcacacaaaaagttcatttggaggttctgaagcacagattaaatctataacatgcggggatgaagcaatcaagaggatgaggatggaagaacccaagttgggcttcaaatttttttttgaatttgttttttgtggataggtgaggccgtgagggccattttaagcccgtttgtttgtttgttgggcatcaaatatgtatgatatttaagcccgtttgttttttgggcttatctaatagacaaaacgaaaaagggcttcatgctttgatctgacaaaacaaactgcagagaaacgctatgctacgtgcagcgcgcgcgatgcaaacacgtgttgaatccgacgtttaggaattcggctgtaatcacaaatattttcagccgtgtgccacatagacagtccattaaatatccttttggtcatgaattaattcgatggacgttctcactcgtcgccgcaagtccagtggcccactggatgcttccatctcctccttgataatatggctctcttcgtccacaagcgaagaccgtcggtggatcaggcaccacatgcttggataggcaaaccatggccaatccttccacatccttgcatccacgaagcattgccttccaaccatccaatagtgacctcacccttggttatataatgacgaatctgtgcagagagagcctcagtactcaagccggaggcagcacactgcaacttaagtttttctatagctcctagcaagctagcaatggctccctcggtgatggcttcgtcggccacctccgtggctcccttccaggggctcaagtccactgcgggcctcccggtgaaccgccgctccagcagctcgagctttggcaacgtcagcaatggcggaaggatcagatgcatgcaggtatcagaaacgatacgtttcaatttctccttcaaagtgctcgttgttcatatatattaaatgttggcccgattctattatctgcatcaattcattcaatcaggtgtggccgattgagggcattaagaagttcgagactctgtcgtacttgccgccattgacagtggaggaccttttgaagcagatcgagtacctgctccgatctaagtgggtgccttgcttggagttcagcaaggtcggattcgtctaccgtgagaatcacagatcacccggatactatgacggtaggtactggaccatgtggaaactgcccatgtttggatgcaccgatgccacccaagtgctcaaggagctcgaggaggcaaagaaggcataccctgatgccttcgttcgcatcattggctttgacaacgttaggcaggtgcagttaatcagcttcatcgcgtataagccaccgggttgcgaggagtcaggcggcaactaagcgctttcgttccttcgtgcatgttctttctttttcttttttttttgtgtgtccgtgttaagctgcacgtaattgttctctcgcgctccgacctgccgttgttgcaagagtactactacaactatcggtctatcgttcggtgacggtgagacagggcacgtgaatgcaagatctccggctatacacacgtactcatgtaatatgatgcctagagcatatctgaatccgtcgacaatgaaattttggttttgcaaaatgctggtatttgtttatcatcctggcacgtgatatttgcctagagcatctaaatcacttttacgaaatgtgcgcgtcaacaaactgatacggcccaaatgccagaaattaccagcatatatagccatatcaacttttgattcgtatatatgaaggttgatttagttagagaaattcggttgtgagagaaggaggctagcaaagattcggttgatcaagctgtaccgccaggccaggacgtgctgtgcgcgcggctgtgccgcttgaccgcagaaccatacggaattgacggaccaattgtgcatacggacttagctaaaataattgttgatttttggcaataagaaaagcgagtagcacataaaatctaaagtggatgagtaaagggacaaaattttatacatgttcaggccttctcgatgagaagtaatactatactcctgttttggggattatatttgtcagatgttgtatcaatctgacgatcgagttatggttattgttggcggctgttaaatatcgattttatgccatcaatacctgtataatttatacagaaataataaaacattcaacatagtggtaggctttaattctaacatattccataagtgttggtgtatatttggatgcaggtaataaaccaccgaattaggaggaaatctagactaagttgaaggaaattttcatccatacaagtgttgggctttttaactccattttaacaccaaaatgcaagcccaaaaacctgcgaaatggataaggcagactgagaaggaggcccaggccaaaacttgggccagttgggccaagccaggtttcggccaaatcctgatcatcgctgttgatctcagggtttggcatggacgctcttgatttactcctgatggcagttgcagggcatttccgatcattcgcatgctctacaaccatcatacctacttatttaaggagctctcatcctcacttcatatcacacactccaatcttgagctgaattataagaggctctattgtattttattgtatactagaattagggaaagattaaggtcgtagaagaaatcggaggaattccggagttatcggtgatccttttctatttcttatactttgttatttgctttaatagaaatatcatttcaagtaattaagatttgtttagtgagaactattattggctagttcctaattagcgtatgagatcactgttcactataatccgttaaaatatagtgattgctttagtgagttacaaacactacagtagttattgattgcttaaacgtggtgtttagatagttaatttctagtggttgctgcgtatcccatagtacgttagaggcgggtgtagaggtggtgaccgccctcaagagcacttaattcctccttgtttgtgtacgtggtagagcgacatctgggaacagtgggttaccagtgcctgaagtaccatgttaggattaaaattgtaacattgtttctcattagtaaatcttctctaccctctacccacatttgctttgtatccttggtgaacctgaagaggaactgaacacacacgttccatgaggaaatcaataccttggaatactcctaggtgaagtgctacatcggcatcttccgtgtactaggggattttacagtaacattaagaaataccaacaaacatttttggcgtccttgccagcgaacggttgttgtttatctccgaaccatgttcatcctcatacccttttttatttttctttcttctacctttacccctactaccctagagaagtattctcgtaaaactcttcttgaccatggagcaacccatctttgaattatcagtgttggtatttcttacgatcacagatagaatccgcaagcgcacggatataccgatgtagcgcttcccctacggagtattccaagggtaccaaatccaagagaacatgtataattatctcttcctcccgttcatccaaggacacaagataaatatgggtagagggtagagaggatttcttagtgagaaacagtgtctaaggaaagcttaagtttaatcctaacacaatacttcaggcacttgtaacccgctgttcccatatattgctctactatgtacccggacaggcaggacttaagtgctcttaagggctgtcaccacctctacacccacctctaacgtactgtgggatacgcagcaaccactggcaattaattacccagacaccgcgtctacgcaattaattactactctagcactagccaagcactaaagcaaacactatataattaatggactatagtgaacaatgatcccgtatgctaattaggaactaaccaagaataattctcactaagcaaatcttaattacttagaatgatatttctattgaagcagagtaattaccaaagtacaagaataaagagagcattaccgataactccgggattcctccgacttcttctacttcactctctccctattctaagtatactatagaacatgtaaagaagctaaagcatatttagagcctcttgtaattgagctctacatcttggtgtgtgtcaaatgagggagaggagaggggtatttatagtgtggagcttgcttgggagtgtggagatcctccatggcatccaatgagcatattcactctcctcatgccaagtgtccatttggatgacggttggagcgccggaaacggtcataaccatcattgggaagcagttatctaccaaactggacttgggccggggcgaacggcctctaccagggttcggccgaactcaggggttcggctgaacccgggacgactccgttcgctccggttttcgtcctggacattcattttgggcccctcatttcattggtatgaatgtttggcccatttggaggtgtttaattgggtttatgggtccaaaactccttaagttcggatacgagtttgattctcatcctccttcatgtatatttcctctcaaccttggtagtttgtcacctgtatatgaatatataccaacactcgtggaaattgttagaaataaaccctaacactatgttggatgttttgtagttatggttttatgcaggtattgacggcgttaatttggtactaaacagccgtcaacaatcagcccctaggggcgaattctacgagccacctccttcataagagccaatttttacaactggctacgaaattcgccccaaattaataagtatggttagggaaaaacctttctttggtcttgaccaagaaaactcctaccatcatctgcgggaatttgagcagctttgctcatgcc

SEQ ID NO: 58507 - DNA, 46315 bp, Oryza sativa
  unsure (1)..(46315): unsure at all n locations
cttaatatatttatcatcaaaccgagcatataccatatacgtaccaaactttgctagtagtaccaaaattaccaaacgggtcctatatatgtttctgatggacgggagcgtatcctatacacacaggccctcgcgtgtacacaccgtgtataccaactaaaaattatcacaaaaaattctagaaaaattcatacatgtactttcaatagtattacatttacgtgcaaagtcgcatcttcaaattcattctacatagagaataacaaaaaagataaaattctgacaaaattgcaaccttaaagctgtcagattttttgttttttttgttacggctaaaatataatgaatttgatgttaagattttaaccctaggtgtaatacaattgaaagtatgtgtatgattttttctagattttttggtgatattttttagttggtgtgcacatgtgtacacgtgagggcctgtgtgcataggatatattgccctgatggacaccacataataggtttcagaatagtcggctaatcgatccaagtggtgactggtgatgagcggtgacaaattaagcgaaatgtgacatcaacatatactcccttcgtctcacaaagaacacatttttaggtttctgtgtttaacgtttgatcatctgtcttatttgaaaattttataaaaaaattattaaaaaatagtcacatataaagtattattcatgttttatcatctaataacaatataaatactaatcataaaaagaatttagataaaacgaagagtcaaaaactaaaatatataatatttatgggacggagggagtaactgtcattatcttgttggaacatgcaggtgttgcttcccagttctagaccaactatatatgattggtggttgagttgactgttttctaccttcacttccagtgtttgatactccaccaactaaggtaggtcccgtttagaacacgagatattatccatcagtcttgaagtgattgaagttcaatcattcaactgtttactttgaagcagcatgtaaattaagatggcttagcaaatgggtagtgcaccttatcttaatatagtttacggcgatgatttatcattttgggaattttatgtcacttgtcgagatgcgataaaaccaccttggccttgcatattgtctttcatttttacagagatgatttatatgtaaaaaaaatagtaatacaaaaaacaacaaatagtaaactaaggcttcatagaactaagaacaaacaaaaggcttgaataggctccaagagtgtaatttaaaaatcatcagttgatggtcgagttgacaagaataataatctatatgtctatcaaaactttggaaatggcatggatcaattattcagattgtaaggtagatagatatatattgaagaaaaaataatatatagacaaaattagataaataagtaattgtaataaaaacagagtaagtgggcatatagaagctatgtggtagctagagtatatttgaataaataatggcacattttccccattaaattatatatatcaaccacatatttcgccttccttaataggggtaaagaatgccaagccattaccggtagggatatcaggtcatttaggatgacatgaggagagtgacattgagtagagagagtgggaaaagagcgagaggtgtgatgtattcatctacaaaacactgtaaggactgcataaagaatcaagccattaattatacaaatctacctgcgtaatatataaaattaacatggaaattatattatccaaatatgatatgaaaaacatatgtatgagttgttatgcgtattacctaaatatgaatggagaacatgttttgtttttgaatggaaaacatgttgtatgagttatttacatatagatataatgtaaaagatttacaagtggcagtacaaaatgtttttatgcatgatgaaatcatattattttgctaaatttctttggaaaaccgctattgtttttgcttgcaaccaccaagtagtttctctcagatgtttggtagttagtttgttggtatcaattaaaaaaacaaaaaaaatacatatcttaatagggacatatgttttattttaggctctatggtttaagtaattaagaatggtgtggttttggataaaattctaactaaatcttatatgcgtacttttcaagacaacacatttgttttggctccgagcccaactacaaggatatgatgagaacaaatacttcattcatgttgcatgtcagaatttagagacaacaattatgcaaatattcgttaacttcggatggcgatttaccaatagaattgttgtctaaataagttgtatctactcactattgttgatggttcatcactaaaccattgatcacgccatacaacttcgaaggcaaatgatagacctgtgtgctcatcatcagctgaacacttcctttcatggtttctcttttcctttcggcttattcggctgcctattttggacgcctttaggctctagctagtgtgctccatggtcaaccaacttgcagtgccttttggcctgacctcgtgatcatgaaattcatgattctccaatcatgtcactgggtgcaattagctagaaccatggcatttctatagacttttaccctacctacctagctaccacccccactaattcgatcgtgacatatattcagttactcgtacactgcctagattaagcagagatccatgcatgaacaaattaaagattgttgcatctcaatgtgcttcccagctttgccatgatttgcagtttaagatgtggacacctgacttgactcgatatcaatctggtaatcggatatgtgcatcacttcatgcatgcacaaaattcggctcatttgtttcgatgaaaattggctttcggcgcaccttgattaattccaaagcaatttaagtaaataatcattacaaaggaatatcatcatactagtacccaataggacaaattaacctttttcttttgcagcaccagaagggaatgaatgagtgaaggatcatgaaattattgtcttttcggcctttttgggctagaacatgtaaggaaaagagagtaaagtgtgactcacataaagaccagtaatgatgatgaatctctaacaattaaaaataagatttattataggtcatgaaaattgtacaaagataacagcaggaatatggaactattgcccaacttttttcttctggaataaggatagttcatgccgtcacgcatcaagtgtgcaaaacatctgcacgtattatcaaattccattctttttcaacaaacggaaaaaaagttaatggccatggaattcggattacccgagaaatatatgtggctgatagagcgtgaacataaacagtctttcaatttctagatgaatttctttcataagtgtcaattcagccgagtataaccaaagtcttgattacaccgtttaaccaatgttaatttgacaaagagagatttgagatagtttcactacaatttacaaattcaagtattgtacataaatgtccacaaaataaacaaaagtgtctcacaatgcttactaaggcaacaaagcaaaacaaataggaattattactataaaaaaatgatcaagaaacatgtaaaaacaagacgttttgctaggggaggaaaatgggatagacatgttacatatggctgttgtatctagctccatggatcgtcccaacctttgggcccctctctcttaacaaaatctacaatggcccgaactgcttcttgcaccctattggagagagcatggtttccccattctatttcaactttctccgcgttgcccaatgcgcgacataatctgcagtgaaacatatatagagcattagagcatgatgatatcatatcaaaattgtatctggtatgtttggatttctaatttcacctgtccacaagtgcctccttatcaacgtattccgggacatattcatcccccattgagaaaataacctgcagccaaagcacttgcaagatataaaattcagcagctacagcataatgtcatcgtagcttacctcatttggcaacctttaactctacgaacaaaaagtcttttttttgtagaatgcattatacagtatgccaaagagaagcttctgggatgtttgttatgctcaaatttcgctaatttccttaaggttattgattttcacattctaatgcagattttaaatgtacttcttttcctgatttctattccattagcttgcttaatgtggtcaaaaagcaaatagaaccaaaacagcccactgggaaaattaccccatttacaatctatgcatgtataaattacgaaagcccaatgctcaaagttaggttcaggacccccatcaatatatatgagttcttcggttctttctgtttttgtatcttcacacctttcaattacttaacatgcaagtcaagtactaaacgtaatcaagcctagttttattacattatagcattgaggaaaccaagtctaatatatctatgcatatatggccaccaatgcaaatgcaagcattcaacctacaagctgtaaacagattcaaggaacaacataatttaactacttggtgaattaggcattaagaaaatatcaaatatctgatagtgaaacggttatttttcttagatcgatcagcttgaaattgttgctttaagtagatacagaaacaaaggaccataaaaggataaccatcactaatccctgtattcatagtcatcagaacagaatgataatgaaaatgtgaacgcaatatttaccaccaattctgggctctggctatgaccaaaaaaagtggtgtttccatgtgtgttgacaaagtcacaagtagaaagggacaatacctggcactgtgttgttgacatatgaccaagtctctgcctcaactgatcttcactaagatctgagctgaacatgtcatcatcacccatatatgcacaaagggagtgatacctacacattatttctatggcattagagtacaactgaagaaaaaatgatgtttgattcgttgcagataattttttaagatcacactgactaacaaaggatactaggagatatgctggtaaatagatctaataaaataaaagatatggaacaaaaagaagtaataggatattggatcatttgaaacaatacagaaaggttaactttgcatcatttgaaaagaaaaaaggactaagaccccactaagagttggtcatgagaaacataagtgggagacaaaaacatcaggtttgttacatagtgtttcattcttatcatgtttgttctattcatgtggttcaattttcatcatccatgattttaacttgtatttgcgagtttctttgctcaacataacatagataactctcccatgctacatggtccacagagtctacgagcaagaaattttgtatcattggtcatcatagccgaaggaggcgcaacaagttgtgtcttaggtcatcatcatcacaatctagagaactataagggattctacaaaattctcaagtcccaactaaagtttttcagaacataggttaaacatccaatagcaataacagcttgtgactcctcatctaactctttacgtagtggttgaagaatacatgatcataaatcaaaatactgaatcccattaactatcatttttcagtaatcatagtatgagcggttattgaaatttttgttgctaacagaggtgtagatcttgcgacatctttattaatcccagaggaagacatcactgacacaaaagtatatctgagcatctcaggcatggaaattgatacctgtaggcagtaatcggagcatctggatttgcttccctgggcatcaaatccattccacggccctcacttaacatttttgctgccaaatctatcatttctgcagtttctggaagtgttgctctatactccctgtcacttactggggcctgaatatcatagaagttgaatcaagataccgtttacatggatttacacataaaaaagcaattattctcaacaggttacaaattcatcagtttggtctgttatttagggaggaagtccctaacttcctatcatagttcacattcaaatattttcacttcaccccttcgcatccaaacaagaagatagggacagggagaatacctgcaaaatgaccccagaaactgccttggaacatgcaaaatttgtccgcatgtaatgcacaatatcctggcattgacggaaaaaattgtgttatctttttctatgataaaaatacaatgctgaccataaacttgtctcaagtggtcaagatgtctaaactttagaaatgcatataagagcctctgaatttgtttaaaatggaccactcaaggtcccaaacatgccaaaaggagcacagtacctgacctgacaaaccggactaagttcaatgtggatgttttgcccacatgagtcttccatgaaaagtgaatttgagatgaaaatgtacacataaacccctaatatggaatccatgggcattatgtgtgccccactgaaaataatgaaagtgctcttggctaatgagaatatgagacccagacttctaggattctcgagcaaagttcacaaattgtgtgttttctgaatttcagaatgcattggaaattggatagctaaacagcaaaaaggctggttgtttagagcgggaagacagacagagatagttgagtaaatcaaaatgggagctggtcaaccaaaagtgagataaggggaggatagaaagagggcttatgataagtgattcattcccttcttcacatgctttaatttctactatgaattaatactaaactccctttgtccaatctgaacatgataagcttgaaactcagctacaattcagcgcacggagaaggaaattatgataggcaagtgaaaaggggaagcagaatggactaggacaggtttggggcaaggtggaattggaagggatttgcatgcaattggactagtatggggattaatatcaatacaagtgcttatgtacctacagttttaacaatactggatgaatttgctttcgtatatgtccatggcatggctggtaagttcctacagtagtcagtaacactagacatggtcaccactcagcacatcaaatcagaaattatattaagtgtggcacatctgtaatctaaagtgaaacacaggtgccaagtccagtatgcaattctcaagtttagggatccacttgaccactggggtaagtttataaacctatgaagcattactatttagactataaatagtaccaacatatcagtgagcatacctggcaaccagtactgtgaccaagcaatattactccatcagaattttctttgtttatcaagtaactgatgagttgatctagttccaatgcatcctttgacaagaaaacatatattcaatacttgattccaaaaaagtagggttaaaatgtaaagcacccaaaaaaacgaataaaatggacaatccaatcaaacgtcctgcagtagaataagaaaaacacagaagggaaaaaagaagtttaccaccaaactagcagatagctcaagcaaccacattctgcatacagtactttcggatggcaagtataaattaagatctcatgactactttggtggtcattggaaaatacaaatgagattctagaactagcttcctgggtatgagtgaatgtgtagtcaaatcatgtaagtaagtcgatcaaagtgcggaatgacaagattgaaaaactgaacatattatgtaaaaaagaatatgaaaattaacttgagaacattaaaatcattcttaagtacctcaattcttctttcagcatgccactaagaccatgaacacctcaatgtatgcaaatgcggttcttaaactctaaggatgaaaaggtccatgttacagatcatacctgctctaagctggaaattccatacccagtgtatgatgaagaaagtaacggctgtaccagtgaccatttctcgacctctagtgcaagtgacaaaggctccaagtagctgtaatgttccaacatggattagaataataaaattagttccagtcttaaccaagagaaaaaaaaatgataacatatgtattatgattatatacttacagaacttattgtgttatttttcctatccttctccaattcatcatttttcagatttttctcatgtttgttactctcaacatataatgaattataacttgaaattttatacatatgccgagtaaataataacaacaactagattatctcatactgatttggtgagagggaagtgattgcatgaatgcatcatgaagtactaaatggtgattatatagtatatatttccatgtttccatgtatgcatcatgctatgcaactcagtacatcagggcagcttccatactgaggagtgacatggctgaagggaaggcactttaggatagggaggagaccacagactaggatgaaagaactttcagggagaaaggcatttcactccatgcttcagaacaactattttatagactaatcaaaacaataacttgactaactaacagtaaagataccaaataacgttgttactgaagcgcttggacagtaccctaattggaaactcatgagaactttcactatcaatagtgtcttctaattcaacaaatgatatggaaaaatatttaatggaactgcatattgccaacttactcggttgctaaaaacccatccgtcaaaccaccgatgaagatcacctggtggttaaaatcaccagttttaaatgcgacctgcaagaagaaatttatagaagaaacaaaacagtaatgacaagccatatctaattagaagttaatatatggatggtgaggctgtgagggtttcctttgtatatgcaaatcatcagaaaatgaagggtgttacagaatgtacacaacataacaaagcatagtgcatagacatctgggcctctgaggtagttaaaacaactaggttaaagaccatgtttggtgcttgaactattctagaagtcctttttcatgctaaactcaataaccagttttttttttcattttttcgccctcgactctcaaaagcaaatcaataacactctagaccatattcacagtgtttttattgacatggtgatggttttcactagtgcagactcctactatacatgtcttgctaatgtggatgccacttaggtccacagttccacaccaacaaagtttagtacctgaaggctatgtcagttgtcatgtcaatcaaaactaccatggaatcagcttttgggtgttatttttctggttttgaaagttgagtgtgagaaatgactgggttttaagttaacggtaaaaaatggaatccaacaagttttgagtgccaaaaatggactttaccttagaattaaaatgataaaacttccaagagatttcaaaattccaaccagattctataatgtgtaaaagggtacatcttaccggcagaataagttatctagaaaccacaatattgcaaccacatcctggcatgatataatgctgatgttctataggcttactaccaactgatcatcttaataaggtcacaaatggcaatgtggcactacgtggtccaaacaaaggaaagaatgcaggtacattgtgacagattatcccattcagagttgagaccctcacttttgtactacaacaaaaggtgtatataaacaaccttgcttgtagcaacaaaggatcataacaaacatagctggcagagatttgtacacttatttcgtcgcaatttcaaagtagaaaacaaatcctctacacgcagcaaaaggaactactatgcaaaagggaccataagcctagatagggtcaaacattgtatattcattcagtaggctttcttccacgcgagaaatgatacagaagcaaggagacaagacgcaaaaggcctagctagccgtgttaacatcagcaaaagaaaactaagagaagaaaattattagcacacaagttgggctcccaaaagtgcaacccctctaaagaaagaatcgcctgcgcttatttccattacaagccctggatcatgagtagaaacacggctatgctacagaagcttccttattccataagcctctatctctctctctctcaacaaccgcacgcacccagcggaaaagggcagaaggacgaatccaacgaggagatccccgcatcgcatctcgaaggctgggcggcacgaacgcggtaaccttctagaagattctagaaccatctcgacctagggaaattcctcctcgtcccccgctcaaatcctacaccatttcaaaccccccacgacgcaatcgcaggatttctacaatgcaaagtaataaaccctcgaatccatcatcccgagcaatcccaaaacgatcccccacagatctcccgccgcaagccgcacgcgcgcgcgccccagagagagagagagagtacctgggcggacttggggccgtacttgaacagcgccccctgcacctgcctcctcttcccgcccgcgccaacgccagcaccagcgccaggccccgcagcaaccacggcggcgaccactcctccacctccacctccacctccacctccaccgcccctcccacccgcgccatcggagaggggagcggccgcggaggcgacgccgccggggggcatggcggaggaggcgcgggcgatgccggagaaccaggagggggaggatgtcatggcgcggccgccggcggcgaggtcaccgccgcgagcgcgagggcatcaccccgcgatggatcgatcgggagggagagagcggcgactcggagagagggatgagctgctgctggtgcgggaaatttcgtcgggtgattttttttctttttttttttttttgggttgacgggatgtgggttgcgagaattttcagggtgacgcgtagccgcatgatttaatctcggcggttggtggccttgctgtcatcctctctttgtttgtttgtttgtttgttggtgttttgacttttgagcggttttttctttctcaaaccctcctctttgaaacaaaacttatgagcctgttttatgattaattaattattagtaaaaaaggaaaaagtatattaatatgactttttaaagtaactattatataattttttaagaaaattgtaccgtttagcagttcgaggggcatgtatgtgaaaaatgatggagttttaatggcatatggttaggtggcagtctcccatttattgaaaaaattattgccacacatattggggaaaatatgtggtggaatatatatatatatatatatatatatatatatatatatatatatatatatatatattggaaacttggaaactaccgttggatcgaaaaatagacatccgtgattcatccatgtcatcatgagtaaaagttttacttgcgataaaatttttacttatgactaaatccgtgagtaaaatttttattcgtgatgacgtgaacaaatctcaaacatctatttttcgatttaacggtagtttccagatttccactacatatatggtttccaccacatattttccccacatgttgaggggatattttgctagttggccatatttggcacttccatcctcgctcgatgagtattatcctcgatacttctaccgtcattatccaacatgtaatacaggttttttaccatcgtactaaaaccaaaagtacctttttaaataatataaaatctataaaatgactaatactacctccattttagaatatatgacgccgttgacttttcgcacaaagtttgatcatttgtctcattaaaaattcagtatgaatatgtaaaactataggttaatattatattttatttgatgataaaacaagtggtaacaaaataaattaaatttatatatttttttaaaataagacgaatggtcaaacatcgtgtaaaaagtcaatgacatcctgcattttgaaatggagggagtatatggttagcccaaaagtacaattttggaatatataatattgactaatacatagtccaaatagaaattacatcagtatttctttttgaaaacagaaattacatcagtatattgtcactatggctgcgtttagatccaggggtgtaaagttttggcgtgtcacatcggatatgctgacacacatttgaagtattaaacgtagactaataacaaaacaaattacataatccgcctgtaaactgtgagacaaatttattaagcctaattaatctgtcattagcaaatgtttactgtagcaccacattgtcagatcatgtagcgattaggcttaaagattcgtctcgcaatttacacgcaatatgtgtaattagttattttttcgtttatattcaatacttcatgcatgtgtccaaacattcgatgtgacaaggtaaaaatttttgccaggggatctaaacagggcctatgtaatcttgatgtagtgtagttaatcacaacgtgcttatgagcgcgtaaacttgaaacttaaaattctatctactatatagacataaggaggaagagatggaaatatttttattaaggttacattgaaattggtattgatctattcccatataatgtcaaacatcaatgatataacctacctagtattgataacataacaagggtgttctacattgacatggatgcaatcaagtctcccttgctactttgtacaatctgattttatattccccaggcatgcacatagaacaaaagtacagtacgatagaagatttaaaaaggatgtgcatcaatcatcttgggtaagtatgatgtagtagtaatggattcatgatctattttaatgccctgttgatattatttttcaggcagaataatacatacaggtagactttcttcaaattaagttgacaatacctcaccgtagatgttgatttgttaaaaaaaatcgttttcttttatagaatattcagatcaaacttgataaataaagagacaggaaacactagaatattcagatcaaacttcagtgattgaagtggcaataacaaattcaactttccatcgacaggttcttgtgcttgtgctgatttgtcacatcatcaaaacatcaactcacacaccatctgtttcacaaaactcatcattcacaccaaacacatataagattaaagcaatcaccttccttctattgttgcaactcatcatgataaagcctacaatatttatcaaatatgaaacaaaaaatacagttccctctttcaaataccatgtaatgtaaaagtaaaactcctatatctatactacgaattttaacaacagtagctcaaaaaggatcattcttttttttttaatctcggcaccacaagccaaaaatcaatatacaacaactaatcaacctatgaacataaacaaaaagaaagaaagattacaacaacaaaagaacttatattattcatccagttggtcattggtgtgtgcaatcgaccacacgcccttgaacatcccagctgactgaagtgagaaatccgacacaactctgaacagctccggcaaattcgtcctgagaaggctgagggacttctccctgaccaccctgcactgcttgacatacatctcctccagctccttcatagaaagctccaacttttccatggcagccttccgttccgccatcggatcggggcgtgcaccgtcagggttcctgtcctcaggaaggatacccgcagtttggtggatgtacttttgtgcccagtcatcgaattgcctcctcttcttcccataatccctcctggtatcctcgatcttcatccggagcttcagttcgtcttcctgatgaaccaggattgtctttacgatctctgcaaacgtgtttatcgccttcttggcagcctcatcggggagctttccgaggatttcatgccaagcatgcagcaccctcttgatgggaggtgtggtctcatgtggctgtgatgaatttggcttcaagttggtgtcgatggggatcacattcagcttgatccaggtgtagagggatcccacatactgcttctggtatgtcatgaacttgtcgaactgagtgtgccactcatgtacaacattccacagctgcacggtccggtcatggtgttgctcgcttgtttcccgcggggcgaccgagatgtccaacgacttgagctccaagatgatcttgagctgtgttttgtgatgaaggtacattgcatcccacatgtgccacattctgccaatgtaagaaaacaaaacaattaagttctcttgagtctatatctattgttcttttttgtttcgttagcaatgttgttattcatagtagaaggagaaatcattgaaaaaggcttaccccttcacaagttcaagaagttttgggtataattgttgatctctgagacggttgatctctgcaactgttgactccattgtttgcagatcaactacatattttgtgtgcaagtgactaacaaccgacttggtcttctcaagtgaggaagaagtgacaccacgctgcttctttttgttgagaacagctagcttttgttgatattccctcctgataacctcaaaatcctggctcagatgtacaaacataacagtttagatcaagaaacaagtgacaatatggtgttgcttcaatcattttcacatcctaggagtctaaaacatggaagcaactgtcctttcaaaggaaaaaacaacatggataggtaatgaaattggattaaaatggctagaaaggtttacagatcagatgattgcatgaacaaaaaattccacaagaacaggaaaataacttaacaggaagaaagaaaatactccagcaaactagtagcagaggtcgtctttatgtgctgaacaaatcatattgcaaaattattgtcgtaagaaagtgctattgaatttagcaatctataagattgtaccaataaatgagtgggtggttgcaaagatttatattttgaactagtggtaaacaaaaaagaaacaccatgtaccttgacttcatggtatagttttttctcccatgcaagcagcttatcaagagtggtagcatgtgtctcccattcgtcatcgtccatttcattcctcacattttccggttgaggtatccctttaaacgagcgattccaagtgattacttgcatcactctggcagaatggtccacaaatcctagcaagaccgaagagggatgccatttaacaacagaaggaactcaaatatgtaattcctatttttttcgaggaatggttctcaaatcctactaagataggatgcaaatggcatttacgttaacaatggaaggaaaccaaattaacctgagagttctcaaaagaagaaaaaaaagaatgctgagtatgaagaaaataatcacagcgagcactaaaaaacaagcaagacagagactgctcaactgaacttgaaagtgaatcatgagaatacaggtcatcaacaatttaaatgtgaaccccaaacaactcattcccctgtaccctgtgacccatatgtgattagatgctctgtccggttcttcgctttacccgctaaatgcggctccactaccataaccattccattggcccattccaataattaaaacaatgcaatcattctgttgttcttgacagtgcagattagtaatctattcaaagtcttaatacaatcgtgtggaacgggttaacttcttccataatcaccaagtcaccattaataaaacgtatctgaacttctctatccaatcttgctaaagcatattccccgaaacaagtgtactgattattttactcattccaatgagtaatctgaaatggtagataagcagcaagtgttctatctatctagtatcacagtgaaaaattgaaaaagattgtaaagaagatattttaattttgctgttggtttgaaagtaatctgaatcgtgaagtgaattcatcgtgttggtttgaaaattgaaattacctcgcgtctcagcgaagttggagtggtagtgcatcctggcggcctcgagcagcttggacacctcgtgcgcgctctgcgacgccttgaggaagtgttcgtccagggcgcggaggatgtcgccgacgcccagcttggccggctgcggctgcggcggcgccaccagcatcaccgccttcgccttccccttcctcgccgccttctgcgtcatcgcccgccgcgtcgtcgccgcctctgccgcggccggcctcttgccctccgccacctctctcgccgccgccgatggctggtgttcgtccggcgcggggggtggtggttctctccgctcggccgacgccgaagacgatggctcggcggcggcggtgtccagagtgggcggcggcatggagtcgaacaaggagctgatgaacccgccgggggtgtccaccttgtggtcattctccggcgggaggggaggcggggagcgggagggaggggggcgctgcgaggggagcggcgggggtggcttcagttcggcgtcgtcgtcacctcgccgtcctcccgcgtcgccgccgtcgccgccctcgtcgtcctcctcctccatgatgggcgcctcgccggacggcttcttcttgatcggctgctgcaggtgcaggtccggcgcgctcatcgacctcgcgagcggcgccgcctcaacgtcgccatgcggaggcagcggcgggggcgggggaggcgggggaagctcgggcggcggcggcggcaggatagccagcacgggcttgccatcggaggacgccgtgacgagcgccgccgccgcggccgaagagtcagccgaccccgaccgcagagccccgccggcgtgggcctcgccctcgccggaggcgtagtcggagagcgcggcgccgacgttcttgagcgcggcggcgtggcccgcgtgcgcgcccgccagcgcgtggcgggcggcgacggcgtcgcgcaggaggtgcttccgctcgcggcaccgcgccacggggccctcgccgtcctcattggactgcgcgcaccccatggggtcgccctcgccggcggctggagtgggggtctctggtcggtggtggtggtgggcgagtgattcgatggaggtgttcgtccgatggatcgaaaggctggcgaatgatccttttgggggaaggggagatggtggtggggggcgggtggttttgtgctttggaataaaggtgggaatgggatgggatcagtggagggccacgtcgttgcgacggtgaagaggaccccggatgtgtcatgtatatgtccacttgtcccacacgtttaccgtgtcagacacacaaatttcatatgaagaaaatttaagttcagttcagttaacctcagttttttttaagtagtatatccatcccataaaaagttcatttttcagtttttaatacaacatttaactcttcgtcttatttaaaacctttcataattaaattttttattattagatgataaaatatgaatagtagtattttatgtgtgacaaatttttttaaataagacagacggttaaacgttagacagagaaactcaaaaataaacttattttgagacagaggtaggactcatctttcttgttttccacgcatacgtttttttcaaactactaaacggtgtgtttttttgcaaaaattttctatacgaaaatagttttaaaaatcatattaatccattttaaaaaatattaataattaattaatcacgtgctaatgagttgctccattttacgtactggagggattagttcccgtcccctaccaaggaaccttaggggtggttggtaagaacaggtataataatagactataagccatctataaacatatttttaggagataagagatgatagagaatagcattggattacagatttgtagctagctgtagcacggactctaaaacgtaatatgtgtatgacatgtgggaccaggtattaatagtgtagtatatgtttatagctaactattgtatgaattagctattaaattgactatagataatttagagctggaaattggctatactattaaatttgctttaacccttctttcctggcaaaaaaaaaaagtagatcattagcacatgattaattaagttaaaaacttgaaaaatagattaatatgatttttaaaataggtttcctatattatttttttaaaaaaacaaatcgtttagcaattcagcctagtcaacctagtcaaaaaaaatattcatctaaaaaatagtttaatatgggactcaaccaagtcaacaaaaaaaattcatctaaaacatactagggtggatggactacgcttgtttatttgtttaagctctttcagacacatggccgaatgcttaaaataatagataagatttctgtacttttattcttaagctgttgtaaagccaatgcttaataaacgaatctgatggagaaaaccttaaattaatttaaaagtaaagtaacataaaaaattggatgtggtttcggtgatataaaaacttcgaggatatagcgaacccatttcctggctccaaccaatgaattgcacctttgattatgtctttcaaagggacttgatcgtaatttaacattttcattagctcctctctaaagcttttctagtatggatccagtcgcttgttcaagcctttcaaatccaatttatggatcttactttatcatgattttataatcatccatatttcaaaaccaacactttgtgtcatgctcgaaagttagtcattctttttcttgctaaggggtgaaagaaccagcgtgataatggtcctgtttgggggtgtttggggagtttataacaattgcacctggtttcagaacctccgagtaatacagattttcattaaagttgtgaaattcgtagcaataggtctatagtgttatgaaacctatcttattatcgacgaattaaattataagtgggaagtttactacagaagaaaacttacgccagaagccagcttacagaggaagccagtttacagcgtaagccggcttacggcacaagccagaaggtccaaggcttacgatgtaagcctccaccctccgcctataaatagggcccataaggtccaaggcgaggacaaccgatcttcggtctcctgcttctcctcttgtagcttgtactcaaatccagaagaaataaagcttccactcgctcatactttttgtgttccacaactctgtgtttggtttgcttgtgtgctgatcagtagaatcgactggtttctcaacacgttatcagcacgagactctaccaagctaaaaaggtaaacatgtgagaaatcagtttctactgatcatcttgctctttatgtgcaaatcattcttctgttatagttgaaataagcagaagaacatggtacctgaagtaccatcccccgatatcctctcagcaatacacgataacatgatggcggctctgccgccgttatcattcaattgctagagttgatacatcctcttagcaacgcccggtaacatgatggcggctctgccgtcgttaccgtccaaaggcttgagatggtacatccccttagcactatttgataacacaatggcggctctgccgccgttatcgtccaaatgctagaggtgatataggtgcctgaagcaccggcatggcaacttaatggacggctctgccgccgttgccgccaaatatcggaggcaaacgaaccttctacacgaccctgaagtgtcgttatggatgtcccttgatttatggacatcatccatatgggcccttgatgccgctaaggtcggctctgtcgccatgaagcgtgggctcatagtggggaagtactatatggtttatcttactttttacagtctgcacaatatgcatgaagtgcccatgtatgctcttcattttgttttacatgcttactttgctgtttgcatgactttcataacatttattttattgttatgaaattgatttccgagcatgattaataatagttaatcaagcaatctgtaatcctgaagattacttaagttaatttgctaggaaagattctatgggaaactgtgtgataatcctaaagattacacacactagtaatcctgaagattacgcatgaccaatttatgtcgaccctgcacatcgtatttacctgtcgtaaatactaaatgatgttgcagaacatgtcggacatagtaaagaaggaattcaccgagcttgccttggatggtagtaactacctcacttgggcattggacgttgagattaaactcaactctatgggtctcgatcatactattgtgttgcccgaagttggcactgtggagtctacgaaggccgagaaagaaaaggcattgcatttcttgcaccaccatctccacccaaacctgaaatctgagtatatgaccgagaaagatccactggtattatggcaatccctgaaggatcgctttgaccagcaagggtcaattgtgctcccacaggcacaacatgactggatcaccctacgcttccaagactacaagtctgtggcggcgtataactctgccctccataggatcatttctcagttgtgtttatgtggcctgaagatcacttacactgagatgatcgagaaaaccttatctacctttcatcccaacaacatagtgctgcaacagcaatataggaactcaaagtacccgaagtactatgatcttatctgagtcctgttagttgcagaaaggcagaatgaggttcttctaaagaatcattctgctagacccactgggtctatggcagtgcctgaagcacatgccaatgttgttggaaactcgcgtggccgtaaaagaggccatggtgagaagaaagggaaaggtaagtgaagtatcatattcatgggcaagagcaagggtaaacccagaggtaaaggcgaactcaagaaggttacaggtgaatcatctggggtaaagcaggataactgctatagatgtggaggcagagggcattggtcccgtaattgccgtgtccccaagcacctggttgagctctaccaacaaagcatgaatgagaaaaagagccaacatgagtcccacttcaccattgagcctgaagctcaaattgaaagcatgatgacatgcttatcaatgttaaggatggtggggacgttcgtatggacgatgattgggacaaccttcttgaaaaaagatgatgacatattcggagacgtgaagtaatctcctatatgtcagtcatatgcagtgttccgcatgactagcacatgtagaactttggtcatgaataatgctcctgaagagcacgcttagtctttaactgggcctaaagtccttgtaatgtttcccttaatagaatcaacttactccatgtttaatttcatttatgtttatgttccataaacagacttgggtgggaatcccatggcagaagaggatatatgtctagtagacagtgccaccactaacacaatcttaagggaaactagatatttccacaccttaaataagaaaactggaaatattatgaccattgccagaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgctgaatatctgctcataacaaaaatagatggatatcaaaagcaagtggtggaaaggctcccttcatcgccattgggtttgtactacacgtacataaaacccactgaggaatatgtcgcgatgaagaccatatttagaaacccagagtcatttagagttcagcatgacagactgggtcatcctgggttgggtatgatgaggaggatcatcaacaattatgctggccacaatgttgaaactaaagacttccctaaccctgaagattttagttgccctgcttgtgcaaaagggaagttgatcactaggccatccctcctgaagattagggatgagtcacctgttttcctggcaaggatacaaggtgacatatgtggacctatccagcccctgtcgggcccgtttaggtatttcatggtactgattgatgcttctaccaggtggagccatgtggacctgttgtccacaaggagccatgctttttcaaagctaattgcccaaatcatcaggctaaaagctagcttccctgatagccgcgtacaatccatttgaatggataatgcttatgagttcaggtcaaaggcttttgatgattattgtttagccatgggcattaaggtagaatattcaggaccacatgtccacactcaaaatggcctagctgagtccttgatcaagaggatcaagttgattgcacggccactgttgcaggattgtaggctgccaaccagttgttggggccatgttgtgttgcatgcagcaacactaatccaactcaggccaactgcatatcatagtacatccccccttcagctagtgcgtggaaaagaaccaagtatttcccatctgcgtaatcccaccaccacagcgtacttctatgggacccaaccggaagttggggatatacgttggttatgagactttgtccataatcaagtatcttgagtctatgactatggatcttcatacggctcggtacgctgattgtatctttgatgaggactattttcccagcatttgggggagaaaggcatccagaagaatgccgagatataatatggaatgcaactggtatgcagtccttagatccacgcgctagtgaagctgaactggaagttcagagaatcataaatttgcaaaatattgcaaataagttgccagatgccatcactgattacaagggagtgacaaggtcgcatatacctgtagtaaatgcaccggaaagagtagaggtaacccagaaggttactgactctgctcttaccccccatcctaggaagagggggagacctccgggtgctcgggacaaggttccgcggagacaaggacctgagccacttgttccactcaaagaatcggttgaagaagctcaacctgaagttgagaaagccccagaagaggcaactcaacctgaagttgagatggtcccagaaggacaccatcctgaagatggagaacccagtgccttacgcgcgcaccttggcactggaagatcggaacactccaactcggtcgttatgggaaatcacgatgagctggaggaaataaatgaggagatttccactaactatgctgatacaggagagtaacatcatagaaagaccactattgtcgacattcactttacctcaaagattgctgtcataatggatttggatccagaaccaaagtccatggctgagtgccagaagcgctcagattgggacaaatggagagcagcaatagaggcagagttgcgctcgctttataaaagagaggtttttgggcctgcagtcccaacacctccaagggtcatccctgtaggatgcaaatgggtcttcctccggaagaggaatggctaggtggtgaggtataaagcgaggctagtggcacaagggttcacgcagaaacccagtattgactatgatgaaacttactctcttgtaatgagtggaatcacgttccgatacttgatctcaatggcaactaatatgaacttggatatgcagttgatggatgtagtgaccgcatacttgtatgggtcactagattcggaaatttatatgagggtccttgaaggactcaagattctgaatctgaaaggaaatcgcaacatgtatagtgttcgcctgcagcgatcattatacggattgaaacaatccggaaggatgtggttcaatcggttaagtaactatctcctgaagagaggttacttaaacaacgatgattgtccctgtgtgtttataaaatccctgaatggattttgtatcatcttggtctatgtcgatgatcttaatatcattggcaccacagaggacattaaagaagcaatggcttatcttaagaccgagtttgagatgaaggacttcgggaaaaccaagttcttcttgggcctgcagctcgagcacctccctgaaggagtgttcatgcaccagtctacctataccaagagggtccttggtaagttcaatatggataaatgtcatccattgaaaacccccatggtggtccgatccctggaagcggataaagacccatttaaacccaagaaagatgatgaggaaatgttgggacctgaagttccctacttaagcgccattggagcactaatgtatctagccaattgcacaagacctgatattgcttttgcagttaatctattggctagatatagtgcaaccccaaccagaagacattgggttggcgtcaaaactatcctcaggtaccttcgaggtactcaagatcttgggttgtggttcccgaagaaccaatatccatccatggtgggatatgtggatgttggctatatgtctgatcctcataatgccagatcccagactgggtttgtatttctttgtggtaatactgccatttcctggcggtctataaagtagaccctagttgcaacgtcaaccaaccactcagaaataattgctctatatgaggccacacgagaatgtgtgtggcttaggcggatgatcggtcacatccagaagtcatgtggtctaaacattgataacacccccaccattatctatgaggataatgctgcttgtgttgcacaaatacatatgggctatgtgaaaagcaatttcacaaagcatattactcccaaattcttttatccccatgagctccagaagagcggggaaataaatgtcctgcaaactaagtcatgcgaaaatctcgcagatttatttacaaagtctctgccagcatcaagcttttacagatgtgttcgtggcatcggcatgagacgacttagtgaattgcaaggatcagggggagcaaacaattagcccatgattgtgatcctgaagaatcacaaacaagtcctgaagacttgatcaactgttgtactctttttcccttggtgaatttttttcccattgggtttttctcacgcaagatttttaacgaggcaacaggtgcaacacaatattcaaagtgccatgtactcttttctcctaccattttttcccattgggtttttgggaggagtttttaatgaggcatgtgcataattcaaattcgtccaagggggagtgttatgaaacctatcttattgtggacgaattaaattatgagtgggaagcttaccacagaagaaagcttacgctagaagctagcttacagaggaagccagcttacagaggaagccagcttacggcacaagccagaaggtccaaggcttacgatgtaagcctccaccctcctccgcctataaatagggcccagaaggtccaaggcgaggacaaccgatcttcggtctcctgcttctcctcttgtagctcgtactcaaatccagaagaaataaagcttccactcgctcatactttatgtgttctacaactctgtgtttggtttgcttgtgtgctgatcagtagaatcgactggtttctcaacttatagaatccagtttttttagatttttataagccggttatcaaccagatactctctaaacaggaccaatatcctatttgaaatggcgattcttttgttaaggggcgcaaagcgatggatagcacctagtctctcctaccaattggttgccacagacttgacaattagggaacaacttaaagctgaaagagttgtaccccctaaaccatggctaatgatgattcagttaaagtgaattatgccccagctttgagccaagtgctgctcctactagaggattcagactacaaatcttgttaagttactgcttaattagtacaaacagctagaacctacaggaaattaaaagaaatcgataaagagccaggacgactctagtcattgctggattcttttgttaggtgctgctttctgctgacctggaacaaaaggattgatgtcctctcttccaatttgtttttttttttcttgtccttcctataattcgtttcttcggaagaaagcaatatggacaattgcaacacgtctccaatcccaacagcactacaaactgtatctggctatgcaatacgaacggtctagtttaggtcgatagtgtgaatggattatggggtgtgctctggggtgtggcaaaattggcgtgttccatcttttggatattggttgtttcggatagacctgttagtttttccttctttttttttcgaactttgggtgtctgaatatttttatttaggtagattttttttggaaaacatgtcgaaaacatttgacgtgtagaacatgattttatcgaacttttaaaattttataaccattaataattttatatatgattagttttcttaagaaaaaaatgagttgctccctgaaataattactgctataaagtagtagattttcgtaagtatccctaaaccatacagacggttcgatcagaagggaaatcgcctgggcgtcggtcaagaaccacctgcaaacatgatctaccacatgttaaaacgatcgaacttttattggataatgctctactctgggtgaccgatgcgggggagccggatcgggcgctccccggcgcgcccctgccccacatgcgtatctactggacccacctacttctccttccttttttcacaaaagatgtttcatctagtatatttacaatgtttcactatttatacatctaatgttgcagtgaatttaaatattcttttgcaacaaaaaaacccatatattttagaaactctctattaagggaatttggtttatttttttgttccatcagaaatgttttacctaaggtactcacaatgtttcactatgtatagatctaatgttgcagtgaacgaaacattccattgcaacaaaaaaaacccatatattttggaaaccccctattaagggaatttggtttattttttgttccaccgaaaaatgtttcacctagtgtactcacaatgtttcactatgtatagatctaatgttgcagtgaactgaaacattctttcgctatttgctgaaacattgtttttatataaggtaaaacaacacctgatttaaacgagtgaaacattttcgatctacttagttaaataattccgatatacatggtggaatatcgtgcaacatttaaaaataatttaataataagctaattttttttcgtcagaatatatccatgtgtggtcttgttttgaagatttaattacaataaatttaatggtataatcggatcatgatttgaataagtaatttagaagaaaaatcagtttaaagtagtgttacccgtaaatcggacgccgattttactacaaacggataggtcgcccgagctcgtccacttttatttacacaagcggccgatttcattatccgcctatatttatgttaatcactattattaccccagtgaacggtggaggcaccgaggcccgagaggatcaaggttattttttttattttctgtggttctggtttttgtgtgatgattttttttccgatacgtactaatataagctgttgcacgtaggggctgatttagttttcatgactttgagcatttcgatgatttcttcttagaaaatagatttttcattaattcagtctctatatttataaaagatatacacagccaaaaaaaaaaacatgcacgagttcttatactccaaacctcacacagagcaatacacgcaaaacacaaaagaagaaaagctagaagacttaggggggagtccctatcacatcgaatgtttagatgctaatttagagtattaaatatagattaattacaaaaatcattccaaaatcctggactaattcgcgagacgaatctattgagcctaattaatccatgattagcctatgtgatgttacagtaaacatttgctaattatgtattaattaggcttaaaaaaatcatctcgcaaattagctctcatttatacaattagttttattatttgtctatgtttattacttcaaattagtgtccaaacatctaatgtgataaaaactaaagtttagtctctggatccaaacacccccctaaccctcaaccttcattgatgagttattctattcgtcccagcatgagaggggggaataggagaaacggaactagtcagtgctaattgtcgtcgcaccatctccgcctctatagaactcaaccaccaattgctgccaactgctaagtctgttttctgtcgtcgccattgaaaatccccttatgcggttgctgcatttcgaacggccatagagcaccgggaagccgcttgccaccctaccaccgtcttccgcagactattgaactcaccatagttcctaaagcatcgtggaaccatccaacatgatatacaccttgtcttttctgccatgagcttgctgaaagatgcattgttgtcattcgcacctacctgtaaccagaccttgacgccgacactcacgtgacagttgccacctctaggacgcctccgtcaagagcctccgttgccatcgtccttatctgcatcagtaaagtcaatggccatcgcacaccatcaacccagcctcgtcacggagccatcgacgaccatcgtccactgccctcgcctgaccatggtcagaacgtggcaccgaagctcaccaagttaccgctgcccctaggacaccgccgctaagaacatccaccgccatcgtctcaatctaccgtggccgaaccaaccgtcaaccacaggcgctatgctgctgacccgccatcacaggtgcagggctagcctccaccgttatccgtcatcgccagtgtctgagtaagagaagaaggactagtctcgttactgtccaacactaccatcagcatcctcagcaccgccaaccgccaatgggcaccatcgccccgccattggcgcctccattgccacgctgccaccatcgaaaaaataaaggtatgcagttccattagaaaaaaaaaatcaaaatcacctactcccctggttctacaatttcttacagttttggataataacatggtctcgatgctatattttttctattataatacatacaatttgtatatttattacaatatttttagacaaatctatatacgtcattcaagtgtctttaagataaatatttttaaaattattgatagttaaagttataaaagtttaacattaactttatctaaaacatgcagaattataaaactggtgggagggagggagtattccgtttgagtgcaacaacgctagacgttcgttccttgagttcaatctccgattggcgcgcgcgggaaaatcacgcgaagccgttaaataacggcctcacagcgccgctcccctccctatcctgcgtcccagtgcccaccactcatcacctcccccctctcatcctctcctcctcctccaatggccttctcctccaccgccgccgccgcctccaccgccttcgtctctgggcaccgccgacgcggcggcgcgtgccacctgctgtcctcctctttcctcatcgcgttcccgcgcgccgtcgcggcgaggaggtgcggcgaggcggccgcggcgccgaggagggtgggcgcggtgaccgtgcgcgcgcaggcggcggcgggggcggggaagaagagcgtgctgatcgtgaacacgaatggcggcgggcacgccgtgatcgggttctacctcgccaaggacctgctcgccgcgggccacgccgtcaccgtgctcaccgtcggcgacgagggctccgacaagatgaagaagccgcccttctcccgcttctcggtaggtaacattatgggggttcgagggctcacggcggcgatggtgaatgaatggatgcaattaataatgcaggagctgacgagtgccggggcgacgacggtgtggggcgacccggcggacgtcggcgcggcggtcggcggcggcgcctcgttcgacgtcgtcctcgacaacaacggcaaggacctcgacgccgtcaagtacgtcgcctccctcgattattctcccccctcgctccgagcaagcaggcgnnnnnncnaaggtgnnnnacgcgttcccgcaggccggtggtggactgggcgaaggcggccggcgtggcgcaattcctcttcgtcagcagcgccggcatctacacgcccagcgacgagccgccgcacgtcgagggggtaaagaaacataacaaccagattcgccggaggattggctcgatgagttgagttcactgactgactttctccggccatgtcggctcgccggcgacgtgcaaatgcaggacgcggtgaaggagagcgcggggcatgtgggcgtggagaagtacatcgcggagcagttcggcagctgggcgtcgttccggccgcagtacatgatcggctccggcaacaacaaggactgcgaggagtggttcttcgacagtaaaatcacccaaatccccccaaccaaattctcccaaatttcaaaccgccccaaacaacattcttcaatttgaagacaaaattgtcaatttttttactgtagtcttttttaaaactatcgaattaagacaaaactgtcgattcttttttctttaacttttgaactatttcgaaatatgaataaaaaattggcaattttttatgtaaattatgaattgtttgaatttgaaaacaaaactttcaaatttttaactgtaagttctgacaaatccaaattatgaggacaaaaccatcaattttttttttgctgtaaactttgaataaatccgatttgtcaaattgtcggtgtaaatttccaagaaatattcgaattgaagtcaagttatttttttggtttcaaattgtttttgcagggattgtgagggggaggccggtgccgatcccggggtcggggatgcaggtgacgaacatatcgcacgtgcgcgacctggcgagcatggtggcgctcgccgtggagagccccggcgcggcggcggggaggatcttcaactgcgtctccgaccgcgccgtcaccttcaacggcctcgtcaagatgtgcgccgccgccgccggcgcccagccggagatcctccactacgaccccgccgccgtcggcgtcgacgccaagaaggccttccccttccgcaacatggttagtactactaaccgttttttattcatgcagcggcacattgctattttgctcgaataaagaaaatgtgatttttttttatctcgggggaatatcggatgaaaactatcggataagcaaggactcatctgtcttataaaaaacccaatcctgaggatgtatttggacaatgtgtatgttcagatatatctttaggattgaattttttttagacgcaggaagtacgtgtgaaaaatagacttagaaaattttttgaatctattcatttcgcaggaaaagaaacaaattttagacgagtagagttcctttttcttacttcaaataaagtcgaggttggaaaacgtggttcattcttgtactgtctctagtaatttctttttatataaatttagaaaaaagaacttttaggcccgattcttaacgggttttcacccgatattttggatgtgaattttatcttgatatcgatgttttttttcccaaaaaggatgtgattttgatatgttaatggttgtgtgaaaattgttagcacttctacgcggagccgagggcggcgaaggaggtgcttggatggaggagctcgacgaacctgccggaggacctcaaggagaggttcgcggagtacgccagcagcggcagagggcagaaggagatgagcttcgacctcgacgacaagatcatcgccgccgcctaacaacacccatctcatctcacctcgtcatggtcaaatacaaatacaaagtgctcggggatctcttcttctcgtgatttattttcttctccctctgtttctttggttcctcttctcataccggaagcatagagaaatgcaaaactgaacaattatatatgtaaatgctaggaaaatgctgttacaaataagtgaataagatgagttttcgcttttcgtttttcatttttccatcacatatccaatatgagaatggaactttgcagagtcaatcagattcagcacattttcttggtcttacctcttttttgtctgaatatatagctgagtaattttgtctaactattcgagggtataaaaaatgaattaactattataaagttgaaaaaatggatttgaacagtttcataagaaattcatatatattaagttttcttttccgaaaatcgcatcgtttataagcgctggaaataaatggttgcattccttaagaacagatactcctcaacaagatctgtgttgtgaattgttcaccttgactcgttcttaacaactgaattcaactttgattctgacagaccagaacagacagcaatgctgacaaagaacatcaggatttctttaccccctttctgcaatattcttttggagaccagtgctcacgaacaagccaactcagaaggagcattgcagcacattgatccacaaagccttctttgatttcaggtatttttgcgcacacacaaggggcaacacaccagctgatactgcatggtgtaaaaagaaataaagaaccaagaggactgataatggtagcagcgagaatcaattaaaacttacaattccagcgattctcgacatttccagaactaagattggtcccatctcgacatttccagaactaagattggtcccatcctaggtagtaatatagggcgatcggaactactgaagcatcagggagcacacatacgccgaaatggtcatgtttctgaaaccactagcatggtaaaagagagcatgacccctggccctgatgcttgaggtgcggtcatcttgaacttgggtcgacatggtcgtccccgttgctccagttctcatgccaggtggtgaaacccgttgtaagggcctctcgcacccatgggtaacggctccgctccaccgcctcactgagagtgagccaggtcctcttgcgggtgctctgctcgggccaggaggcaagctcttccttaactcgaagcgcgaacaccgcagctctgcacatcccctcggggcagaacttgtcttgatgcgtcttgctcttgaagtcgtagaagcccaataattgcttatgcacagaaagaatcgcaaataagtagagtttgatggcagaacacatggaagggaataagtgatgttcaataataagccacacgcaagccacaaggactaaggaatcacagaatctatttaaacttggctacacattaaatgtagactatgcaagtacaacctagcgacacaatattcctttgacttagcttgctttcctaaataaacttcctataaaataatccatttataatgcaagattcaggtcaaggtttattggctgcactatgtcgtgtgctcttatgctctgtctagtaccaatagtttcattaaactttcaaacaaacaacttgaccagatgtgcaaatgagcaaaatcagtgtcaacacagtagcagagtagccagcattaagcagttcaggtctggattacaatctaaagtgcgagttagcaacacaagaatcctcccttaacttacaagtgcccttcaaagtttgtgtttactgaaagtccaacaagtgctatttacacaatgaatcttataaaacagtatacaatgatgaggtccaaccagcttgtttgttagtcaagtggcacctaacacttgtcaaatgaccctagttctttaatgcacaaaaaaaaaggcctagtaaagaacaagcagcgttgcatattcatatgctaaagtatgaacatattaacacttaacaaaatggatgctgactctgaatgaacagataaggccggaaattccatagcccagactcagactatgcttaaggatcaattttcaggttaagtgaaggacacagctagttatcagaaggtagtaggtctccataggaaagaagattatatctaattgtctatataaaacacaaaatcgcatgcatacctcaaaaaagacctgaggtcttggacacaaggttgaacaacaaacatatggctataggatataataatggggcttttttctaagagaagatcaaaaagtcaaggtaaaagtgccaaagggtctcaccactaaatctcctcgaactccagcttcttcaatagcttcacgagcagctgcctcttcaacagtttcatcattctcccatcctccctaaagcagtatggcacatcaaacaaaagaccgcatgccacagaatcatgtactatataataaacaaacagatatatttatcccaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttacaaatcaaggaacatatctttatgtaatggtagatggataacggatattggattatagcctaaataatttcccatcaattactctggaaatctaaagcacaaacagaataacatcacagatgttttcatataccatgttctgagaattgagtgactcttaggcatagatgtttaaaatgttaataccttaggaaataggagaccagatccactctgggagttgatcatgagaacttccacaagtttcttgtgtccatcatcagaagtttcatcattgttatctttatatctaaaaggtatgcacctacatatataagaaacaagtatcagatgaatttaaagcatgacaacattcttctctagggtctttaaccatgttgtcttacagcaaagataagagcagcacgctcacagatacatactaatgtagacagtactgtttaattgagttcataaaatcctgttctgaagtgagtttaagtagaagcttgactatcaagcactattcagatgagtaataactttactaatgttggtaaaatgtttaactgctactccaaataaaatttgacctcaaattttgaaacaaataaattaattctcatatagcttatatcactaacagtaataagcacttaatgcaacaacaccagtatttggaacattgtgacaacaggacaaagcagcataaacaacaggtacaaccagctattctcctagttcggtttttagtctccagttaatacaaatatcatttttcgtatttgttaatacaaatatctaactgcacacatgggaacaagaggaccctggggtcatctctatgatcctgaaatccatctccctgtgcccatctcacacatatctatgtttttatcaccactttcttttcttggaaaaatcaaataaaaatggaacctctcccttgaacaatttaagccaaagggataccaagtctgcacagcaccttctgacagtgctcataaaaggcacaaactaatccacacctgcaacaagagacatccattatcctaaaaaaaaaaaactctagaccctccaaactgagcctagaatccttatccgcgaaaatttccctatcgacgccggcccaccaccgatgccgaatcaatatcaatacaaatctttaccaagattcacctaattgatggcacatcctgggaccaaacagagataccccaacctccctttttttccccacacacaggcacaccccaatcatgtggagccggtaaagaacaaagcacactgagaatcagtaaagaacagaaaacgataagcaggtcgccatcagcaggtgcctacggatgaattaaaggagctaaattttaatggtagccctgctcactgttcattgattaagaccaccccctcccctcctcccataatctagccaccaaatagtcctcctacttcccctccacagcagcagcagcagcaagaggtgaaaatttgattccaatcaagcagcatatcaaaacaaacctaaattacggcaagataaaaataaaagtgatattttttcttggtggtgggggatacgaagatgatgatgatgcaggaggaggagaggaatgggggagtaaaaattggggctttgaggatgtcccacccggccacgagtcgacgcccatgctcgtagcgctgctggtgccgccccgttctcgccaccaaatcgcacatggcttcttcctgtccccgccgccgccgccactaccggaaaccgcctccgccgccgctcgagagggagagagaggggtagggttggtcgccgccggcgacgagcaatgcggcggaaggaggaggaagaaggggagggtgaggggctcgagagatgtgcgtgcgtgcgtgcgcctaagcgccttgcttcgttccttcctgggtctctcgctgttcttgccctttttattttgggaattttttgccctgttttggtcccctttttaccccctttgtgtagcttttttaggactttttctctggtttctatggtttttggctttggtatgtggttttggtttggtaaacattttcaacttcatccctctttccaactcaaggttgttctctgattttgtaatacaatgtgccgtttagttatgaaagtgctttaccgcttccgtctatgtcggttgtgtctttcggtttaactcgtcgacaatatattgtttggaccgatttacggagagcaagaaaacgtacacggtactatgttttaaaggtattgctttacttgaaaaataaactaaataggttgagcgccgttgaaagacgccgacaaatcaagtctcacacgagggggaggaggcaatgctatgtaatgcttcatcgtgaaaggaaaaagaactttacaaataataccttgataaaaatttttgttttcattttcgtcacgttttctgtttaacttggcgacgatgtgctttagcggagcaggcgtgtgtgtttagtatcgtgtgttgcatcatatgaaaaaaaagtaaatgaattggtcgtacataagaaaagagtgaaatacatgactggtccctaaagttgtgtagtggtatcacttaggtccgtgaacttgaaaattacacgtttaggtctgtgaatttggtttaatgtaccacccggtccaaacgtcctttgactgcgtttgatcgctaacgtggcatgccacctaggcaacacttttgctctcagccccctccacatcacaacacgtcgcatatatcttcttatagttatatagtgacaccagaatcccaaaaaaattctcacatcgttcttccatctcattcttctccttgcatgtatagaaaatgcggttctgattagcaattgccattgctctgcactccaaaataaccttatccttgcgcaacgggcacatgattaacaacactttcttccagcgacttcaagacgaggacgagcttggagaatccatgggatgcctagcgcgcaagccgtattgcactgccttccgccgctaatacggccgccttgtgctaccgctaaccccactgcactgcgctgcctcctgccactaatcgcaccgccgaggccaccacagctgctacctctcggcctccttcccctaacctcaccgtcgaaaccctagccgatttagggatattttgagggatttgggttgaaatgcacactggtcatagcaagttatgtgcgaaagtatatgtggagggggctgagcacaaaagtgttgtctacgtggcacgtcacgttggcagtcaaacatggtcaaaggacgattggaccaggggtggtacattaaaccaagttcacagatctaaacgtgtaatttttaagttcatggacctaagtgataccacccctcaagtttaaagactggccatgtatttcactctaaaaaaaatcggctctaacttgaagtgaggtttttgacctcactgaacttgccatatattttaggcaaattttgctacaggacattgtaactgtgtgtatttagctcaggacaccgcgaaagtgaacttttgggggaagacatcccataatcgtggatatttgccgatggacaccgcgccgtctcctctccacttgacgtgctgacgtggtagacgggaggctgtttttttttatgcggtcggacgtacataacatcatatgaatacgttattctcttctgcttcattagaatccgtttgcaaagggtctacaattacaagattgctcaagcgatcccatgtgggctcgggagtatagacactatattttaaaagcaccacatggataccttgatttctcaaaatttacaattatatttttattctctataaaattataaaaaaataaaactatatgagttcataatggaagtctattaatatcattttcatatatcaaatactaatatttttacttctattaatgaaaatatttcaagttggacttatctattgaggaggattgaaatgatgttagaatttcacattttacgcaagtgtcctcacttccatcgatttgattaatcgaacacttatcagtcaatatgtgcacaattaacatatggtaacgactagaagtttatattctctgccaaatcttcatcttttgagtcaatatctcgatcacaatatctcacttatcgatttctcaactaaatcttcatttaaattgatcttcaacccaacccaacacaagttagtgaaagaaaggtaacagagtgatcaccatcctcaactaataagtgtatatgttcggttgtgtttttcagtttaattcgtcggtaatatatcatttggctggatatacaaattaaagtgagagaatacgtgtacgtggctttcttttaaaagcattcttttgcttgaaaagggaaattaattaaataggttgagtggtgttgaaagacatatacaaatcgagttagacacgagagtgagaggaggcaatgctaggtgatgctttacgatgaaagaaataaaatctttagaaagaatgctttaataaaaagttcttttttaaaaaaactttcgttacgttttctaactcactaacgatgggctagttgggtactttagcaggtaggggatgtgttcttgttttgtgtttgaaaagttttgcttcatatgaaaaaagagattaaatgcattgatcatgcatacaggaacaggaagccaaacgttttcatttatttcatttaaggaaagtagggttgttaatctgtataggcccttctaaccctagctcgaggagtgtcttttatgttcatatcttgtttttaaccaacgaaataccttcataagagcactataacattttaagaatcaataaatttttaaatggaccaatatatacaatctttgaatgggatttgactttggttttaaggtttggcaaaaagaacgaattggctctcacttgaagagaggaggttttggggactccaaaactagccaaggacagctttgaaaggaaataaattcaaaacacacgaatatgaaaaatatacccttaacctaactaaatttatattgaaatcacatccacatatgtaagcactaggatttcattaaatgtagtgggtgagtaatcatacgctgacagctctatcgccataccttttgtggggccagtcagtgctgagaggtatcaatatgtaacgaggaagattattgtctatcagtgtgagctcgaggggtaccgacagatgttagataacaacatgctcgatcgtccagatgtacgttcactgattaattttcaatttgtaacttagttgactgctcgatcgtccagatgtacgttcattgattaattttcaatttgtaacttagttcactgcaaaaattcgtaacttagttgtctgcaaattaattaattaaagtatttgtataaaagaggatatatactatttttataatgaaatgatagaatagaaatatgtaacagtccaaccgttgtataaaaaaggatatataatatttttataatgaaattagaaatatgtaacagcccaacccaaccgacgggtggggctatttacacttctatccttgcttcaaaggcccaaacgtccccgtcgtccctatcggtccaattcacctatgtagccacacgacatataggctgacgggtgggcccacttacccacgccaccccactgcctataaagttggatctgagaaatgtgtactaaacatactgcgagggtcggctctgagcccactaaacatactgcgagggtcggctctgagcccaaccaatggacggataccactccacttacaggctctgagcgcaaccaatggacgggcctacgaacctacttatactttcgtcctcgcttcgtgtaaaagggttaacctagaagtgatatgattggaaggaagatgtcttataagttggttccaaccttgttaaactagtaaggtggtactaaacatgagcacataactcaaggtggtactaaacatgagcacataactcaaggtggtactaaacatgagcacacaactcttataagccacacaggctaaattctaattggactgggatattaaaaaaccatactggcctacaatggtaataagctgtctgaatgatgatttcaattatgttccttggtaataatagtacactataattgacgatgctacccaaaattcaaccatctccgcgcttgttcatcatttggccggatgctttaaccgtgattatcctgtgaaggtgaatagtatagtccactatcggctgcaattttttccatgtcatgtatagccaacacgatgggctgtaatgcatctgccattttacttcagcaaatgatatttaattctttcatttatcattttctctctcctttgcatttctgttccgatacccatgggccatggggcgtcgtcgagcagttcctcccgcgcgtagaaaaacggaccccactttttcttcaagggcgcgtgtaggcgggcgacaatttagtcgcacgctcgtcctctctctcatccgcgcttagcaccaggtcatcttccgaacctacgtggactgcttatagccatttctagttctgtgcatgctctaaagtttaccccatacccacacggcatgtatatccgactaggtataagggtaccatatacagatagaataaatttagtaaaggactcggttgttatgttaacttgtgtatcaaggaaacatccgatagttctagtcggttacgattgtaatttatcttgtccgttaggaacatgggttgtatcttgtaattccggctcctcctcctatataaggaggggtccgggtgcctctaggggcataatttttctccctgatcatacgatcaataatacactcggcggatcaatccccggacaggagtagggtacttctcatcgagaaggcctgaatctgtataaacctagtgtctcctaacccatctacttttccagcttgatagccaccccttttagtattgccaaaatattgtttcgacagttggcgcaccaagtaggggtagcgtcaagttcttcgccgattagtgcaatgggatttgtttcgggcatcgacgacttcgccttccctcccgggcaggcataccgatttggcagcctcaacttcatcaccgacgacttcgacaatatttctcttctcggctcagattcgaaccagtcgggaggggatgccatctttgctccattatgtctcccaaactcggctgaaatctattctaagaccatctcatctgagttggattcaaaccactcggatgaggtctcgtcaacttcttcgcaatcaaatcaaggagaggcaacttatccgtcaatcttgatgtggcttcccgacgatctggctgctgtttttactacaagagcgtcttctccccgtaggtccagattaaactcggcttcgacctcagttcaatctggctctagggaagtcggcgtgatacttcaacgactcggaactcactacaagaggaaccctctttagcaatacatatatgtattgctaaaagtctctataagtattgctagggtctgcaccaacgcatttaatatgcgttgcctatgctgccgttgctaggatcaattacaacacatagacaaccgttgataacaagtggaaataagcgttgctacttagcaacaattttaataggtttcagcaatacttatatatgttgttcccttgagagatgaacagttttatataatcttagcaatggatataatcaagttgctgcaacatgtacaaatattgtaatttgagctatccactgtaggtggcctttgaccaattattttgtcaggcaagagacccatgaactcaaagcatgcacaagtgacaatagtccaatcaatcatgataatcgattatatattaaatatagtattttgcattacatagacaatcatcagtataattcatggcattaaacctttgttcagaacattaatgcagaaaatagaatctaaagtatataaaaaaaacacatcttgttgcccccattctccaccttgcagccatcatcattccgtgacatgtacaggtgacctagttgcgtactagcagtcacaaaatttcccccacatcttcacccatttatcttgtcaacctataatagaaaaaatatataagcattaatataccattatgaagacgaaaagcacatctccgaagtaagaagtaagagataggaacatataaaaattgcaggccacgcaatttcaagtcctacaacatgaccaacaattttgtagcctttgtatggcctaatcaaatcttcggattttgccaatgcaagatcgacatgaaccattaaaaattcatttcctagctcaacacctccaactctgcgtgttggatcacagcttacaatagtggcaagagccacgtttgtattccgatttttccaactttttaagaatactttagttccaacctgaagtgcataatacatccatcaatattatcaatatactttaagaaattcaagtatcataaataatttcacagtaaaatacctccattgaattgtcagtgataaagtccattttgctgcactgttgtttctataaaaaaaaattggatcatggtttgcaatttaaccacaagatagaaagaaagaaagaccaaacagagccaattattgttctccaattcaatcataatactagtgaatcatgcatgttatagtttgaatggactgatatttgtaaacatggtgaataaaaaaacaaccttgtatgcaccaccaactttatgtgcatgtaccatatggctgtcctgattgtcaggtttcttgttctataggggagggcaacaaattagtgctaaaattatatatattaagaaattttactttcaaacttttctatcaaataatttttgaactcaataagaagtgaaaactaaccttggcacaaataatctccatctgtttcccatggtcatttaggccaaaggttcgtttgttctagaataaaagaatacatcacattgtcatgaactatagtaaacattcatagttagttacaaacaataccaaataatataatgctatgtatccatgataaccatataataggatgcaaccatggtgagttcagaataaaaatataaattgaaagacaaggaccttgtgtgcagtagcatgcttggttggtggtgtcttatcctcatcttgagcatggctttgtgaattctgttgtcaaagagagcatatattcccagttacaaaatagtgcaactattcccatgtataaaacaatgaaatttatgtatattaccatcacaatgttttcctgttcaacatgacaaatttcttgcaagggaccgtcaccatacactttctatcacagtggaaaataaaaggacattaagaccagattttattaaactatttagactaaaatgttagcaaggtttaccactgttgaattgtcagttaaaaagtctattgtgttgcattgccgtttctgaaaaaatagagagaatttacagtaaaaaccaacatgctgtgtgtgctattttagttgttgtgtagtgttcaataaacagaaatagcattttgaacttgaaacaattagactaaccttagaagcagtactatacttgtttaggcttggtctaacaagcttgcgggtaaggttctctttgttctgcaatacaattattataactagtaaatcatgtgtgttatagtttcaaagagcttatatctgtagacatggtgacttaaagtgatgaaaaaataaccttgtgtgtacttgtaactttgtgtgcattcaccatatagttgtcctggttgtcaggtttattgttctacagtggaaggtaacaaataaattttacaaatctatatatacatttatatatcgaaattaaactactttcaaacacttattgactatggcattgagtttgaaaggataaagagagaacttaatcaactcaccttgtatgcactagaaatactcttccctggttgcataagctcattatggtccaaatttcctttgcgctgcaatggaataggtcataaaattggcacaaactataatgttccaattatttgtttatgtttgcacaggaagtaatcttcctttgcttcccactgtgattctggcccaaagactgtgtattctagagtaaaagaaggcatatgattataatgaatgctatgtaaataatagtgaatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttatttgtagatgctccatctaaacctccctgtaacttcaattaggtaagttagatgcattcattgggtcacacacaagttcatataatttttttaagactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctggttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtgggttcttctttgcaggatctttttgtctctatggaacacatgaccaaatcagtaaagtcctaatagtagctatacatgcttgaaatggaaatagatgaatactattcaagacatgttttaccatctcttctcttgtgcgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtatatgtaccttcgatttctcgttcatccaatgattgacaagagcaatccactggtcagaaagcacaccttctgggacattgttgcaattagcttccttagtctcattcacatcaaaatacaaatctttagttttgctttatattgccgccatctttctccaattttttttaatatgaactcttccatccgaggagcataaaggaatctcatctacatatagcaacacagaaactcatatggccatatggggatatgcataacataatacaagaagttagcaaaaatgttgatctgaaaaggaattacctttact

SEQ ID NO: 58508 - DNA, 30557 bp, Oryza sativa
caactcccagtctcaagcattagaaagcatgccaggtttaaaaataacagcccaccagccataccaggcttaaggtcgcggtgaaaatatccacgctgatgcatgtgactcaaagcttgaaatatctgaaaacaccaatttcggacttcagtctctgaaaagggcttccccctgctcttcatcagctggtagagattgcattcctaaaatcaccacgtaaacagaaaaaacttcaatcacttcagaggtcacaaatgccaaatcaaaagcgtctaattaagaaatacaaaccatgtattcaaaaacaaagaataacatatcattctcccttatgacttccttgagtttcacaatgttcggatggttcatccttcgcaaagactgggatgcgcacacaaaaaaaaaatatattaatgaagtataatagatatcatgatcaaacttgattacatgttgcataataaagcaccttcacttcacggagattgatgcactcctcccatgaataatattttttcttcattttcttgattgcaacctgtcaaggccagatatgttaataatatgtcaaaaaattatgccattgataaggcagatcaagtcactgtcacttcttttcataagatagatcatgacggtaagagttagctccagtttaattcagatttaattactactaggtacaatataaagtaatcacctagcatactaaactccagtgtaccaataaacaagcagccaaactgcttagctactgaaaaaaataataagtcataacataaacaaaattacaaatattggggcaagtagagtggcataccacttcaccactctctttgttgatcgcgcgccaaacactcccaaatgttccgtcaccaacttccttaataatcttatacctgaagcatgatgcaggaaagaagttagcactcagcaggtacaagctcttgaacatctgagagagcccttacacacacatacacacacacacaacatctgagagagaaggggtgttatttacctctccatttttactagctggagagtaaagctggtcttattctagaagagccctgttgtgaacaagactcatatgtgtattgctgaaatgcctttgaagggtagatcagcaaagccactcaacgcttctggaaaaactctataagcaatacccatactctgacaaaaaaacttgaacaccttcactctgaaagagcaacaaatagatcagaagatttggaagaaataaaaaatacaaataggctgagtaacataataattacatgtaaccgaatcatgaacaatgcatgtcatgtagaaatttcaagcataccggtttgttacgccatcaaacacaaagcctgacaaagaactgcgtagtatgcaccaaatcttgggatgatcaaacaaaaagcaagcagtgtaggggagaagagagcaaacggaaagtaagaaaaccaggacctgctgagagcaagaaattcatgagaacaggaacacatgccatttaaatatcaggcaattagcttctcaaataaaagcatacctagagattaagcctgacaatgaagatctaatgtcagatccgattgtccaaagaagttccgatggtaacttttgctggctgatcagtgccacaacaaaaactaccggaaggatgcaagaggatgagatgcaccatgctcgaagaaatgtgctacagctgcactgtaatcaatagtcgactctaatgtgcaatagcatgggaccaggcaagacggctgctgaatgaggtgtgatcttcaggtgcagttgacaaaagagataacgaggaagtctccgtaaagagaaaacctccagccaagaacttcctcgagcagcgaaatgtgcaatacagaggaacttgtggtgtagagggtgtactccatatccttaatgagaatgctagagccctggcagtgcacggtgttggaacctgcaaaggcatgcaaaatgaatataaataagcagcaaagcaatggttgaaaacatgtgtcagtgaagtaacagggaaaaacatagtcaaagtgagaagagggcatttatcgattcatgctaccaaggagcaccaaagcacccatgaaattagacgtcacatgcatgtgccaattcatgttacctacaagcatcaaagcacagagcacccgagatgcactaatttactttcgtcccagaaacactatgagatttgagtctatggatgcatgtgccgtgaaacaacgttaccaaaattaacataggacctcaacagtgataaattgatactacaccatatctattgattgcaacgaattgattgaattctcgcttcctgcacaattaagacagtgatcttgctacagcatacatattactggtaccaacatgatgccaagtgatgagactagacatgaaaaaagtattgagaactagagtaagtttataatcagttgccagtaaattaaacatcagacgcataacatgtgcaacctagcataaatcggcatgatggatgctcaggaactgcgattcatgaatagacgtgaggaatatccgtgactgatgaaccctagctcacacacatcggaaccaacaactcctccaccaaatcccgtagaaatcatgatgcgccaatcccccaaatcaaccctgctaaactccctcgaaattcgaaccaaaacaattcatccacccccaacaaacccccgcaccgatccgaaattccgaatcaatcacccgatccccacccccacccccacctcccccggcgcccgcagcaaccaccgcgcgatccccaaatcaaactcatcagacaccccaaccatggcacagccaagccacgcgtcgattcgattcgattcaccaccaccaaatcagcccaaaattgaatcggaaagtgggacgacgagcgagcgagcgagcgagacagacctgggtgcctctcggcataaccgtgcgccaccgccgccgccgagggatccaggggacgccgccgccgccgcctccagcgctgaagaggggggagggggagggggggaagggtggggatcggatggcttcgtctcgtctcctctcgcgtcggggatttttttttcttcctctcgccttcctgtcctctcctctcatttatctctcagtcgtccaatgtggcggggcctttttgcgatacggtccctgtactactcggttatacctagtccaaccttgccgcgttttctttgttctttactcggagtagtttttttattttattttatttattttttttggaatcgccttgcggttgccgcggtttcagacatgccgctttatttgacgtgtctccctgttttgagtgtgcagagaaattaattgcaaaaatagtgttttttgacttgcgttttatgtgtttctttaagcatcagatagatcgactttgttctagttcattgattttagttaagtcatcttattagtgtttttttttctggttaagatgttaaggtggttgttcagctcacttagcatgtgttcttttgttgcatatgattaattaactattagctataaaaacttgaattgattaacataatttttatagcaacttttctatataattttttaaaacatgccgtgtagcaatttaaaaagcatgcatacaacgaataatggagcagtaaatgagaaccatgagtagtagtaggtctgagcagacccttagtaaggtggtgtttggatccagggacttaactttagtccctatatttagacattaatttagagtattaaatatagactacttacaaaactaattatataaatgaaagctaattcgcaagacaaattttttaagcctaattaatccataattagagaatgtttactgtagcatcacataggttaatcatggattaattaggctcaatagatttgtttcgcaaattagtccaagattatgaatgggttttattaatagtctacgtttaatatttataattagtgtccaaacatccgatgtgatagggacttaaaagttttagtcccatctaaatagggtcttactttctttgtgtgcgaccattttttttatgtttcttatcacacgacatatatgcatatatacaattaactagcacatactcctctttttagtttatttttctaaatcatttattctcaatatctatgattctattgatcacatgaatttatatttattagagtgatccaaatgagaatatgataacaattattttgaggagacgacaataattttcttagtatttacggtagtagagatttgtttctattttttttaagaacggaaggagtattatattaggttaaagagttcgagcaaacatgtcgaaagatcgggctacatgttatagccggattatcttgttatcttagtcggaaagtcaaaagcaagatacgtgagatttgagaaccgtcatttgaccatgtcttttaagaaaaactcatggtagttatcatgttacactgtggatcctaaattgcctatccccacacttgaattaatatatttttctctttctcttaacagcattgagcttgaataaatttccacttttactatacatgaagcaattttgtccctgacctgaaaaaaatataactttaaataaacaatttagatgtggtaatgatctactccttggtaaattaataacgggcaaggtcagtgtgcatgaccaaatatttggtctgattaggtgtccttccagagtggcagaattcgttcggtccactactggtccatgtccctcttgtccaagacacctaattaaactaattaacaaatgctattaatcgtgattagtacactgcatgggcatcagagaaagcaatgggtaccgacttgcgtacctaaaatgcctaatccgtatcgctgtaaacacaatgtattattggtgccacggtgattagtagtaggagagatttttgcttgaagcaaaaaaaaatcgcacatggtacgtgtggtcgtgggtgcattgcgaatacattaattgattggttcatgatttctgtctatctcaatccgattgttcgtgcttatatcgatttagagcaaggctaataatatagccgatatgttagctataaggttttttttttgtcttctctcagcctacttacaattaatatagttagctctttacaattaatataggacccacttgtctctctcacatggtttattggttcttatatccaggccgcctctaagtttacagcccgcttctcctctccctcctctcttctctcctctacctcggcatttagccgacttataacctattattatattttcttataggtgaatatcacccacgatttaggacttgatcggttgtgctagctgctgtagctgcaacaagcaagccattcacaactgccgcaaagctctttggtttggattattggggctggtgcagcagcgcgccagcccgcactttcgatcaggaccttaattacagtggtctcgttctcttggacgatgttaactctaaaaataattatcacaatgttgtctctttcgtgcgaatagtgttatcttaagattatgttattcctcctctttcccaactcacattcatttttttcgcatgcacgtttttcaaactattaataaaagtttttttatagaaaagtttactgaaaaaaatcatattaatccattgtattaaagtttatttcagttaatacttaattagttatgagctattacatggtttgttttgcgtgctgaagagaagaggttcccgaatacagcctaagggccaagagattaaaattttgagaagcagctggttagtagctggcttctgagagtctgaaaatgctgggtttttcggtttatgatttctaaatcattttctagattctacgactacatattattagaactatttagagaagcttataattctgacagaagctacagccaaacatgtcctatgtagtggtcgattcaacttttcatgacttatccactgataattttgtttttcctttctgctagcatccatttgtgtgtgcttatcggtataggcggtaccgtccatgactaattaaagtggtttcgacctcttggatgatccggagactaaagataattagcacaaggttgcctcttttgattgcaaataatgttattttaagtggtggtctccctatttcgatctaaatagcagccacaataattgctactacatccgtaacgttttatattataagactttctattattacccatatacatatatctggatacatatatgcctagatttattaacatatatataaatatggataatgttagaaagtcttataatataaaacggaggaagtagttgattaagtattaatgcaacgtgatgggggtcgtcattacatttgcagacaagtagacaacaataatggcgatgcaggtttggattatccgtgtatttaggtgccatgcttagcttaatactactccactttacagtcatagccacgtcagcgtgatatgcttctcattttctaagtaaattatagtgtgatttaagttacaccaaaccatagtaattcgagaacttctacggtatactacagttttaaggctttgttaactacggtatactacagttttaaggctttgttaactaatcactgtagcacggttaagagcaagtttaatagtatagccagctactggctctaaattatctgtagttaatttaatagtcaattcatacaatagttacctacaaacatataccgcataattaatctctggtcccacctatcatacacatatgtatattggagtccgtgctgcagctggctataaatctgtaacccgctactcttatctctcctcttttatctctttaaaatatgtttataactggcttataatttgctattatatctgctctaaatgacatagacggtgcattaaatgaacttataatttcgatacataagtttagaattgatatgtgaccatgatatgtatcaatatacgtaacacattgcgaagtgagtgtaactcgagaagggaggtcggactcccccatgactactgccctctgccacctccatccatcgatcctgagttcctgacaagcaggcgtagcaaccacccttctcggcccctcttccctgcatttgctgacgttgttcttgtttgcactctcaaggtgagcctcgtatttccccttatctcctccactgtcacagattccggataggctcgtgtttcttgattcgatggcggatggatttggttggtggattgtgtaggtaggggaggatatttctcggttttgccatgccgtacaacagcaagatgggagcgaggaaggacagcgaggcatgagggtcgttgtcgggttaatggtgtcgtcgcaacgagagaggcggggctcgtcgtactccaatgggagcggctcggatgacggcgacggtgggggtgactccgacaccacgtcgaccctctcgaggaagaggccgtcatcggtggtgcaggtgccactcaagaagcagcactagccagaagaggggcgcggcgaccgcagcggtggtggtgggtggcaggagggcggcgacgacaatgatcccttattaattgttgtcgtccgtgggcccatcacgttggctattggctactccggcctcttcacatcgcccgcagtgcgccaccttgaagatgggaagagataggaagagaggtgtcgatggcgctcttcagtgccgtgctggtgccggtcgcgttgcgacgttgatgcgtgtggcgtggatgtactgctcgctagcctcttcgccgagctagcctcttcgcctccttcctctccatgcacgctcggccagcttcgactcgccgatggagatatgagagaggtagagaggggcgaggtggacgaagtgggactcactgatgtgtgggtcccacagttttttttatctttttgtttgacggacatatgtgcccgtatttttttttagtttcaattttgctctttttttatcaagctgtcacgtaagcgtcacgacattaccacgtgagatgaaaacttagtcaaggagccatgaaggcaccacgcgagttaaaaacggggacaatactaccgataaacctcgtttacactggttttataagttggggggctgtatcagatatttcggttcaaaggatgaaaatgggatttggtgtcaagttaagggacctcaaatgaactttatcgatgccaaggccggcccatctagttattacccaggaagacctccggcccacgcagcccgtcgcgtggcggtaggtggggagggggcaggtgggtcccgcagtgcccccggcgtcgcggggtcgtcgtgtcgcgtgccggctgcgctcccctccactcctcctcccctccccaccccacggtgccgtgccctccacacgatcccccccccctccactctctctctctctctctcgcccgagtctcctcctcccgcacggaagcagtagtcccgcaggcggagctctctctctctctccggcaaatcggcgaggtgagctctctcttctcccatcgctgaatgaatccgcgcctaaggctctagggtttcgtttgcttcgactatcatccaccctgctcggatcgccgccggttttgctcttttggttaggggtgtgtgggtgcagcgagtctaggcggatctggcggcgatcggtgtgtacgggatctcagcctcctcgttggggcggatggtcgccgggccgccgcggcggcggttgacccgaatttcgtgtcgaattttgcgtgttagtgattgatctcggtctgcttcccctcccaattacttggaggttcttcagagttggggttgctggtcttcagaattgggtggggcatgagacaattcgcatggcatacacctctttcgatttgtgttgtgcgtctgtgttagttgcgccatcaacgaccgggaaggctttggtgaaatgccgcgccccactttgtgggggaatgagagatgattgcggtattgacgcgtgcagactgatcttagtgctttgttgtcgttgaggttcacgaaacatgagcgaagaggtgaggtgaagaataaccgagacgtttatggtccttatcatataatcttgtctaactagtggtaactaccatgatgccatggaccaataacagctactagaactcataagactacgtatccatccacaataggaatatacgcgtgaccaactcttagttagcacacttttttcctaaatgcacacatcatgtttcagtcctttatggtaacatcttgaccttcactgagccatttctctgaccaagtggcaaccttgagtccttgaccatacaagaagtcgagtgtctcttggtgcgccgttggccaccaacatagatagacaatgccattcatgtagcaggggcaaggaaactcttgtaagaatctgatatcatttggttaatgaaatgggagaggagctcctctctttctcaaaaaaaaaaaaaaagtagcaggggcaatggcagcatctccattttttttcccaggatgtactcatctagcttgactttgtaagtggttttattccttatgatgtctaatagggttatgcactgtttctccgcccttttagaaaatctagtttgctaaaaggtatgaatgctgtttttagtagaacaaaaatgattgatctagcatggcactgagtaagtgtgttatgttatatttctcactttgtaaagcaaacactcctgaaagtactatactctattgcccttgtaattcatttagggtaatgtagaatcacagaaccagctaaattaatgtcctccatgtctcccccattagtaaaggtacaatgcgttgcttcaacttaccaggcttctcttttgctctcacatgcgcatgcatgctgtttgtttgagggtgatgtgagtatgcttaattatcatgacggtattatttatttcctcatgctcaagtgtgttgcttccacgatcctcatttctgcttttttaaactacatttactaccataagattatttatgttcatttggcatggtttctccaggatggaaatgttctttggcagttttcttaatgaatcagcatcacaagagtacttctctggtcgtccaaatgtcgagagatgcccattcctgagaaacatcaatggagctacaacattttcattttcttctgctttgccagtagctgtaagatcttctttacatgacctctggtgatggcattatcaatatcaaaagtgcatttgatccttaatctgtgctattgtgcaggcccgaggagccaagggtccaatttttgaggacggaccaggctttgattcagcatttaaacttttccatggacgggatggaatagttccgctttcaggaaagtcatatgtacctgatgagaacaacagcgagagcgttgatgccaagcctgaacctgctctgccgtttaacccattggctgctagagctgccacaataagtctatctgcatttgggccattcggctttaacttctttaatggcaagggcaaaaggcagaacaagaagctcaacaatctaaatcagtcaaacaagaagcccagcaatccgaatcagaattccatgaaagtttgtcctcattccttccttttattttctttcttttcgcatatggatatggtgctatgtttgtgaagtcctatctagtttctcgctatcatgtcctaatagcaatgcaaactttaatgtttctcgctatcaagtccgaatagcaatgcaaactttaatgttttgtctattattccaagtaagaatgttccgtctaacagttttaccattttattataaagaactgatccagattttgttcagttgaagttaagtgatcgtgattttggttcacaagtaggcattttggcatttccctgggtgtttggctatatgttatttctcatgtatgatgtatccaagtgcacagtgttcttgattggacagcagtagttgcatagctaggattttcatctatccaatcagtttttctcatgttctgttttgaaccattttcagcagaaaggaggtaattcatcatcgcacgaggcaatgagcaacgaatggctggaaaatgggcagtgcccacttgcccggtcttaccgagcaatgagtggcattctgccccttgttgccaaggctttacaaccaccagccggtgtgaagctgaagtgcccacctgctgtggtcgctgtgcgtgcagcccttgcacggactgaacttgtgaagtctctccgtccccagcctctgcctgcaaagatggtagccattgcgttgctcggaatggcagcaaacatccctcttggggtgtggcgtgagcacaccaagaaattctcccctcagtggtttgcagctgtccatgccgctgttccattcattggaatgctgaggaaatctgtcaacatgcccaagactgccatggcattcaccatagcagcctccattgttggtcagacaatcgggtcgagggcggagcgcattcgtctgaaggcactggctgcaaagagcgacgctgattccaccaccgtggctgacatgtatccaaacaagactggaaattgcagtgacaccgagggcaaggcatgggatccgctcgcgatgaagatgatggcgggacgggcttctggtggtgctgctgctccaacaccaagcatgtgtttctgattgctcactgattggaaaatttgtatctaccagtatccctggagagtggagagttgatattgagtctattttatcttgtgatgtaattgcctttgcttgtccctcagaagtattcgtttgtttgtggggtgagacaagtggaataagagtgctactatatacacgatcattctgttgttaagtttgccagttctgcagttcatgtatctgtaatttgatgatgctggatttctactatttatcaatcgtcattatactgtgtgtaacctgttggatgaacgcttgttagctgttctggtgagtgacatgtagccctctttgaatctttttattgagaggataatcactgtatctacttgattgtacaaataaattaaatattttaagaaataaactcaacaaatatcttaaaacaaatggtttaagtaatgcagtaaaagtcctttttaaggaaacatattttttaattgtagagcaaataatttgataaataaactaaaattttaataatctaagagtaataaataagctgaaatttcaataatccgataaatacgctggaaaaacatggcttggacattggctgggtcctaccggcagtgagagagagcagcctgccaagtggggcccagatgtaagagaggtgtgaaagcgagattaaccgggaggaacagcgggctcccgccatttccattcgcgcgtagcgacgcctttcccgcgcagaagaattcccttttcccgcgagaatcctttttaccgccatttttcttggcgccaagcccggctttcccgcggcgcgctcttctccttcctataaactcccccatttcctctctcttctccatcccaattcccatctgctcctccaactccaatccaatcgagaggtcgatctctgaatctgatctgatcaccatggtggtggcactgggtcccggccggttctacggcagcagcctcccacggccgcgcttcttctccggcggcgaccgcgtcgagccgccggtggccgtcaccgacccgctcatggcgtgggcgcacgaggcgcactggtccatgggcggcctcagctccaagcgcctccgcctgcagggccgcatcgagggctccatcgacaagctccgccgccgcgcccgccgcgacgccaggaaggcggccaaggcccgcgccgccggcatcaagccccgctcgctcgccgccctcggctccgacgacgacgactcctcctccgacgaggaagaggaggtcgaggcccagaagcagcagatcgtcgacgagccgtcggagtcggaggaggagcaggaggaggagaacgaggaagaggaagaggaggaagccctcgccaccctcgccgccgcggccaagaggaagcgggcgaggaagctcagcgacgagttcgaccgcgtcgcgaccatgcaggagggggaggccaagaagcagaagcccgcagcaacctctacaccggcgaggacttcaccgaggaggaaggccgccgaggtggctctcaccccggcgccggcgagggcgtcaccgagggggaaggctgctgccgagggggctactgctgcaccggcgagggcgtcgccgaggaggaaggccgcggcaaggaggacatcgccgaggatgaagcactgagagaggtggcctgcttaatgtgaaatcctagttcttgctctgttacattggtcgctctagagaatcgagatgtgattgatggatatgtaatgtgttatgtgtgtgtgctaagtatttagtgatgaaaccattgaaatgtgatgctaatctctgaattagtcatgaattcctgaatcaacacatttccagatctgaattctgaacatcttgcatttcttgtttatgagtgatgacatttttttttgacttgctcttatcagccatcaattgttttgcatgatgaagagaaaacgcgattgtcgtttcaatcaaatgatatcttatgatctgtgtccgtgatagaaaatgtcactgattcgtctgtttcttaattaatcctgaaatgacatgctccccgatctgatttctgaacattttgatgctactccccatctctctagatggaagtagaatgcaattctcaatcctttgcttgctggtagtggtatgtgtttgtgttaagataagaacaggaaaagaatggtacatttaggccagcactgtaattctgcagtccttttggtttgtgtgtttataactttgtatctagtattctttgttctacagtaggggtactaatacagggagatggcctattatgtgttggtatcagagacgattcgttctatctcttctagtagtcgctctttttcttccaccagatcctcattttgcttctgaagctcttctatctgcttggtctgttctgaatctttcctgcaaacacataggatgatttagtagtggcaatagttggatcatgcttatgcgactagcgtgctgagaagcatgagatgtctgtgaagcaatgcgcgtaccggttcatgaaggagaggttaagcttcagtgaccggacctctttctctagagtttcgcagcgcttaagcacaacctgtatgtcagatggtattactggtgttgagcttctttcctttgcttctgccatcctaatcaataaaaacataatccaatgtcactcattgttcaagaaatggcattgtcgattacgaagaaagtgttattgtaggtccaaatgccttgagtcttcagatgtataatagttgtatgtgtaacataccaaactaccctacaaactataagaaccacattgtgcatacatacttgcgtgagcgctcaaccctgcgtttctttgtaggatctcctttatctgcaaaagccaaatatgtagggctttcaggtattaaaaacatgaaaaaaaaggcgctatgtgagatggactacatgatcctttaaacttgtttcatgtttcaccagtgtataagcttttgtctcttcagtaattctttgcagtagtcatcctatactgaacttttaagtttttaaaagtagagttccttgttgggtttacctgcttgttcagatgaaatggatcccattcgagttaggctccctttctgcaaatgagtgaaatgaaccgtataacatctgccatgagaaggaaaataagtgatcagaaatatcagttagaacatacctttctgtcatccttcaaattttcttttagtattctctctctgaaatctgtacaccatgaacaaatacacacaatgttataactagagtagagttcaaacaatttataacagcaatagtgtgctcattgaagattttatatggcctcgggtttaaatttatccttaaggttctattttttttcttaaatgtatacctttgccttttgatctacagtcagctgtcccattgccatttgcagcatttgttctagtactctcacaaacagtcattgcttgcccaatgggaggcaggtcatcacaaacttcaaatccagctgaaggtgctgggatagcagtagatgatccactctgcgaaggctctcgagatgctgtaccaagccaaacctggtttgcaggagcaacaaagttcccactgccttgttctgttggcctctcgactttcggaagcatcaccgagtcttgaatttgggaagttgtcaccagagggaatatatctgttcctccaagaatgttctgttgaaaatgttgactgtcataaaaaccaaaagatatgcctgatgaggtgtctccattagcatggctactaagcttcttgcgctccagtgtatccttgagcatgctcacaactgaggtgatggtatcttgtgctactatatgtggattatccaaaggggatgttgatgaacttgaaggagatacaaatgttggagtctgactgggtgtattgctcattggtgcactgttcacagtacttgcgtttgtcagatcttgtctcagtttgttagctgtttcaattgtttcagttgttattggtggcatgttactttgcatcgccgcatatcttttcctgcacataatggaaaattttgtagatattgagctaagaacatggaattgagctatggattgtaatgcgtaattgcgcatagaactggaaattcctgcctgagttctgaagatctgcttctagtcattggctgagtactatgaaaccaggcctacatatgaagaaaccaggcaatataagcaaattcagccatttactaattataaattcatccatgtattagtagatgggtgatgaaaatgcctaacctttgccaaaagtaggtcactagcttgcattcccttttctgctgcattcctgtcatgggagacaaccaattcagtacaatttggaaaaaatccagaacacaatatgatgttggtgaaaagctatagtacttgagttgttgctggttatggttcattgtaaactctgaatgaactgccaaattctgcggaatcaggttgtcagtaggaaaatgttcttgagcaatttcatgttgctgattaggaaagccagctgcttctgatgacaacctgcatatatttgacaaatatcctattattcacataattattgattttttttttgcatgcagtggtcattaaccataaattgaccaacatacaaactgctagatatctgtacagatttctgattccaagacaaaattttctgagttcaacaccattcacttgctagaaaaaggaatagaccccatgcaaattagagctttctgaatttaccgtaagagtttctatttcatgatttttcaaccttaattaagttaacatgacatggctagtttaatgagggatacaaatctggatacctttgcctgaggttaatcgacattcagttattctagtctatgcaaggcaaccaatccaatcctacatacaattttattcatcactgcatatttatggatactaaattgaatagttagttctggcacaccatgccacaatcttacctagatggttgtcgagggcgattattcatggcactaaatcctggaatctgtgcacaagcaatcaagaatttcaggtaacattaaccatgaaagtaatcagtacatcaatgttcatatctatgtaagcttatgcactatctctaaatatatgtatgtatacaaaaagttgtgcacttcataaaacaacagatgagttgggatttgttttttctgaaacatgaactttcatgtactgagacaaaatcttatggattttcagaaaacttgcctctccattcataagccagctattgaacaactcctcgctgtcttctctgaaaccttgggacagatttctgaaccccatcatctccatgcttggtgccgccgccgccactcccatcgagttctccatcatcgcctttaggaacatatcttcacttgtgttcctgaacagctcagacagacccctgccctccatttccatgaaccctctcaactcaccttcagcccccctgacaaaatacttaaccagattattgactataaagttcctaaaaactgtctttagtacttaactaagtagggtcacaagaggcaatcatatgatttcaagaagatatagtgaaacaaataagataatataaagtagaataccacctaaagcactcactaacctaagaaatggaactagcagaagagttcaagcacacaagacatgatactaattgaatattatactagttggcttataataaacagagtggaggtatcttcccttctgtggaggcaaagattccacaattcttgttttgtcttatgagttgaaaaattggcctctgaagaatttgaccacatttgcaatttcgcatggaaatgagtaaataaaatgcgcaaagaaggtctatgtttaccaggcaggtatgaacggaataactgtacattacttgaagttactagtccttccacttaattaacctggattgaaaaattctgcactatcatcttttgtaaattatgaaaattgcagcagatatgtgagagatctttcacagctgcaatcagaaaaactcttagaatttgttccaagatatctaacatttccataaactcttccaaagttccaatctgcttgtgttagcgataaaataagcccattgatgtaaggaggtgacaccatcgatgacatatttgatgttacttcaggaattcattgatctacatggcatttcattggcatatttgaatcatacacgcaaggctcaaaagtgcagttttggaatggccctgcttgaagcttgacataaacttctcaccagaccatttcttctgcttgtcaggtaaaactactcctgtcttgattaatcgaagatatgccgacggcaaaagctttgttttggacatttctgctgacactgacaattctcatattttcatataattttcttattaactcatcaccgagctgaaaatccctaattattttactgactaggcaacacaattttgagaacacattaggcaccacaatttaaaatactgaattttcatcttcttctctaagactctaagcagcacatgatcacactgatgctgaccttaaactttcctactcttttttccatctagagaagaacaagactctggcgattgaggttctgagttctgactaagacatcaatcaatcaagatctctcttgaccatctagatacatttatatatccctgatagctgattagttggcacatcagcatcagctaacgatcacaagacggttacagtaagtgctccagcaagctgtagctttgcatcctgcccaaaacggctcccatactatagctgttgtccattgcaccatggatggattctctggtgccggcttcacgacgcgcatcgccgatgacgacccgccattgttttctctctttctttttcaaatgttgttcttgccattttcctgtttgaagttttccaagcaggcgatgcaagaaccgagctgtgcctgcctgcacaatcgcaaacatatattttcttaaaacataaacaaagatcacacagggatagtaaaatatgatgaaacaatattcagcatcaacttgattctttaaaatttgggtttgctaaaagtcttcagaattcagggcttatacaaatatacaatatctgcagtcgcttactgtcttggcctatcacagagccgcttccatttccatcgaaatttcgcttcaaagatcagaaagcgagtacaatctaatacgcctccgctgtcacaagcgtattactatctattacgcctttatgcggggaatgcggaagatgggccttatatccggcccacgtagaggatacctttgcttcgatatgggctggcccatgagaaggcccaactagagcggcctcggcttctcttctaaaaccccacctcgcctcgcgtcctcttctccaaccctagcgcgccgccacctcgcgtcggcatcctcctccgcctccgccgccgccgcctcgccgcccaaggtagggtgccttcccgtccatctcctcccctctcgcgcagcatttctggatcagtcgaggcttccagttcgatctagaccttcgtccattcggatctcggttcgttgtactgcgcgcgcgctccgtttcttgtttgtttctggatgtagtgagatgttgtggagctaggacgagagatctcactgttctgttcttatggcagcaggcgaagcgaagctcgtgatttgtaatttgtagcagtaatttttggttgattctcatgcgttttagtgggatctagaacagggtgttagccttttctttcagtaatctggtgtggatttttgctgcaactgttagtaagagctgttaggaaggaatcgcatgatgcttatggtttgtgtttgtttgatttggtgtaggtaaggtaagccatggtgaagcacaacaacgtcatcccgaatgggcacttcaagaagcactggcagaactatgtcaagacatggttcaaccagcccgcccgcaagcagaggcgccgcatcggtaaagtgattgatctcttgcgatctatctaatgattatgtgaatgaatgagcatgttagcttcctacttgctcgtgagattgtgctgtgtaacatatgcgtgaactgcaattgtgcttctaaatgcccgtagtgcttcttccctgggtgttcgtatgatattgactgccgatcacgcatttcttgctctgtagtgttttatttgctggtagctgcttagacactgtttacttatgtacatattttgcttttatgtctatttgatcagcagccatctgcggtaacatataagttaaattgctatgctgtttcttaattttatagtttcttctggtaatgtgttgtgtgatttattggtgctatcataattttagtttgctgcatagccagactagattaaaattcagtggtctggatcttgataaaccctcatctaacaatttgtgcatgtgtttgcgacaaattgtctactttatgctttggtaccagtcacttatcgacttaaactttacatgcttctggattctatttggttttgcatgtacaataagctaaaagatgctttgtgtatttcttttagttctgctccttctattatttaaaaccagccacaagatgctgtgagttatgcattgttgctgtctaaattggaaaaaaaaaaggaatgctcaagtgctatttgtagtcctgcatgaggcattaaattttatgtttgaagatgctgctatttcttttttacccagcatctaattttcttttggtgttggcttttgcagctaggcaaaagaaagctgtgaagatcttcccccgccctacttctggaccacttcgccccattgttcagtgccaaacacttaagtacaacatgaagtctagggctggaaggggcttcacccttgaagagctgaaggtaaatcagattgcttgtttgaatagcaacattgtagctttgacgccataatgccgttgaaactttaccatgtgttatatttggatcgtgattctgatctcaataaacctattgcacacaggcagctgggatccccaagaagtttgccccaaccattggcatctcagtggatcaccgccgtaagaaccgctcacttgaaggtctgcaggccaatgtccagaggctgaagacctacaaggccaagcttgtcatcttcccaagacgtgcccgcaaggtcaaggtgagggaactttacccgccttagccttacacttaaacccactgttctgaagatcccttacattaaccaactcctttcgcaggctggtgactcgactcctgaggagcttgccacagccacccaggtccagggtgactacatgcctatcacccgtggcgagaagcgctcggttgaggtcgtgaaggtcacggatgacatgaaggcattcaaggcctacgccaagctgcgcgtggagaggatgaaccagcgccacatcggtgcccggcagaagagggcggccgaggctgagaaggaagagaagaagtgaaaggattgcaacctgcaacgttaagaatagatgccctaagttttattaccattattgttatcagcttctcctgatgcgagactggcattctgatcttgctgctgtctgtctactcttcagtttgagcttgtttgggtttttgtctgaagtgaaccaaactaagtgcatactacttgtcttaagatgaattcagtcatttcgctacgtctcatttacctgccagccatatggatgatagtagatgcttgtgttttcattcgccatttggctgtcaaattctgttctttttactataccactgaatttgaaactgagtcgtcgtggtcgtgttgcgacttgtgacgaaacagatcgatctaaaaacgtgccaaatcgcaagtaatcacaaactggatcaaatccgaagaattttatattctgcaaaaaaatacaaaatggttgataatagattttttttatttttaattttttaaaaaatatttacagtaatattatactagagaaaatatttacagaaatagactctgcagccctccccgagggcggccagatcaccttgccgcccttcacttgggtgatagggtctattttttaaatatttttacgggtataatatttttgtaaatattaaaaaaaattaaaaatgaaaaaaaaatcttggtaataatgtggcggcccactaagctccagctagaagcccaaagcccacattagtttgggcccattaatatctcgggcggccgcttatcccctcctccaatcttatcgtctcctcgaagctttctcccaaactgctcgtccatggcgttcgccacactggtgggagtgggaggcctatcgcctgccctcttctccccctcccgccccctctcctgctccagctccacctccgtctcggccccgttcatcctccgcgccggcggcggcggcgacgcccggcggcatggcctccgacgcctcgtcaccccactgagagggagcgcctgcagggtaaactgtcgcctcctcctcctcagcttagcatttctagttggtagctcgagctgactgattggcgctgctcgccgttctttgtttcctgtgtattattttggataagtcacactgttacgtgttaattcaccagacttatcaagcgagtagctcttctttatggattcactgactcaagaaaatgcattttcatttctgtagatatttgatttgtcatgacattttcggttggatgtgtgaaatacatttattatgcaccatttctagaataaaagaatcctctccagttctgtagacgattaatttgatgtggaagaatgcatatatctatgtattatttcaacagggagagagtacgaactcacgtgtactccagtgtgccaatgaggctaatgtggtgaccgaggatgacattgtgaacgatggtatcgatgatgaaaccgcttccgatgctgaaatggatgaggatgctgaagcaaatggtgatgagtcgtcaggcactgatgaagatgcttctgtctcctggatagagcagcagcctcttccttatccttcagtaagtacacaaataccaatttgtggttttgcacagagtagtagtgacaactgtgtgatgggaaatgtaggatgccctagagccatacatcagcaaggagacggtggaacagcactggggagttcatcagaacattcacgtcgagaggctcaatggcatgattggtggcagtgagtgggaggggatgtcgctggggcagatgatgctatcctccttcaatgagggcagggaggcaccccatccccccttcttccatgctgcacaggtatcattccgtatgctgagctgtatgtcctccatatgactaattactggacattcttttagatatggaaccatgatttctattggcgatctatgcaacctggtggcgggggaaaacccccagaacgccttttgaaatttatcaacagggactttggatcctatgatggcatgattcgacaatttatggatgctgcatcaactcaatttggttctggatgggtttggctttgttgtaagtgatgtacagatgcttagcgacatacttattagcttcatcgtaccagtttcaaaatttgcatatgttggtgtgatgaactgaactcttttttctgtaactctctccagacaaaacaagcaagttgcctcatgtgaaatcaagaagcccaatcccatctgataattatggtagactggtcatctcaaagtctccgaatgccatcaatcctcttgtctggggtcactctgtgagtattaacttgaaacacttaccctacattgctatgccattcttctgtcatgattcgtatgcaatggctaaagttgaaatgcaaagcatacgcctggcactgtatgtctgctggtttttttttgccgtatgcatatccagcagggatctcatgaggctatttctttttgcagccactccttgcaattgatctttgggaggtatgaatattgcaatcaggtttctctttcttttcctggcatttttattaataaacaattatactaacaaaacctattactttgggcaacagcatgcatactacctggattatgaggttagatgacaagtgatgcttacatttagtacttaaaaaaaacattttgttttacttattttgttcatggctatatctttgcaggatcggagatctgactatgtctccacatttctagagaagcttgtgtcatgggaaactgttgagtccaggcttaagaaggccgtacaacgggcagtagaaagagatgaatatgttagcacaaagcatataaggaagcaacttttagctcgggcaaagagccaaatcagagctatgcctcagcaggtcaatggggatgcaagagagcagaccagcggtcaagagaagtccctaggggtgtgacaacggagccaagtaagctacggcaggtgggtcatgttgccgagttgaaccatggggatgatggacttgtaacacaggaagctagagcagctgatcaatcttcaaggtagcagtatccgaagattgtatgcacatactgtgggcaaccctttgcttaatagcaaatgttgtcgtacaggcagcttcacagtttctgtcgctgtcgatgaatagatctgtagttcgtgacactgcagcaaatacaagtcacaaacccagagtcatgtgcgagctaaattttgataggagtaattaggtttgagtatcatagagatagacaagaattagtcacttggagcaaatgagcctgacatcttgtattcctgtgctgtccatgtttgaatcctgaacttctgattgacaaaccaaagaaaattgtagttccgaagaaatacatcactggtgtcagtaatgtttgtttcgacaggctctcatgaattgccatggtggttgcttggtacttggtaatgaggacctacagttttgtcatagatttccatgagctgtgtgttattttctggttgctcttgtccaggaactcaataataatgtcctgatgcgttgcgctacatttttttagaaaacagtcaactttcattacccagctttgaaaccaaagccaaaagcagcagaacagagcattgctctgcatttacaatctggtttccaaaagtttacctgttgcacctgatgccagagattaacacactgttctctatttctctacttattctagccgtgttgttctacccttatattctttatctctctacttattttccttttatgtcatttgcgctgatgtacaaaatcctcgatttgcaagtcttgcgtgtattcctgaataaaaagaacttttgggagtaaggccgtgtttagttcctttccaatttttttttaagtatacggacacacatttgaagtcttaaacatagactagtaacaaacaaattacagattccgcatgtaaaccgcgagatgaatctattaagcttaattaatccgtcattagcaaatgtttactgtagcaccatattgtcaaattatggtgtaattaggctcaaaagattcgtctcgcaattttccgtcacatcaaatggcgcttagcaaatgcggcggtgccagaattgcctcttcctagcttggttccacggtcacaaaatctagtcagagattaggccttttgctccattctgtgtcctgtaacccgtcctcttcttttattttttagtttttgggtccgttgtacataaactttattcctattaataaaaaatgcgctgcttgcgtattaaaaaaaatctctactaataacctggtcatcacattgacaaaatgacaagtacaaaagcggaataaaatcgagtaaactattcaagcaagccagagaatgaagaaggccttagaaagttcactgttcctccctcaactatagcctcagtttgtttgtcatccctatatcacaatgattttcggcccttaccgttcacaaaaacctcatacgagatgtcatcctgtactgtccatgtttgacttctgaacttctgattgacaaaccaaaggaagaagttgcaagtgagatcgtacggttctcttatggttgctctggtccatgaactcaacaatgtaattagtcaaaaaaaaaaaagaactcaacaatgtccatatccattgctctgcatttgcaattggtttccaaaaaaatacttatttcatttaattgtttaggattcctacaggcactactatagtactacggagtaggagatagacaaaccaatcaaattaattagttttttctcaacagtttgctttaacctattagtagtaggcaacacataaagccttttttattccttcagtatcagggcaggactgtatagcacaatcttggaatatccaaatatctttctctctctctccaagcaaaatcgttgacgtgataaaatctaaaaacattaaataaaacaaccacaaaaaaaaatattttttccttctcatcgaaattatcgccacacacgagaggctttttgtctgtgccatccacgagtcgcacactcgtaagccacgtcgccaccgccgatcaggagtcaacaccccaccaacggccctgatcaggacacgtgtcctgaaaggctaaaaccaacctgcaaaatacccccttcctatataaactcataaaaaacgcttggacatggcgtccattgatcttcctcccccctccaactccaagaaatcgactgacgccaacgagaacgagacgccatcgctgccatgggtttgcaggtaaattaaacgaatcgtcttcctgcttcttcttcttcttttcccttctcgtgattttctttgtgttttcttgagcggatgcgcataggttgaatggatattactcctccgcttgttgaaatcaatctacctgcagatttgctggttgtttatcgtttaggattttcttccctttggcatgcaatatatatcttgtttggagtaccatactaccatgtggtttaacagtatgttaatttgtaattaaccaatctaatctacctgctgttcgttcctctgttggttaatttagtagtgacagtgttctggatcaagtagctaggtaggtgcagtagtgataaaagatcaaacctttttgtgctttagactttagaggagccatcagaaactgcaattgatgcctttgttatcctgttcttctgaactccaaatatgcagagcagtttcctgaggtaaacaaattcaagtcgattctgaacaaattagttgttgttcttgttgtgcaggaggagtttgaggagttcgccgagaaggccaagaccttgcctgacacaatttccaacgaggacaagctgcttctctatggcctctacaagcaggcaaccgttggcccggttaccactggtatatataggccttctgctcttcttgaaacgatgcattcatcaattgagctaattaatttgctgctgttcaagtgctaagattccatatgctttcatgatgatcaggcaagattagctttcatatagttgcatctgaatcactgttttgtgttttgactaaaaaggattatcgatctgcttaagttttgccacaaatttagtgcttgatgagtgtaaactcatctatccttgtaatctgcttgtcaatttggggtgtttaatattacaatttccagaggaattattcacctattacagtactaagtggtggttgtcatttgaaattgtagtaacatatggtattcttatgtttctccccgatggggactttgcttagcagctgttctactttttttttaaatcatgacctttcaagttccaaaggcaatgcttttggacttgtttcgtaatacagacaccaaagatcacattttatcctcgagttatcgtatctaacaattcagtttcatctttcagggcgcccaggtattttcaacctgaaagacagatacaaatgggatgcttggaaggccgttgaaggtatatgccgatctctttaagtcctcaaaaacatatatcagctaaactatataactttgtcatatctgcaaactcccatcaatgcttacaaatccaaatcatggtgaattcagggaaatccaaggaggaagctatggccgattacatcaccaaggtgaagcagctgctggaggaggcttctgcatccacttcttaggctattatgaacaacaccatcaatagtgctgcatatatgtaccaataaacataaatactataccatcatcaggcgctttgtgatcatcccttctctgtacttgtaatagtttcaagcagactcggtcctgttaattgatcatgactgttattaagtttgtccgtcttttctaaatttaacttgttgctaaggctacggtttggagttgttgggattttcttatacgcaaggattctattaagcatataatactataccctgtttagttcacgccccctgtttagttgacgctaaaattggaagtttggttgaaattgtaacgatgcgatagaaaaattagaagtttatatgtgtaggaaagttttgatgtgatggaaaagttagaagttcgaagaaaaagtttggagctaaacaaggccaagttgatgggcttttatgtttctgtatccatgatgcaatgaacctccactgctctttccattgtctatacatctactacaacggtactggtgtaatttaattttgtgggaactgtcatttcagtgtagttggtcagtaaatgcgtacaaaaacatactagcaatgatcaatgatatcgattgcatatgaacagcaagcgaagaagacaaacagtaacaacagtagacaatggaaactgtgaaggcaaaacagtaccaacaattaaatcaagcagtagacaataaaagcaaagaaagtgaactgttggatagagaacaacagttataaacgataaataaaacaaaacaaaaaaaataagtgctgcgttgtatgaacagcgaacattgaaactatccggttgattgcactaataactggtctgcttttaagaaaacatgaattctataggaaatagttcaaaactcgtaaaatccggtaggacatgctttacattgtcagacaacctgttgccgcggcagctgcttactatacaactatttactcaacaaatatttattttgcatatctaaattccctattctatattttttttatgtccatcactttgccaaaaaaaatttagacctatagtaatttagcttcttgaggatactttaaacatggttagacaactcaacaccgaattaattgacacacgccttcctcctatcgaaagacattccccttccaactggtcaatttcttctataaccttcctcaattatatatttgccaatccttatgagagaatttcttactcaatccatactttgttcatgagtataattaagtctgtctgtcttctctgaatttaacttatcgttttaaggctacgcttcggaattgtgggaatttttcctagctgttgaatgaaccgaacaatttgccttcaaattcctacaattctacgaagtttgtctgtcccttttgtgcttgtttaagccaacaaggattccacaagcatatactgtatactgcagccgtcgaccatggcgtgcctgccatactggagtggagtgcacctcctctcctgcagattcatggcatcttgagaaaagaaaagagtcagggagaggatgaggatggcaaaagatgatggtgtttctctctatccatccatctcctcttttgctggaataatcaggatgatgcaatgaacctccactgcccttctcttgtctctactcaaacacatctactatgtactactgaagtatagtttttttttcgaacgcgtaaaaggattgcacgtcaatatattagaagaatagagttttttgaaacacgacgcactcaaatagaccggcctatgccaaggaaggaagaaaaacaaagataaaaaataacgaaaggaaaggaactctgctccaaacaactggagggggcagagccactctacgctcccaacaattccccaaaggaagcgacggccgctaacgaccacagccggccctctgaaaggatggactctaggactactgcgaccgaagaaagcacatagtcaaagaccctagagttataggactctaggactctgggactactgaagtatagtaaagttgcagtagtgtatttagttggacaactgtcattttagtgtagtttgatagtaacaagtgtgtgcaaacaaactgtatgattgcttgaaaagtaaataatgaaagcaaaaggaggaaaaaccagtaaactatgaaagcaaagaaagaaattgtctcattgcatgaacagtgaacaataaaagtagagaaagaaaccgtttgattgcacgactggtaacggtttcttctctcttttgtttccagggtagtaactgtttcaaggcagggattttacatcatttcagcaaaacaagttcagattccggaagaaatgttccgacattatctgttctaagatctacacaacagaaacaaagaaaaaaaaatgttcagtcacctgcaagtgcatttctttaccaagttatcgttggaagaggggttacccttgctagtctggttacgacggttactatgcaaaaccgaaaaaaaaaatcagacaaatttcatcctaagtttaaatttttatttaattttttagtaacttattaaataaacctggtatttttcattaccacgccatggcaaacaagtaaccacccatatcttaaacccaagtcacaagcgctgcccactgacacctcggccccacaggtagataataatattattagtcaacgaggctgtcctgtgtagcaggagcaataggtgccag

SEQ ID NO: 58509 - DNA, 9857 bp, Oryza sativa
tccggcccatcaaagcttttccatccgctcgcggatattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaatgaggctgttgaaagcggatcagttgttcaggaaagtcattgacggcgggtggagaaagcaatctcgactgcttgggcttgacgttggtagtaagtatgttgggctggctgtttccgacgacaaaaataggatcgcattgcctctaaggtatgcacttcaaactattgtagctgaatattgtgttccttgatccaaaggtttcactgagatagtgagatgtttccagaacatatttagcacaagtgattccagtgtgtccataaaaattagaacatcactttctatgtgatgatttaaatgcaggcggttctatattccattcctctcatggattagtaggaatgttgagtttccaactcacatggattagtaggaatgttgagtttccaactcatttcaatggatcggcattttttgttgtacttcattcaaatcattatcatgttggattggaatcttccaactatcagaatttgtttcagtttgtatggtctctggcttttgtaagacagtctattattgtgctgtgtctgttgtattaggtccttctctttgattaattcgactatactaaacttcggtttgttagaaaataactgtagttgccttcaaactttaaggaaaattatttgcaatttacaatatatcgatacacaagatcttatccctactatcatagtgtacctttattatttttaaaaatattagtctttaacatatttaagccttataaggcttttcttcacgagaaattcttcacttaccattgttaagatggacggactgcacttggctaaagctgatatccttttacctacctaagcactcagacagagtggatctagatttgctgaagtatgcgtttatctagaattttgtggtcattgtctgcactgctagcataaggttatctcaggataacacccctgttttatcagatattgactctcttgaatttgcaacaatccacctgcctacctggttttttgtggccaatactatgatagtttagtgatgggatatatgatctgcatgcattcccttaaagaaatggattttcctattgggattaacaattgcattgtctcctacagtgtattgagcaggacaaagacaaacatcagcttgatggcggatgatttcgtaactttggtatgctgaatatgtttactgacatttaaattctggagtaatcagattgtagaatcacttaccaaaagatcgagttcttaatatgccatgtaacatcatcctacatcagatcgagtgcttaatgtgccatgtcacatcatcctgcatggctgcatcgcatgcctgcatactgcacaagcaattttgtagcatgtgtgttgaggttacgatgcatttatggaagccagggttacaggccttctctaatatgctgttctttactgctcaatttactcatgtcatttacatttccaaaatactcgagggtgacattgtccacaaagaaatcataaatgatttagcaatagaagttacagacagctcatgatgcatatattctttcattttagattctggtgaacatttaaaagcactcatgttttgctatttttcatacatggaagccaattccttttctttgtttttgtgaataggtctcaaaatactcccttgcaggctttgttgtcggctatccgttcaacttgcagggtcaatctagtccaaatgtaaagtgctcttgtgctgggagcctgggatagtgcacctcattttctcactatatgtttggtgatgtttcctttttctattaagcaggcattacaagtaaggcttcttgttggagagctctgtaaaactgggaaacttgatgatatgagttacacctattgggatgaaaattttacctcgaaggtgatggtacttttttgcccattatctctcaaacatgaaactacatattagcatggggtgcattactcatgtgaccattttatcctacttttcaagtacttttttatggtgaagtgttttgattgatctgtttatgtctccagtgtgtagaagcccttttacatcctctgaaactacatgacccagttgaaaccaaaacaatgacagataaatttgctgcggtttgcatactccaggtacatacaacaaataccaaatgacgtcattgtagacttcgttgtttcgattatgtaattattattgaaaaccagtactcatagttcatttagctgaacatctgcttagtgacattgactatcatactttgttttcctaaaaagatttttactttctgtgcagcgctacctagataatatgaacagagaattgagatctgcagataattctggaaaacagggtgacacctgagttccacaatgcatatattattctgttcggtgcacactaaaccaaagacaacggaatcagcatctgttcggtgtactgctgccttagtgtactgctgccttatgaaaaaggctgtgcagttcattgagacatgtacaaaactctgagtttatgctctcgtatacgcctgataagttttgtagatgcagacttgcagagctgacaattcgtcagctagcaagggcagcttccctgcctgcctgctagaggcaatttgttgtaggtgatgcacaagtactaggaatcttttcccccttcctttattttcttgcttatgaggccattggcaccgaaatgcctgcttatgcgcagcttgaacaatctcttccaatatgattgccgagcatgcgcgtgtgtatatgagcctctattgtgtttcgggaaaaaaaatgattgccgagccaagaagatgcaatcaggctgtcgagtcaaatcaggttgataatggcgtgctgcagccagattccatttcctatgtctgcatgcgcatgcttagacaaaattcaccgtgatgttaacaactcatgtcattcgacgacgggcagcttttgatcattgtcacatccctgatacttgtaaatcctcaataatgtttcctcagttgtgcatatccgtggcctgcaatgctccgtgcaattgttgaatctgtttccagaactgatagcgtaaggaattgtatgaccatgatccttgctgtctggttgcaaaagattgaaaattctactctacaaagcaagttaggctgacagagaatcttgtggatgggatgaggtaagttcacttatccaattagtttactactctataggagacaataggtgaagaaataggcacaagagctaatgtgcagacttgtgctgctgagatcgtttcagacttggacaaacaatgctatgtggtttacatggactgcgagtctgcaacagataaaatcaccaatctacagctgtaatctgcattgtccgtttcctagggttagcgtaaggaattttccgatgtttctcccaggatctcagtctcagtggctgagatcgctgctactacctacacatgcaaaagatcataaaattcgattctatcaagtaagttaggctcatgaggaagtttcagaatacaggtaactacacaaaggagttaaacacatcacacagcacaaaagaggagaaaaaagagagaaaattctgaggtggtaggcacatcacagcacagcaattaagcatgaaacataaggggagcaagcaggtcggcgcagccacttgtcaagttaacatagctctcacgtatgcctgcctgcttccatgccaaaagtctactacactacagctcaagctactatgtatctgcctatctcaagagcaggagacagtggtgagcacagcacgaaaccaaggtagccgaaccatgcaaagtcaacacagttgacaaccagcaatagctttgtgcaaaagagatttggcagccaaggaaagacaggtcaggagctcacatcaccattggaagtcagccactgatcgtaccgttgttatttttagggagccgtactgtctaatcagggggagaagagctgatgaaggtgtatactggcacgttggagatggcttgaaggtaaagaagacggctggttcacggtaggtgattcggtcgagcagccaacggttttggaccggaatgcacgagctagctcgatcggcattctcccttttattgtttatatattttcccggttgtttgtttgtttgttattccggcgatttcttgaccagagataagcagtcgtttatttcaaggtctgagtctttgacaatttgtttgtgtgttgattttgttttggaaattgtagactttgactgaaaagaacgaggttaattaatctcgtaatccagtcagagatgagtaattggcatagcgacggcttgcatgaaattagaagttttgttaatttcatattagcaactaatacgatctcctgcctgtttgcactttgcaggaggaaaattcagcaagagtaggaattggaggcagaagttaagcacaatgtagcatatatggagttatggatcaggaacacgtactctccaaaatgatattcagccacatatgcatagtttgtcctatttaagcttccatgaatactaaatataatatattttttcggtgcctacgaaaataatcaaataacgacccctgttggagtattagacaaaactcatacgtggttagtccatactacgtgcgcattattggctgatggccatagcaatagcagaacatgtccatacactgtacatgaaaatcgtgatcgaactctgttccctttactgttgggcacctgcagctgcagtatctactataccaccaaacagtactacccgtctgcatccaacgtgcaaacttcggtttgtccaccaccgggacatgtacctcgtgtgacagcgacaccaccaagcgatcgatcgagagcacgcttgcggtgaggacgtgaggtcgctcgcccggatgagtacaggggctcgaggccaaggagggggggaaccaaacgtgtgacgggaacagcaacgtctcgtgggggcagccccggtcgagccgaggcgcgctggcgctagctagagtccgtagcgtttggtgatcgatccgacggcctgtctccccgcgcccacgtcgtcacgcggtgagacgcgggcgctcggtccacacacgcgcgcgcgtacgtgcgtgcgccatggccaccatcgatcgcggccaccggctgggtgatagccggtgcgaggggaaatatccggaaggaggctacttcctctgtttcataatgtaagtcattttagcatttttcatatttatattgatggtaatgaatctagatagatatatatgtctagattcattaccatcaatataaatgtgggaaatgctagaataacttacattgtgaaacggaggaagtactatattacgagatctcattcgagataatatcagatatattgatacgatgttaaatctagtatcccatactgaaccatacccgttaggtctcagttgataccttattagtaacagaccgacacctatcgatactaaactttttacccattggtataaaccaatacccattagctatcagatctagccgagagaaatgagagaagaaaggatggagatggtagaactatgatgctctccatcctccctcaacacgaaatgaatatgacaacgatgtttcccatcatctctctgcggagggcccgccatagacgaggccgacacggagcgacctcccgtccgattcacccaccatccctcatccccccccccaccctccccccatttcccctcccactcgaagagcaacgcgtatagcagagaaggtgttcggtgcaacgtaaaaattgggtggcgaccaaggcgagcacgtggcgtcatggagcgagggcatgaggaggatgagtggggtggagcgaatcgtcacgcgaaggataccttcctatttcctaatgcatgggtacataatcccaatatatagcttcatttgttttttttttctcccaaaacaaattgagtctggatttgaaattttgtcttagcaacttaggaagaaggaacttgaggtttttcaattcttctctcgcatgtccatgcagtattcgaatcgatcaagcttaaaggtcggttgtggtcaagcgtaggcgtcgctcatctaggagtcttgttgggaggatcgtagtactcttttgatactttgccagtttcggtcaatggtttcggagtctttactccctttagagttttcttcttccctagtcgtttccttgtgttcccttaacaattgtctctggctgttgtattgtgtaactgaatttcggctttattctaatatattgacgtgtatttttttcgcgtttgcgaaagaaacgacttgaaattttgtggatgttattttaataggaactttttaaaattttagagagcttttataacatggtccacggagtttttcatttattcgatactccgtattattttttaccggatattttcccgggaggagaccctcgcgggcttttgtcatgccgctgtcccttggtcccgaggccgcagagccgtgctgtcccctccctccgatccctctaagatcgatcggtcgctcgaggccggctacgttagtctcgcctcgatcgatcggtacgggtacactcactggctcaccccactgcaaaaaagtcaggattcgacgcttcggccgattatcaccttgcgatcgatcgacaactcgggggttgtttcacgtgtacgtgttgagtccccgttcacgcgtggactagtcaggaacaggatacactacgtactacgtacactcagtggccttgacaatcagagacaatgtactaagccattcgatcacacctgcatgctgatcagcgagtcgatctacgactctctcgcccgttcgtcgtcgtgaccatggtggattaattagacgtgcaaattaataaggcgtcgctgtccagggtgccgggtgtcgacggcgacccgtggggacgagcggtcgtaccggagagagaccgtgccgcgcgctccgctccgcgcggagcgtggcgtggcgtgctgccgtccatgcacacggcgacgacgacgataggtgcatgcacgcacgcacgcacgcgagaggcgctaagctatagcccgctgctgcgaacatcgcgcgcgctcccgcggcggcggcgcggtggtattcggtcttcacgtcatggtcgatcgcgcgcccgacaccgccacgtgaacgatacgtcctgccgcgttccgtgtgtccatctctcgtacgtagcgccagcgtgcgcgtgcgtagcataggcggcggtagacggcgtacgtcgccgtatagcagcgcgcccgctcgcgcgtctcgcgtacgtcgcctcatcgcgtgcgtgtgtggatttagctagtctcggtagctcgatcggtctcgcgccgaatcaatcggagtcgtagcgtggcgcgtcacgcacgtagcggtagccgtgtgtctgggtccatcggacacgatcgatcacacgatatatgctactatagagaagctagatgcggacggtcgggctcggccatctttcgttttcacggggcgtcgttttgatcaggattcggttcggacctgacgacatgggctagctactacacagtagccgctaggcgtggatcgaaggatatctttgatggatgctataccgtgctacgagctagcgataggattgggggagttgtgatgggcaggaatgaaaagggcgtcttctttgagcgtagaggaatcaggcgtgtctgccgacagggtccaagcttgatctttgttaatgcgacctcaaattgtagcctgtagaggctggttcgtcttgctaatgttaactgagacatgcaggacgcgatagcatttgccgatttgcgtgcatcggtgcatgacaatacctctctctggtctggcttcgctggcaatgcttggctattgacgttaccaacgccctaacgataaggatgctctcttaattctttacactttgagatagagtacaatttttttttagaacatgagatagagtacatgacttctcaatgtaagactctgttcaagataagttcatctgacattagacggatgatgggtagagcgtcacctcaacttacaaccagggttttaaatctctcgttatagctgtcgctatctcccgctatagctgtttgagaagggttctagctatttactctcatgtacaatttagccgctatatctttatttagcccgctatagctgccgctatagctatttgagaagctaatcactaaatgccttagcctgctatttaaaacattgcttacaacacgttctttgaggactcgatgtcttccccctgcgtctacaacccggagctttttccttgcgctttagcggcggccaaccaaaaatgtgcaaccgtgaaataggcagttacaccgtactatgtgttatgtctacagagagattgaaaacaaatcaccatatcttgtcggagtacaagataggactggcctccctctcaccctgtcagaagcttcgtttcaagtatggtgagagtcctctcgcggcggttacagttaagatcaaaattggaaagggttcaaccccttcgttctggtggtactggcaccaattgttggaaataaacactggcgtatttgaggggatgtttttcacggtgaacactatggtcaatcacatcgtgcaagaagggaagctttggttgtagcgaaacctagtcccttatgaattccttttggcagttagaattccttatgaattctctttttccttgttgctttaagctgatcggttgcctttctttcttagttagcctagtgtgctcttcccctctcccggtaaggcggtaacccctaggacttgacttagtgggtggcagttataaaaactgttttttcttgctaatatatcgttgtgcaagccttgtacgggtttaaagaaatactccctccatttattttttatagtcatatttcgaaatctgaaaattttatttttgattggcatatttcaatccaacaacctatcctcttaatgattttgtcaaatttaatgcgtgactctccattcttccacacatgattggctatatgagcattgagaaatgtaaatattaattaatcgcttgtttacgaggaatgactagtagcatgtttaaatggatgataagtagaattacttattcttggtctatgtgtcagatgaaatatgactatcaaaagtagatgg

SEQ ID NO: 58510 - DNA, 3384 bp, Oryza sativa
atatatatatatatatatatatatatatatatatatatatatatatatatatatatatatatatatatatatatatatatatatatatgtatatatatatatgtgtggactctagactcgtcttttaatatttcttttcttttaatttcgaattttctgtaaattgtatttctatatagactttatgctcttcttccaatattatttatttttatttctaaatttttattatttctaattgtatttctatgtggactctaaactcatctttcaatattctttaattattaatttcgaatttctgttacttctaaattgtattcctatattgactttaaacttttcttcccatgtttttttaaaattttaaattttagttatttgtaaattgtattctatatggactctaaactctacttttaattttattatatttattttaaattttagttagttttaaattcctatatggactctatactctacttctaatattccttattttttaattccgaatttctattattttcttaattgtatttttatatgaactctatactctacttctaatattccttatttttaattccgaatttcagttatttcctaattgtatttctatatggactctgccttttctttttcttcgattaatgtgaaaatttctaaaccatgagagtgaacgtggaggctcatttttctatttctttaataatataaagatttttaaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagccagtgttgatagcgctacgagggacttaatatctccagccagtgtcgatggcggacttcgctaccctaacagaaacggtaaatctaattgaagaggcctctccaattagtcttaaccagagacacccacgtgttaatactttatgagttttggttattattaatccattaagcaagtaggggaaatattcctatcatctatgcttcaaataaaattttctcttaaattaatcatccgatttacaatccgattacatcattgtgttcgtaataattaaatctttacaataaaatctcacatgattatactttgatgaaaaatcataaattacttttatgatatgtctaacttacttttagatttcagtaagttacttcttagacatataaaagtaaatttagtaaagcctaaaagtaatttacctaaattatagaagtaacttataacagaaagaaagtaactttaattaatgcctttttttcattgaacaaattatcatatatatatatatatatatatatatatatatatatatatgttacttttagatttgattaaaatacttcctatacattcataatgctctgaggtgattacttttattattattttagttaattccataatttgtgctgattaatttattttctagatagagtcatgtttttatctctacaacggatttacttcaaatgacatgctaaagttacctttattttgttctaagttacttttataatatatgtaaattaattttaggttttactgaatttacttttatatatctaagaagtaacttagtgaaatctaaaagtaatttagacatatcataaaagtaatttgttatttttcatcaaaatataatcatgtgagatcttgttgtaaagatttaattgttacgaacacaacggtataatcggatcgtagatcggatgagtagtttaagagaaaattatatttgaagtataggtggatggtgcctctatatagagtggtagctggtttagacaaatcagctgcgaccagcgcgcgacctcaagtcgatcaatgtgcgacctcaagtcgatcaagctggtagcctagctggtacccccgtttttcctatacggtgtaactaatggaagaataaagatcgcggcttcagtagcttcacaagaaaactagttagatcaatttcgttttagcagagatgatcgtgtaagactaaggctaaatcaaagtgaattggactcttaacacttccatccgagcgtgcaaacggcaaacatcagcagattggagggccaccagaaaggcacatttaaccccatccctttctccccttctttgttccttgcttgccgaccgagaactctgatcgtgacggggccagaacaaaccggcactacgtacactgaccggccgcttggactcggatgagctaattaatcaatcaatcagtccgatcgagagtttttattttcaattaattcctatcttccgttggactttgacgctttgattagaaattaatcgagtttgttaatttgccacgatcggatccgcggttgctttcagtgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcggggggggggggggggggc

SEQ ID NO: 58511 - DNA, 12236 bp, Oryza sativa
ctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccatagggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtcccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgattgttttaaattcttgtacacaattgtttgctctggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacgagaagaagtatgtattttccaataacttgaaagacacacatgcacacacgtcatcacgcacgcacatcacagtcacacatcctcgcaaacacgctaacacacgctcaaacagaagaggctagtggcgtaactgctacaacttttgcgcaatatctatggacattaggatttaaaaccttagaatacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatatatatatatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaact

SEQ ID NO: 58512 - DNA, 53672 bp, Oryza sativa
tttccgtgttgaaaaatactaagccattcttacctgctcgtaacgaccaagtgtaatgaaaaggaaagcatcaagaatgatagtactactgcaaagttaaggattaagagtaggcaaatgcaatacaagtagacagcgcagttatgcagaatggaagagctccaaagaagtgcaggagtgcaactctgaacttcctagtctccgaatttttgcaattgattgatgttcaggtccaaacagaacctcttctcattttggcacaaaaacgaacaaaagaactagtatcatgcatgattcataatagtatcatcttcgacccaaaaaaaaaagaaaaacctaagtaaacataggtaaagaatttacttgtccaacagcaaggacaactgctactgggaccactcttataattcatcatacaaaaggttcatgttcatgaggaagctcaggggaatgtgaaggagccgcctatctgcgagttctgtgacggcggattgatggcaacccacagcaatgagatggtgatggcaaggaggccagaccagacgaagacgatggtcggtgttcgtcctctccttcccattagccccttggcgaaggggtaaaggtgagccagcacccagaagctgaagaacacgccgccgaggagcttgctccactgagggatttcactgtatattgtcctgctgaacccgacagcgatggcgatcaggttaaccatcatgatgacgatcggtgggatcatgagtgatgtccacttgacgatgtagagatcagcaaactcgtcgtctgcttcatctcctccagatttggatgtcagcgtgaaggagatctcgataccagcaatcaccttgagaagaccctgaagaacagcagcaaggtgggcgctagttcctccgattagccagaactgctcattcctccaccattcctccaagctgatgcctgaccacttgatctcgagcaccgcaagcatgcacattgtcagagtgataacgagcagataggtcaggaaggtcacatttagcgtccgcacaatgaactgtcccgagaagagggacagggctggcaggaagcagtagacaatgaggaagattgatgtgaaggggtaaatgccaacgttcaggtatgcaatcctctgaagaaacttcatctttcggcttgcaagtagtgcattgttgcgggagaagaagatttccactgaaccagtagcccaccggagcacctgatgaagacggtcagtaaggttgattggtgcagtgccacggaaagcatcacgtttggtgacacagtaaactgatttccatccacggttgtgcatcctgtaaccagtgaccacatcctctgtgactgaaccatagatccatccaacacgctgaccccactcagtcttatcttcataccagcatgagatgacactgatagcctcagcaactgtggaagcatcgagaaggtcgcgagggacggtgagagcaccaggaggacgtccatttttgactccaggatggtcagcaagaggtcgcccttggaattcagcaattgggatagagttgatgaggaagtttgaattaccgaacttcttgggaaattgtgacatgttcatttcctcatcatcaaaatctgccattctcaaagcctgcctctcttcagatgcaactgtggaagttttaaccttgcgcctctgggggaagcaacagctgcagcaaccactatgttccttggagcgcggtgggtcaaatccatacaaagcgatgcgacggaaaagacatccagtgccgacgtagactggtcccatgataccatcaagtgcacgcatgttgacatcgaagaagacagtgttgtggttagcatatcgatctgatggatcaatgccctcaaaccgttgagggaactggacatagccaatacggtcaccaccacgatccatcatgaagcacatgccttcacggaaagcttgtgagttgtaaacatagtgatcacaatcaaggttgaggatgaaaggtccatttgacatgacagcagatgagcggaccaacgcattcatcgcaccagccttcttgttgtgatcataaccaggacgcttctctcgggacacatagaccaacattggcaaacggatgtcaacctcagtgaaatcaagaggtctgccttcttcaccgctggttccatacaagggatcatcactaggaggtttcagcattacctgaacacaatacggcaatgatcaaacaggtggcattttcctggttcactactacaagatagatagaggcaagccccatagagatactgctagatattaaaacggtaaaaaggatgcacatgcttctgctcaagggaaaaaacaaaaatgaacagtaatcatttgtgcaaacgtgcaatactgtttatatgcagctagctaatatatttcgattgcaagccatatatgaaaagcaaggagaaaggtgatgtaagaatgtgaaaagccatatatgaaaagcaaggagaaaggtgatgtaagaatgtctacctgaattattccagcatggtcaccccgagcatgctcagcagagggctgaatccaggtaccaggccaatgcgtgccatcagccatccaggtagctttagggattttaacagcctccaccacgtcatcgagagcagcctctcgttgccgcttcatggccttgatttcctccctggcatgatatgcatcggagcggcgacggattgaatcaggcaagctattgatcctgaccttgaactcgtcgtactccctcttcacccttcttctgtccttgacaaaatcagaacggaccttgttcttgtatgggtccctcttcagattaaagtagctctctgggttgcgaggctcaatgtcatgtttgcgacagaaaggaacccacatgtttgcaaagctagcggcttcagccattgcttcaaatgtcaggagagcgcctccatcatcagaaacatagcaagaaagcttctcaacaggataatcagcagcaaggatggacagaatagtatttgctgtgaccaatgggggttctttttctggatcagcagtagacacaaatatatcgagccccggcaggtcagatcttccgttaggatttgatggcgtcggggtctcaaacttatctttcaggacagcaaggtcagttgctcggttaacagggcacaactttggcagctgatccaagagccaagagaggccaaaccagagttcgcaaacaacagacatgccccatagccacattgcatcctcattcttgtgcttaattctccatgcaaggaatagaccaagaacagccatacgaataagaataagaagcctgcatggaacaaccaaactaaggttagcatctataaactgaattataagattagctataatattgtgtatttgtttggaagctggagagatcagaggaaatagaacagatctaacaagtcagctaacatatttatctattgagcagagatctaacagctgggagtatatatctacaaatccaggtttgttttttagtttcatttccaacactaaacaaatcaaatgcatctcaaaacaatatagtactttctaccagatcaacggatccaatcagtcaaatgtgagcacatggatggacatgtgagccattcacctgtatgggctaaggacacccgcaggaatcttgagcttgcgagtgagcggcctccatggcttgctcgtgaactctgccggctggccgtcgcctccacccagcccgccgcctccgccaccgccaccgccattgtcgacctcgttctccttgggccaaatggcattgccatacccgtatgtccccttggtctcgaacagccaccgattgtgatcccaatcgccggtctggctcctggtcatggccttctgcgaccgcattatcgacagccgcctctccatcctcgacgccggcaagccaccgggcggcggaggcagcgacagcgtcggcctcgcaccgaccacgtcgtcgagctcggtggccttgtaggggtccttgcagccggggcaggcgccgccgttcttgacggcgtcggcgaagcagtcggcgcagatcttgaagtcgcactcgcaggggaggatgtcgtcgccgcgctcgtcgctcatgaccttggcgtcgcagccgttgatggcgcaggaggagcccttggcgccggccatctgcgggtggctggcctccgactcgatcaccttgtccatgaggtgcgcccgcgtgacgctgttgaagccgccggtgaagagcgagttggagacgtactgctcctccacgcgcgccgagatggccgggtccatcggctggttgtccggcgtcgccgggatcgtcacgtggtagttgaggaactcctgcccagactccggcgacatgtcgccgctgttgccgagctcgctgtcgaggtcgtcgcgggagtagctcacgtagcgccccgagtgggtgcggcgggcgaacgtcaccatcggccggtcgccgccgccgccgggggcctgagcgcggccgtcctcgccggagtaggacatgcgcgagaggcggctgctgttgctgtgacgcaggccgccgccgccgctggaagccatggatcgatcgcctcactttctgatctgcgaatcgaaggaaccaaatcagcatcgcgaggtggggatcggaaaattaaagagctagtctttatcgcgtacgaggataaaaatggcagatttgtgctcgaagattcccgtctttggaaagaaatcagaatcagacaggcagcgagagaataggctgaaatcccgggacccaaacccaagattcaaactttggaaagcaaaagggaagaacaaatctgagcagcaaaaccttgtcgccgtcgcccacagaacacgaagcaagaagcataaaaaaaatcgaatggaatccgaagagataaattcagtgttcactcaaccctaaatccaacaccgccggcaaacgcagactgaccgattcaaaaaccagagaacagcccacagattcatcagatcagatggatggaaatggttttcttaccatgcgatgcgaccactcgaatcaatcaaactcgaggaggagtaagagagatgggagtaatggcgtgtggtgtacttgttcttcttcttgggccacaacaacacaacaccgtatgaatggaaagacaatgagcaatggaaggggaagggatgcgagttaatgatgatagactactcgtgttagcaattgatgaggaagatttgggaagcgaagagtgagtacaagtactagtggtttggtgaaagctaagctcggagaagacgacgacgaagtctcacaggaagcaagcggctgctgcagcgaggaagaaatgagtaggaggaggagttgtaggcagaggaaatggaaaaaggcagcacagcacaaagacgcgtgctcacatggggatgggggagacttgggaatggggagccaaaatatttcaaacaaacggagagatttccttttcttttttttttttgaacatagacatgtaaaccctatccctatgagtatctttaaagactgggccggcaaatctgaagattgacgaaatcaccacatgcgtttcgctgtcgacggatacgttgcataccattgaaaggacaaagccgttaaattctgaaaaaatcgctcctataaagagtcgaacccttatgagagaaattcttcgtttgtttctttctttgtttatttatttattgttgtggttttttcttaatcttaaagcttctttttaattggcggctgctggcctgctgctgcgtgcatatgcaggaggggaagagctgtaccaggaaggaagcgcgtattacagggtaggatgcagctggccaggtgaccaacaaacacctgccagtgacggtgaattctgcacaaatttattttttttgaatatctgaatgattcacgcgttttttaaaattttaatgccaggctctaggcatcaattactaccaaatctgccgtgagtccccaccagggttttgcaaaatcacgcagctaacacgtgtagtaaatcttcttatttattaaaaccgtgataactatacggttttcatggttatcacaataaacatcatatcttggaatggcgataattttatttaaaatagtttggtaaacccgggtcccactatattagggtgatatgaaaatctcactatcaaaagcacaggtttaagcttaacaacgagcggagcgtgtctgactgagcacgcacggttattagatcaatcaaacacaccaaacccactttgccgtaacaatctgcatgcaggtcatttttaagtttcactttatttatttacaaatggattgaaagtttaatactcaagatagtgtcaggagatgatggtgtgaacgggagcggagggttcagatttcagaatgcacatttctcatttcgcacatgcacggatgcacctgggtccatctgaaaaacaaaattgccaaaccgcattcataaacaccaccaccgccatcatcatcatcatcattcatatcagccacaccgctgtatatgaagagtacaccgtaccatctgtctaaacaagaatcaacttctgtttcaaaacatttatctgtattaacttcagaagttgattgaagggagtatgagttaacaaataatacgacatgtgtttaacttggacggcacataagggtgacataaacaatttggggtgattgagatcactggcaaatttttttccccgtctattcgaacgtttgaaaacatgtacggagtattaaatattgataaaaaaactaattatacagtttgcgtgtaaattgcgagacgaatcttttaagcctaattgcgccatgatctgacaatgttgtgctacagtaaatatttgctaataacggattaattaggtttaataaattaatctcgcagtttacatatgaattatgtaatttattttgttattagcatacgtttaatacttcaaatgtgtgtcagtatatccgatatgacacaccaaaactttacacccatgcatctaaacacacccttaatttcgtttggtttgaggagttgtgtaagtatgttggtgttcggtgttccctggccccaagctggcagcatactagtactcctattgaaatggccaaattaatactggtgttcaagatattgcttcatggaccacaagttttgcattgtagactagttgcatatccattccttgcattgcatctgctaagctatggccgggctgtgtgtcaaccccacagcttcttcttcttctttcttggcctacaaaaatcagcaccaacggttgtgttgggtttggggtttccatgtgtcccaagttattgtggggatgcaccgacttgttcttgtctttggagtttggaacggttcaactaattaattaattaatcatgcagacaccaagtgctcttgttgtttgcttccaaaggtgtactagtacatgtacaacggctagtgttatcctcatcaccggccggttctttcagtttcagctgaatggatagatggacgatggcttatctcattttgtgataatatttatgtcttacatagttgaaaatatgttttaaaaattactatataaggccctgtttagattctaacttttttcttcaaacttccaactttcccgtcacattaaactttcctacacacaaacttccaatttttccgtcacatcgtttcaatttcttcaaacttccaattttagcgatgaactaaacacagcctaaaaaaagggcatttaactatttgccacgtttaatatgtggcaattaagaatttgtcacctacagtctatggcacgtgggtcctcatgtgtctattacacgtgggttcagtggaaaaccttaatcattaattataagagtggcaaatagataattatctctaattcataagaactatactggcctgaattcacaactctctaattcacaataagaagaaaacaacgggcctgaatttggtagagagaggccggccggcgttgagaactatactggccttcaacaacatcagttcagggcacttctgatgctgaataatgctctgtgaagtgagtatactgcaggttgtctgtttgtagatatgaacattttgaattgatccgaagattggttcgtggtagggtcgcaatcacatgcattaattatgtggagattaactagctagtgttgagctggaatgaattcagattggtgagcagtttaatgaaatcactggtgtccatatggcacatatgaatatgatccgccatgtgcacatatgcgtcatccgggccatggattatggagtactactattatttggatgcttaattactttgttgaatggatcggcgaagaagagagcagagcagagcaaacacggcagctaccaagaatttgccattttatttatgatcaattgatctcaacaaggccaagttataggagcatatatactccatgtttaattaaccagccagctgattgcatgcagcctatcacaattcagaggatcgagatgacacgtaaacgtacgaaatacttcttctgatttttaattcataataacacagttaacttttaacacaatgttaaccatttatcttattatagaaaattatataaatatcatttatcttgttgtaatttattttattattaaataacttcaggtatgacttatactttaacatatttatattaaattttttaataaaatgaatggccaaacattattataaaattaatggtgttatccattaaaacatgaaggtagtatatatataagtcattgattaattgttgtgttttgtttagaaattgttgtgtaattgaaatcacagagctatacgtacgtactgtatatcacgaaaattgaagcagcaacagcaagtagtagcataatatagagaaacggtctatgtacttcgtatatacttatgtatgggatgggttgtgttggaattagtctcaagactaaaattaagtgcagtactagcgaaaggtggtgatgattaattcaattgttggacacgatacgtgtacgtacgtactttaggctagtaataataagattagcttatgttccggctattcgcgccggacgatataaaaacgatgaacgcggtggagaccaagtctaaatatggttgaccacgtaaaattcatagaaatgaaatgggcatacatattttttttttgaaactagagcacgagggcccccctttccattactggaacggcataaaccaagtcattacaagcagaaactggagagagaaaaacaaaagatgttaagagaggggaaaaatgtccagcaaagctgaaaccaagtcatcttcgcagaggccagcgcagaagggctggggagagaagactgaactgaaggccttgccatcgttctagcagaagactagagaaacagaggaagagaagacagagagggagcagcaagagagacaacattgtctacacacaaaagcacaccattagcagcttcattccagccttttaacacaaggtctccaaccgtatcttgaattgaaaacatcacttgccacctgctttaccactctggctcccagctccaactttcttccgtttgcctccaaattctgcaaaacagcacaggattcaatcaaatgacagatcataaaaatcacctcaatggggtctttaggaaggatattatcaaaacaagctttgttcctagtcttgcatatggcccaaatagttacagaaacccccaccagcaacaagtttttcatgtttttgttaaaaccagaagaccaggaactaaacagctgagttttatccaaaataggtttcaggtcaagagcacaggtaaccacattccaaattaattttgcgaaggggcaatcaaaaaataagtgctggatagactcttccctgcaacagaactggcaaattttgtctccctttcgccaaccccttttataaagattgtccttggttagaattttatttttgagaaacagccacaagaaaatcctgatttttagcggcactttgatattccaaatttttttaaaaggacaagcagtctgttgcagtttcagagctctgtacagagatttgactgtaaaaaggccatttttttgtcaagttccaccaaagcctgtcttttttgtccacctgcagttgaaacccttcacaatgttgttttataaaattccaatcagcaagtttgtcaccatgaaggacccttctgaatttgattttatcccaaccccccagaagcacttcatgaacagaaatctgctttgtgtttgttaggttatacagggtggggtactgcaaggctaaaggtctacctccaatccaattatcttcccaaaaaagagtttgttttccattccctatttttttggtgcaaaacctatagaaaatgtccctaacctccatcagcccttgccaaaagtgagaatctccagccttaatgggcatacatatgttcatatgttttgatgctaatcgttgctagatattttctccatccgaaaatgtaagcatttataaattaaagttatatacaaacattaagaaattagataaaaatgattgtactagctaatacgatggatatatgtgggtgtactctctcttaaaaagaaacaattcgaattatctgttcagatttatttttagaatttagttttttctttaaagcgtacggagtaaagaagcatcatatgaatgctccatcgatgtcatgtgagctgatgattgtgttcatgttattgttgcagagtgcagacacagggcaggcaggaaccaatcgatcaattgaccaacaaaacgcggtggagtttggttggtactcttttttttctttttttttgtttggttttgttaggcaccgatcgattttgcaccttataattatactgttgcaggtgcagccctgcactagcacacctccgtgtcttgtgttgcacatgcgcaaaataaacatcttgttctatctcactctcatattatttgagtaattttattatccttggagagatacttcgaaggtctcatattctctattgtaaaatttgatacctctagttattaagtatcttaaagtatccaaaattttattataaaatttggatatctcaatgtattttcttaaatactgtaaaattcctcgtattatttgggttttagtctcgcccacaaattttaccattttccttcccttgctacaaatgaaaataaatggatcaaccttggaaaataaatggatcaacctaccaagtagtaccaaagcaccaacattacaacattatacatctttctctatctactcccctgccccttttacatatgactctcaattcttttcataccataacattatcatcatgtaagtgtaaaccaaagtaaagtgcggggatcgataagaaggtgggaattgggggcattaggaaaggacacaacggttgtttagcacatatcaccaccaaagctccatgcatcggtcttctcccccaaggatggcactcgtccctttgtactagtattgcatcttggctgtgtttaattcacaccaaaattaaaagtttgtttaaaattagaataatgtgacggaaaagttagaagtttgtgtgtgtagaaaagttttgatgtgatggaaaagttggaaatttgaataataactttgaaactaaacacagcgcgtgttgctcatcttactctgagttcaggatgaagaaacctcccaccgtcccacattacatacgagccagcttaggctgtgtttaaataacatgtgtgaaaagttttggcgtgtcacatcggatatacggacacacatttgaacaaaacaaattacagatttcgcctgtaaattgtgagatgaatttattaagcctaattaatttgtcattagcaaatatttactgttgtaccacattgtcaaatcatggagcaattagacttaaaagtttcgtctcgcaatttacaagcaatctgtgtaattagtttttttcgtctatatttaatactccatacatgtatccaaacatttgatgtgacagggtgaaaagtttttgcgtgggacaaatagggccttattcaacatgttatatatcgacatcgtcatatttcccatgtcagtttatatgcccccatcatgtttacaaataatctatgttatcttaaaaaaatgtttacagataatccgacatattttctttgaatgtcatgctgctcactatgtacgtacgtagaatcttttgtacaatacgtatgtactattgatgagttgatcattaaaagatgaaatgaatactgtcttcagtcaagtaatgtagctcaccaatcttctcctgttgtacacaatgcttgcttctagctagcttctcctcttctctcatacccatacatatcacatatgagactcttcgtcttcaccagctagaggagtgatcagcaatataatgcaatgcaagctccatggcctattccatgcatgcatttacccaagctaaccgaagttcatatagtgtcttgaatcatccctactagctagcagagtacatggggaaagaaacaagcattgctccgtggaggtagcagccattgataggttctactgtcaagagtccatgataaacttgtcaatcttttgatgccctaccttccctttgtcctcacatgagctgaagacatgtactctgcctctaaattaagatccttggttgacgcaggagatgccattcgagcgcaaagacgccttttggcttgccctctttgcaaaattaataatggatttgtacgtgtagaccgacttgttttttccctttcagcgtgtaattttgagagacagatggcattggttaagaattagtccatgcatgagtgtaaaatatgttaacttcttttttttaagaaaagagagagagagcgcgcgcgcagcgcatcgatatgtgtattgatccattctctctttttattttttgaaacttgtgcattgatccattctaatcaaccaagtaattattacggagtactctttccgtttcacaatataagtcattttagcatttttcacatttatattgttgtcaatgaatctagatacagaggcagtataagatacaaacatcgtcgttattttgttattttcattcgctaatgtgtacacaatgagccaggcccaaacaattaacagtacgtgctcgttcggcccacgtccattttctctctgaaaatgttgctttggcccttgtccattggtgaaactttgtcaaaaatataaatttactcaaatataattaatgaaacaacctaccaatataatgctcctcggcctctatatagtatcatcaattgtccctcttatgcatgtatatatggccttcaattcctctatattataattatacttatagtgccgtctaattaaaaaaaagaataaaaatgtgtggagatcgatcgatgggaggagaggggaagggatcggaatgggaggcatcaggaaattaaggaacaccaattgctgtacctcagttcatctcgcagccgaaagatcagacatatcctttctctacaagatgtcccgtgatgtacattccagttaatcgatcaatgcatgcattcatcttgttcatcagattactgcacttgtcgatcgatgtccttccgttatcgccaccgtaccatcatcatatttgacatactatttcatgtatatgctaatagaaacctctgtatatacctgattaaacatgtatttgcaccaagagaaatcgcagcttaaacctgatctagacataacaacttagtactaacggcacaagctgataatgctacctaattctgaactgtagagggtatatattcactcaaggaatgcatatattgtttgaaaaacctgctcaatattaatgcatttcttcctagctcaaccagtttacaattaatcgtccttgatccgatatataaacaattattcataatgttatatttacactttctttaactaaaatgttatatttacattgatataacacgcactcaaaacgtgtactcctagtactagctagtgctctcaattttggttgttcaattctaaccatgtcatgtatattaccgtgcagatcaatgagagtcggcagcggaaataggattcttctaaatctagagctcagctaatataatttacatagcttttcctttaatattctactttttaaagttttaaagtacaattctaatggatatttagactcagtaatagagctgcagccctagccgtcctactcctgtctccgccccattgagagagaatagtgaagcataagggaagaataaactgttctaccatacacctcgaacccttcaacgatggtttagtaaaatgagaaaacaaaaatatattgcttctgtttcgtttgacttttttcttagtcaatgttttttagatttgactaagtttatagaaacaatggcaatatttaaaacactaaataagtttattaaattcaacattaaatatattttgataatatatttgttttatattgaaagtatcagtgtatttttctataaatttagtcaatttaaagatgtttgactagaataaaagtcaaacgacttacaatataaatcggagggagtacttttttttaaggacgtgactacacagctagtgatagctggtttgtctaaaccagctaccactccatctatgagagactctatccacctatacttcaaataaaattttctcttaaactactcatccgatctacgatctgattacaccgttgtgttcgtaacaactaaatctttataacaagatctcacatgattatattttgatgaaaaattataaattacttttataatatatctaaattacttttagatttcactaaattacttcttcgacatgtaaaagtaaattaaataaagcttaaaagtaatttacatatattatagaagtaacttataacaaaaagaaaagtaactttaatgcataccttttttcattggacgtgactgctggtttgtactccaatagtatgtatcttttttaatctttttaataacttatgtcttttaaatcacatattgtttttaagatatatttgcatcattgtactccactcaaaatatgtgacaaaacgatattcatattgaatatattctcattttatttaatttaaaagtaatttattacatgttagaaagtaactattacatcttatacatggttaattcttattatttattctatcaatgttatttacaatccatcaaaggttttatcttcttttctcattctacataaaaaacaaaaataaaaggaaaaaaacaatcggtgattaaacagatttatagagttacttctgaaccatgcaaaagttacttccaattaatattgaagttacttttaaaaattgttaaacttacgtgtgttgatctgtgctgactaaatttaatgtctagataaagtcatatttttatccctactatgaatttacttctaatgtcgtgacaaagttacttccgttttgttttaagatacttttataatatatgtaaattacttttagacttcattgaatttacttttattgtctaagaagtaacttagtcaaatctaaaagtaacttatatatatgataaaagtaatttacgtatataataaaagtaatttacaaatataaatattttttcatcgtcatataatcatataagatcttgttgtgaagatttaattataacgaatgcaatggtgtaatcgaattgtagatcggataaataatttgagagaaaactttatgagaaggaagaaaaagacatgcatgtctaagagtaaaaatagcatgtacgtcagcacctgtaacagtacctcttctcacaattggttcgtcgctggttaacactaaatagagaggcttctcggtttagattttgcctttttttaagtatgttttgctcaattcattttacaacaaatcaaatcttttttctaatttttgtccaagtgagaaatagctactactcctataagagatagtaacaaagaaagaaacaaaaagggcgcgcgtagcgagtgccagtggcggttgcatgtagagccgcagaccgcagtcgagatggtgtgctccgtggctgccaccgcctcgctcctcccctctcctcctcccaaacccaccgccctcgccgccgacgaccaccacgcccgcctcagggcggcggccgcgcgctccgacctgccggccgcgctggccgccttcgtcgccatgtcctccgccggggcgccacccgtcctccgcaccttcacctccctcctcaagctctgcgccgcccgcggcgacctcgccaccggccgcgccgtccacgcgcagctcgccgcccgggggatagactccgaggccctcgccgccaccgcgctggccaacatgtacgccaagtgccgccgccccgccgacgcacgcagggtgttcgaccgaatgcctgtccgggaccgcgtcgcgtggaacgcgctcgtggccggctacgcgcggaacggcctcgcccggatggccatggagatggtcgtcaggatgcaggaggaggaaggggagcggcctgactcgatcacgctcgtgtccgtgcttccggcctgcgcgaacgccagggcgcttgctgcctgccgagaggcgcacgcgttcgcgatccgttctgggctggaagagcttgttaatgtcgctacggccatccttgacgcctactgcaagtgtggggacatccgggcagcaagggtggtcttcgactggatgccaaccaagaactccgtgtcctggaatgccatgatcgatggatatgcacagaatggggattcaagggaggctctggctcttttcaataggatggtcgaggagggtgtcgatgtgacggatgtctctgtcctggcagcactgcaagcgtgtggggagcttggctgtcttgatgaagggatgcgtgtccatgaactgcttgtgcggattggcttagactccaacgtgtcagtgatgaatgcactcatcaccatgtattccaaatgcaagagagttgacctggcatctcatgtgtttgatgagttggacagaaggacgcaggtatcgtggaatgccatgatccttggatgcgcgcagaatggatgctccgaggatgcggtgaggctttttactaggatgcagttggagaatgtgaaacctgattcattcactcttgtcagtgttattccagctcttgcggatatttcagatcctctgcaggcaagatggatccatggatattctatcaggttacacctagatcaggatgtatatgttctgaccgcccttattgatatgtatgcaaaatgtggccgtgttaacatagctagaattctgttcaattctgcaagggagaggcatgttatcacatggaacgctatgatccatggttatggatcacatggttttggcaaagctgcagttgagctatttgaagagatgaagagcattggcatagtgcctaatgagacaacattcctttcagtcctctctgcatgcagtcatgctggtttggttgatgaaggacgggaatattttaccagcatgaaggaggactatgggcttgaacctgggatggagcactatggtaccatggtggatcttcttggccgagccgggaagctagatgaagcatgggctttcattcaaaagatgcctatggaccctggccttagtgtttacggtgcgatgttaggtgcttgcaagttgcacaagaatgtggagttggcagaagaatcggctcagaagatttttgagctagggccacaggagggagtgtatcatgtcctcttggcaaacatttatgcaaacgcttccatgtggaaggatgttgcaagggtgagaactgctatggagaagaatggcctccaaaaaactcctggatggagtatcattcaactcaagaatgagatccataccttctactctggaagcacaaatcaccagcaagcaaaggagatatattcaaggttggctaagttgatagaagagatcaaagcagtgggctatgtgccagacactgattcaatacatgatgtggaagatgatgtcaaagcacagctgctcaacacccacagcgagaagcttgccattgcttttgggctcattcgcacagcccctggcacaacaatccagataaagaagaacctccgagtttgtaatgactgccataatgcaaccaagctaatatctttagtgacaggacgggaaataatcatgagagatattcagcgattccaccattttaaggatggcaaatgctcatgtggagactactggtagtgaagtgttgagacagtttgaatctgcacccggagatgagggagcttcagaaagatcagagtatcagatctgacaattaggtgaaactaattggcaaagttcttaaggtaattgcttagttttatacgtggtacatgctatgcgataataggattctacatatatggttttctattgccaacgcccttgccaatgagttttaccttgttttattgtagggctgtgcagctgcctcttatatcaacactaaatggctaaacttgtgaagtatctgaaaattgttatagccacttcaccttttcaggaaacatactgcaaattccagtcagtcattgtaaaattgaaatgcttctatttacattaagatactagtgcatagggaacctgttcttcatagcaaccatgactttctcatgtcttatctttggcctgagattagattcacatgttcggtcgaactgtcaataactgaaagttatcattttcttcttaccttttgatcatggattaaaaaaccgtactgatgtaatttgttttttttcgtaaaaagcaacatcatctgctattccatttgcaataaaatgatcgcacatgcatgcttacaagtttcaacaaaataattcaacactaatatcctttatgggagaggacatgcacttgaagctcaggaaagcatcttattctgaatgcagctactgctgtaaaatgttattccagggcattattggatcagcatggatgtgatctttttccttcagttattagcacttcctgctgacattgttgacttctgtttcccgactgtagcaataaactccactgccactttgagtgcattaatagatgccaggttcatcaggcttgttgacgaccatgttggctcccctccagccaaatcagaaactccccggaatacaatcacaggtatgccaggagatgttgttgtctgttgaaattagtatatgttctgttaattatataaatctatcttaaccttcatgattgcatgaaaaatgatgtgtaaatattggcagatatttaagtggaaaccatgagagataaaatacaaaactcaccatcaccactgctgcactctcctcatctactgttgatacaccaaattctctgaaaaggaacttcctatattctgcattgtctagaaacatatcagctgacgatccttttagcccacagactacttttggagttgttggcaagcagaaagtgtcgttacatctttcaagtgaaacctataaaaatttcacaattagtacaatttttcgggcattaatggtcaagcataagctggcatttattatgctatatctcaccttaagtccttctgcgattttgaaccatgctgaatctacaggtaaccagaaaacttctttcataggcttacccactgagtatagctcctcatttctgaatttcagagctcctagaagattctctcctccatttgggacagtaaaatctccaaagctaagttctgtatccgactcttttggtgatttgaacttctaaaataatcaaaaacaagaagtcatataaagagttagtttgaaacgtgagacagttggtactaaaatactccctccatcccaaaatatttgacaccgttgacttttttaaaaatgtttaaccgttcgttttattcaaaaaaattaagtaattattaattcttttcctatcatttgatttattgttaaatatacttttatgtatacatatagttttacacatttcacaaaagtttttgaataagacgaacggtcaaacatgtttaaaaaagtcaacggcgtcaaacatttagggaaggagggagtatgttctaattatcctgtagttgtgcttataaactgtcctctactttcactccaggctcgatgtgtgtttacctactaggctactactaaatgtgattttgatttttagtataccatagtatttaaaactaacatgcttatataagcattgctagtttaattttctctagtcagaactaaatttattaatagattagctgaatgttcattcatttgctaaagattaaaaatgagccactcatgtcctaacattatgcagcaaatggaatttttttttattgaacacatcaaagcagtcagtagaagatgtagtagagagaaggctgggtggtagactcaccaaagcattcttttaaaagtacagtagtgtatatattttgacacgatgtaactaatttaatgattcaaagcaactataatactggatttacagataatcatattccattcttttaaggggaataatcagattccagttgctttgaatctttacttctttgaggttggaaacggaatcagatcacagttggagggtaccttccatgtccaagcacttgtataagcaacaaatttggggacactgacatcgccaaatgacattgaatcattagaacttcctgctgtgccataatgaacaatgccagacacagtaaagacgtcgatgagagtctgtacagtcacagccgcatttaactggaagaacaaaggcatagtaacaatgcataagcatagcgcagtttgtattaaaatcctgcatgtaaatagcatctcacagcagtttcttttggcattacttgtgatatatgaaaatggttttctccatgtatcacaaggcagataatgtaaacgcaaataacttatgaatttaataccctgcgttgtcctgtcagtgcatatataacattgacacctctaatactcccgatgtgataccttcgtcctgaaatttgaagagttcagcattttattcttgagagtccattataagatgtaaaagaattaaggactacatgagatgttctgaatcgaaattgaatgggaatataatatatcagcggaatataaaatttcattaaacctgtaaaatgaatatttgatacaatgaaaatgtggtatattattgtattttttccttttgtgttctccttatggcaaagttttctattttatagtgcatctatcaacatgatgtgaaatcttggtttacggctttacagttcctgtacagctgtaccccgttctttgatgtgttcatccaacaataagtaaatgggacgatgtgccaaaccacattatgaaattgctaattgacaggctaaaccatcacatgttgaattcttcaggtcttgattgagcgcagatcatttaaatttgcagagcaagctggcttcatcacatatgacaaattcaggtatatctaaaacttgtattcgatgtccttaaatgttgaaactactgtccttcgggaaaaaaaatgctgaaactaccactgacttcaatagtagcattatgtatccatatgtgcatttgttctgtttttggtattttggttcacttagcagttttagcagtagttattggatgttggaaatgccaatgaaagacgccaagacttatccattcaagcatgtgggttggaaatggaaggcccagagttaccgtagaggtcaacgaaggggaggacatgccaaggtctgaagtagccggaggattcaagagcagtggcctcatcgatgtacgacatgacgagcccgatggaatggccccgccggttgaccttgtcgacctgccatctcaccctgtccattgcaggatgcactggcaaagccatggaggaggatcctgccagcaggaagagcaggagcagtggcagatggcacctcgtcaggttagagagctccatggccattgatggatgtctggagctcgattactggatcggtgtgagcttagagcagctgagtagcaagctttaaagtccaattaaggagttggtaattggtacggttgatgcagaacgtgatcagcgtgctccaatttagtataatatatatagtatatgagtacggcgatcaaagagggccgccaagtggtggtactaaactactagtaatattgagattgttggatgtgtctgtcatcagtgtcggtttttatcagagaagcttgagctgaatgcaagagagaagaaatcaagcctgcatatgcaaagatttacctccatctccatcccaaagcattgaccatgtacagtaccagtaaaacattgccaaatctaaaggtaaggatttcagctggcccatacaagttcgctgcttttctgactataactgcggagttagcatgacaggatttggttgctcattgctttgtttacttgcagaggtcagaaggaaaagggctgcctgcaattgcaaagcaaccctcggtagttgaagtcacagcgaccgtacaacctcctgcaactgcacctctgcatcagtggtagtagactcgtcgtagatggatcatggatggattgagttgaagcagagagagccttgcctttcaacttctcaccttgccagtatgccacatggggtgaaaactgaaaagtaaaggtactaactgttgactgcggaggcgctgatttttacaactacgatgaccactacagtacatgctctgaagtctcatcaatcatgggccaatggagtgccaaatcattcttatcatatcctggaccctcttgcctgcctgattgtcgtgttcatttgctcccttgtgcacggggccccacctggcagtgacacgtacggctgcacgtcgtcgtctcatccctgtgtgtgtgtgtggacggttggcacagctgcacgtggccctctgacgagtcgctttcgtcgctagctttgctgttccagctggttaaaataaagtttacggccctgctttcggtgcaaagtaaaatggcataagtaacatatgttatttttattacttacagttacaaagttaattagtcccaggtttttcttgtgcaagctcactattagctcccattcaacgacattaaagaaaaactcactcttatgcgcaggtcatcacagcttctactcactagccagtagccagaaaaacaggaatgattaaagagaggatctgtacgtgataaaagccctcatcatgggatcaaacacctattgtcgatcataaggtaatcattatatattttactgcttgctacaatctctctctctctctctgaatctgtttacacacgctactcttgcactcttactccttgttggttgggtcaatatcagacacatggtaaaaaggtgattaggagatcacctccatcaacttgcttcttgcttggtttgttctacagcctgccccagttgcattcacagtagtgactagctacaaaagctgaaagatggcatgcacattggcagtgcttcttgttcccaatataaaagctctataagataaaagaagggagtactatgtactatatatcattcacacgcccatctggctctagtacatatcgataccttttcgtcatctagctagcttcatgtttaatgcaaatccccattcttacatgcatgttgatataggttttcaccgcacacatgtagtagatctcttgccttgtgggcattacgtacagcaaagaaatagttaactagagaaaagaaatcagaactagtgcatatatatattgagtatatatactggtactctcaggagtgatgttttatttcaccaactcacatataggaaattacctcaaaaaaaattatatatagaaactagctagctctagcctctaggtactcgatctcttgtacaatgtacacacattatacaacattaattaagctttcataaacatgttttcaaataaatgacatctctcactgcatgcattgtatgctcagtctccattcatgaaaacaagttaggactgcattcagtaaagatcatccttcatgcacaaattttcttgctttgtggggctctgaaaagctgactctaattgggaactgcacgtgcgtgatgcagcatttccttctttgttagcagtaaaagatgagcccttgcctgtcacgtttgctgcactccatgcatgaacatagctttagacaacatatgactttttcatatagagccagatcatatgctacgtactaacctactttgtctgtctcacacacacacatacagacaagactatattgtatatctatatggtagtgctggcatctcaaatagaatctctttatttctccacaatgccctttatcagaacaaggcatgtgtaagaaactagctaaaatacagtgtctctcctctttttttttaaatctttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattctgcaacaagaagctaggtaagatcaactgaaattttgtgctatatatatatctgtcacttttgtgctttttgtgatgccttcattaatacatagcacaatataattctatatgaaagaaattaaatagagtcacatacatatgggcataaaagtgggtaaaggttacatattgcttaggtattattttgttaccttgagatatcttctgtaaatttcattagctggttctctgatgggtaagcctaccttgctgcaaatagtccatcaggcaaaatagaaaatatgccagacagtagaggtgttagaatacggtctattcattggtatatgcatttagttttgcaaatatatatatccagtaaatcaaatatatattaaacgaatttgggacagttgttaactatatgcttgcaaatgatgcttaggcagtaggaaattagctttgcctaataacacattaacacaggcaggagtcattaacaaattaaagactaacaatgttagcttagctagagaaaatgaattggctagcttccatgcaaagaagtttcaatttaatttaattaatttgccgtgcttttatttatatatcccatattaatttaactcctagtttgagtttctcaaaagacaatatcgttgacttatataataatccaaacaatgtgtattttcaacagttgttcagatataccttttcccgaaacacatagacttgtctttcctagaaacgatgtgagaactaactcacgtctttagtcatagaaagatcatgcatgcatatatacggtacagttggaactctatccatgaaatcattgcatcatcatgagtttcaaaaaccttggaacacttactactgcaaaatggtccttggttcgacagagctaaaggtctagggtattgcacacgctgcatcttttcaggttgcagcgtgcagacctgatatctctctttctgtgcattgtagtactgtgctagctagtagctagtgtagctagtgtgttgctgctgacattttgaaacacattgtggtacgtgcatgcatgaaattttaatttcaatagacatgcatgcattgatggtttcatcagtagttcagagtactggcactactggctactttactactccctccgtcccataatataagggattttgagtttttgtttataatgtttgaccattcgtcttattcaatttttttttaaattattatttattttatttgtgacttactttattattcacagtactgtaagcacaacttttcgttttttatatttgtaaaaaaaaattaaataagacgagtggtcaaacgttatcagtataaactcaaaatcccttatattatgggatggagggagtactatcgagcaggatacacacttcgctaccattgttcgatcgagtaagattgaaagaagtaccctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgaaatttaatagatgaaacatacacgcatggagggtgaaattaaaattgtactccctccgttttaaaatgtttgacaccgttgactttttaagtacgtgtttgaccattcgtcttattcaaaaaatttaagtaattatttattcttttcatatcatttgattcattgttaaatatactttcatgtacacatatagttttacatatttcacaaatttttttaataagacgaacggtcaaacatgtgctaaaaagtcaatggtgtcaaacattttaaaatggagggagtatttaaatatggatgtagaatataattctcttcagttcttatgaatctgtctggttgtaaatttccgcggctagcatgggttgggtgtggtcctatggtggagtactataatacaatacatgaattgacaatgtactggaaattaatcattgtgaagatagtacactttaaattagataagtttttatatgactgtttggctttggcatataatctactaccggccagctcgtgattaatggtcgtttgcctatataaatttctcctctgaacacatatatatagacgcatggtctgaaactctctgaaatcaaagctttaactcatcgcgagttcctcacccacccacacacatgtacaccaaataaagggaggaaaaaggaaagaataatcaagagagacaaacaaaagaaggatcgatctagcgatcgagctagtagtggtagagagcaaaaactgcacaacacacatcacctcactttggttggatgcgctagtagcttttagctttcactagtcctgtgtccaacttatttttctgaaagcgaaagatgactattttgttcagatgatcagtgcatgtttgtttgcaagctctcttcctccagccttcttttctcactctctctttctttctctcctttctcactgttacacacttacaccccacatgatatgatgcttgcattgccttcgttctccatctccttttgcaattggtccctttgcattctctgtagcattcatgcattgcagcaaaagtatcaagcaacacacatacagatatgatacagctagctggttagggcagtcctaaccctccacctaagatggtgtttatggcattaactacattgccatataggacttttaacttatgtggcactatattaattaagagagagagagagagtgaagagaggaagaaactatgtctcatgcaagacatagcttcaacacgagaacctatgcactagacactgtcaagttttgcattgggagataatagtgtcttcataatagatgaagaataaatctgattggtagagaagagagatgatgtatttattaatgatccactttaagaaaccatgggttgtagagtgtagtttctattggagaaaatcccctatgtactcataaaagttcacctaatcccttctatacccctgaattttgctcaatcccttacatacccctgaattttagtttggatcccttccatgccctttccgctagttgaccgttaaattcttttgaaaaagtccattttgccctttgctataaagaaacataataaattaatgaagtatattgttggaatgtaaaaatttattggataagactattatatttatgagtatgtgatgcaccatattatttgtgacaaatttacttttacatatgatataaaaagttgatacgtatttattagttattaaaagttcttttatgtagcatatgtgttttcatagtaatacaacagatttgtttattacttcagaacacatatgctaaaaaaaatcttttaataactaataaattagtattaattttttatgtcatatctaaaagtatatttatcgcaaataatatggtgcataactatctaataaacataatagtctcatataataaatttctatgctccaacaatatactctgttaatttatctgttaatttatatgcttctttataccaaagggcaaaatggactttttcataagaatttaacggtcaactaacggtcaactagcggaaagggcatggaagggatccaaactaaaattcaggggtatgtaagggattgagcaaaattcagggtatagaagggattaggtgaactttcaagggtacacaggggattttctctttctgctgtgatgtcttattgacatggcataatagacactacttatagacattatgggttgggactgcacttatacgttagtacagagctttgattgatcgtcatccgatccatgtcttgtcactgtactactgtagctactagtatgtaggtttgctgccctaccgcttgcttgttttctcactttaactaattgcttctaaaacgcattgaaatcgaattgatcttcttggttactggatgaacgtattatataatatgtttgagttaaatgtctctactttcaaaattttgtaagaacaatctgattcttcgtactgtaaaactggaacacgtcaatgcatacagaattagtagtacaaacttgactgaagaaatagtgtagctgaaggttttgatggcaattatatatattctgaaatgtcagatatagatattaatttgtctttttcattcagtgcctgcatgcatgtgtctccggcatttcatttcgtccaggctagcaatctactccagctaataagctagcaagatggtcagataactgactgtctggctcccactaactaattatgcatccacagtccataactgtagcacaagtactcagcaaaacactcatgttgcgcgcggtcaatgctattgctacctagtacctacaggatacttgtaattggttgggctactgagaggagaggaggaagaagagctagcagggtgaagaagaaatactatactccattagttcatttttatagtgtttgtttattttaaaatctattttcaaaacaataccgcgcttatattcacgttcgtacactcacttctaaactcatacacatacactttatctctatgagtatgcacttttaaagactggatcaacgtatcttaaaattgaagaagtcaccgtagacatgaatgtgagcatttgtgctaagtctaggaattgaacttgagtgagcaggtcccatactcccatcccaagggatcttttgagctcagtttcattctttgagaataaattttaaccatccatttgaatttatcatgacatatgtttctaatggatataaaactaatgttggttggaaatactttgaactgtgagtctgatagtgtaagttctatatactaactatactaccttaattaattattgatcaaaatcttttgagtttaactttcggaaatcaaagtacgtcatgtaaaagtaaacgtaaacggaggaagtagaataatttgacaatcaaagaagagagcccaatacaaatacaaaccaaaccggcctcataacgtgaattcacatttgggcttacctgataagcccataagtttgagaggcccatgttggtctatccggtcgaagtcggacggaataagttcactttggatccctctatttgtcgtccagtctgattttcatcccttgatcgcaaaaccgggtacgataggtcccccaacttacgaaaccgtttaaataagatccctcggcagtatttgaccccggttttggccgaggtggcgcctacgtggctaatttgactcggtcttcatccgacgtggcattgacgtggcgcttacgtggcaattcaatccaaaaaataataaaacctatgggacccacatgtcagtttcacacacacaataaaaaaaaatggtggggcctacgtggaccccacctgtcatcctcactacagctctctctatcccccctctctctatcctctctccttcctctcctctctatcccgctctctctctcctgagaatggcgagcggcggcgggcggcgctgaggggtggcgacggagctgacaggcggcaggcggcttgtggagtagcggcgagcagcggcacacgcgcgcgtggcgtgggcgctggcacggtggaggccccgacacacccgctcccccacccccacacacctggcgctcgcggcggccactgacgcggcggccgcaagcaccgcaccgacgtttacagcttcggatggttctcctcgagcttgtgcgcggccgcaagaaccacagcgagcacgtgagcgatggcgccggcgccggcggtagcggcggcgccgccaccggcaaagctcatcgcgtggcacacagagcgactacttcccactcatggcgctggaggggctcgaggcagggtagtacgccgagctgggcgacctgcggctggaggggaaggtggtcgccggcgaggtggagagggtgataaaggtggggctctgctgcctccatgaggaccctcagctgcggccgagcatggcgatggtggtcggcatgcttgagggcaccatggaggtgtgggagccgtgggtgcagtcactcgggttcctccggctctatggccgtcgtacaagtcgtcgtcgcagctctctccggtccaagatagattatacggttgcattgatcattttggttgatttgtaaacagagggattaatttgtgcatcgtgaggtctatacaaattttgatctgttttcccatcggcacacgaaccttatattctcggcgctgttcgcggcgtcgctggcgtacctaatgtggtggtggtgggagaagatctggtcgtcgacgctgctccacgtggtggggctcgctgagatgctcgccatcttcggcctcgtcgtcgtctcttgccgagatgctcgccatcaccgagtagtcgctccgtgcgccgcgtgacgagctgcccattgtcctgttcgaggagttggagtcgtcgccggtggcggcgccgacgccgtcgctcacgtgctcgctgcggttcttgcggccatgcacaagctcgaggagaaccatcccgaagctgtaaacgtcggtgcggttcttgcggccgccgcgccggtggccgccgcgagcgcgaggtgtgtgggggtgggggagcgggtgcgtcggggcctccaccgcgccagcgccgatgccacgcgcgtgcgtgccgccgctccacaagctgcctgccgcctctcagctgcgtcgccgcccctctgcgccgcccgccgccgctcaccattctcaggggggagagagggggatagagagaagaggaaggaaagaggatagagagaggggacagagagagctgtagggaggatgacaggtggggtccatgtaggccccaccatttttttattattgtgtgtgtgaaactgacatgtgggtcccatagtttttattattttttgattgaattgccacgtaagcgccacgtcaataccacgtcggatgaagaccgagtcaaattagcaacgtaggtgccacctcagccaaaaccggggtcaaatactgccgagggaccttatttaaacggtttcgtaagttgggggacctgtcgtatccggttttgcgatcaagggacggaaatcagactgggcgacgaatagagggacccaaagtgaacttattccatgtcggaccatgaccgagagagagagtaaaaaaaaagtaacaaattgattatacttttcactcagtaaaaagaaaaaaacgacttttttttacattagtcacataagcctgcattgcaacaagatttaggaggtaagaaacgtagtttaatctgatattttcttctacaacgttttttataggtgagggtgggaggtgttttatatataagaggatatcttttaatacgtggaggttaggaccggataaaagaaaaaaaatgcttttaaagtgatacagataattctcataaaactattttaaagacttatatctacctccgtcccaaaataagtgcagccgtggatatccgtatccaacctgacttatttaaaaattttatgaaatttttttaaaaaatcagttatgtgaacttatattttatcatttaataaaaaatactaatcataaaaaagttctaataagatgaacagtaaaaaaaatttagatgtgaacaaagtaaaacatcatttattttgggacggaggtattacttagctttagatccatggagtagtttctctaaattttccacatgatcaatgtgaatacagacggagatcatacatacagtttttaaagttaagcattacccatctctaaaaacattgatagacgtgtgagaagtgacaaaagagggggcagtatttaaaatgaaatccggcaattagcagtgacagccggcgctaatcatgccgtcaagctgccctctatctgacgacccacacccaccgcctctctctcctcccccaccacgcggcggcggcagcagcagcagctagggtttagagagcagcccccaatcccatggccccgccctccgactccgacgactcggccccgatccccgccggcgccatctccaagctcctcatcgtcataggtactctcaatcctcatcccctcctgcgcttctgcttcttgttgctaatcccgttgctgttgtttggttggtttggcttcagcgatgcagacggaggcgctcccgctcgtcaacaagttccacctcgtcgaggcggaggaatccatgttagtagtgttctcccgtttctccccccttgttcctcttcaccaaccatttcctatccttccatgccatgctgcacttactgctgttgggtggttataagttaaatccctggaattaggattttttttaaaaaaaaagaaaagaaaaaagaacaagttatttttgtggatggtgatgttctgctttactaggcaagtttagtggcaaccttcgtttaatctgtctcatgaaaatgtcaatgtcagctgtcctcgaaacttttggaaataattatatccaacttacagggatagtctgatacgatccgttttcactattcctgttcctgtgtccttcatacataaattaagctttaaccttgtgtcatcaccctgttttgctcatataacctgtccgatactctcagctctgaagctaactcctacctttgtggcacacgcctaacagatttcctaaaggtgccccatggattagataccatggcaactacaaaggccttcacgttgaccttgtatggcctggaaaagatcctgttctcggtaagttgtcatctataatatgctgctcaccagcttgttgtcaagaatcaagcaataatttgataggtttcttcatcatgtaattcttacaatttatccacaaactaaccttatttctttcaggagttgactgtgttggcacggtatcagcagcacttgtgacttatgcttctattcagtcattgaagccagatctgatcatcaatgctggcactgctggtgggtttaaggtaatgtttcaagatatcacatgtttgatgccatgctgtcgttttattgtacctgggttctgatgttgtttcccttctggtctttcaggccaaaggagcagacattggagatgtctacttagcatccgatgttgcattccacgataggagaatacctatccctgtgagtgttctgttatgtcttgtagtatttttttttgtggacctagtcccatttttctgcagtgtgaccttattcagttcattgatgtgctacattattagaattcagaaagtcatacatgtcttgaacaaaacattgctagtttttatctgtttatttcataatccagtccgtttcatggttttctaattctaccttcctgcaccgtgacaactaattatttataaacttatagtctgctttactcacttgtgcttctggtgacatctgctcctttgccatttattctcaagatattatatttgcatcgccatattttctacaagttctttttagataatctatacacgtttaattgagatgttgacatggaccttcttggcttatccacaggtcttcgacatgtatggaattggaacacgaaaaacatttgctacccctaatatattgaaggaactcaatttgaaggtaagctacagagctatgctagttgatgccaaactgctggaatgaatactgtgtgagtcgtgcttacatgcatatatcttactgtctcctttagcatggtgttgtttctgaaacgaatttgtggattttattggtaaactgtagcactgtatagactcaacaagatgagtcgatcacatgctagtgttcaacattccggaagtcattgtgccttatttgcttcaggttgggaagctctcaactggcgattctctagatatgtctccccatgacgagtcagcaatattgaacaatgatgctacagtcaaggatatggaggtatctatttacttctgctcaagcattcagcttaagaacataggcacacaacagggaaatggaggtcttcaaccataggttcctcttggaagttggaatgagttcatcctttatgaactttaggacaacttttacacatcttgcattttgtgggtcgttatggcattgaagtaggcaaatgtctataggaatatatttttatccaactaattatttgctgatctcttcagtttttttgttaatgcctgagttcaagttaaatcgactagcatgaataagatactttgtgtgcactggtattcatacgaagttatctgctgctctgctttgttttcagttgtaatttgtaggctcaaactggcttcgttattcttgtttttccagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtatacaatttttaggttcccctgaggccctgatcccccgtatgtacaaaattcttggcaattacttggatcaatagcgtggaattttgtagaatattctgcaaaatgtgcagtgtaatgaaactaaataaggtgatattctgtcaaactaagataagtggtgggcggtggagttattttcttaatagagcattgagaccatcttcattgtttgctctacgattggtaaactgtgaaaaaaaaaacccgaagaagcaataaacatagtttacgtgtagaccttttatgtttgtattcttagtgattaaaaaactcatgctagagaataaatacgatgctataaaattcaaacagtggtgaagaaaaaaaagaaaagaaaaacaataaaacaagaggcaatctgcttctctcactgtctctatgcactagaggtagaggagcaattaagcctcgtgttgtgattggttggctggttggttagttggcgcttttatcgtggtgcctgttggcatgcctgaacctgaagagtataaattgactcctggtagttttgccattggtagatacagcccttgactctgctgcctcttcagttcaggtactgccctctcctcttcctttactctgctctctttttctttatttttttaggacccttctgcagtagtactacatgtttgtccagctgctgctgctgctgctatcagtttcttgtccttgtgatacataattctggtgtgaatcttgctctctacaaattattgtgcacatgaatcttgctcttcagttcctatgttgcaaattctagcacattgcaaaaggttttcgtcatggcatgaacagaaatagttttgcagtacataattttgtcaagtttgctgaagaagctctgaaaattccttgcacattttactaggacaatcgatttccctattttgtttacaatgaatggcagattgatcttgtcagatggagctggacactgatcctaccaagctgaaggccaagcccatcatcaaaccaaaagtagaaccctgcgacgacgatgacgagttgccgccgccgccgccgccggcttcaggatccggcgaggattgggaggccaccacccctctcgccgccggcaaccccttcttcaccgccctcatcgccaagtctcatctccaccccaagttccagatggtaagcatcacggatttatcgctggtatcttctttttcgaaaagtttggacacccagaaatgatttagcaccaatgaagttaaaaaagaagcaataagatattttatcctagcacatcaaacatggtgaaattttgattaagagactcgaacctaggctgatagtgcttgccatcctagccactgcacaatgagctcatctcgacatttttttcttttcgagtgtacttcctctgtctaaaaaaaagacaacatttatgatgatttgacaacatgtccagatttattatccagatttattattttagatagtatcaaatccccacataggttatcttttatttgggatggagggagtacgtgtattaaaaagggaacacacttatggtgtgtgcatgcgtggtggtgatgaacatgcatgtgcattcttcatttaataaaaatgttacttatatcttcgactatcaatttttaaaaattattgtagtttaacatataccttattgtatcattaagattcactactagaaatactttcataatatataattcacatattgttaaactagataaatttgtaaaagtgatgtgctaagatagagcttaggacaaatgtaataattggaaatggagggagtaattaaacggttttcttttaagttaaagagtactctctccatccctaaataagtgaggttttagctatttaaagacatattaagaaatatgttaaaagactactactatgtccttaattgatatggtgagaaaacgaggatagaatactattggttcagttacttaaaaatgagaagaaaaccactctaaaaatacattcatgtaaagataaatttttagcctaaagttgcacttgtttaatttactcctaataatcatcattatgtggataagtatatcatcatgcataattaaatatatatatatatgtctgtgcggaattgatttgattatttaatttgtccgcgcgcgcgcactaatattatttatatgcagtggattccacctcggttccagcatcggctggcggagccggaggcgcgcacggcggcggtgctccactccggcggcaagtcgtgggcgacgagctactgcggccacctcaagatgaagaagctggacgcgggatggtcggagttcgcggtggacaaccggctcctggtcggggacgcctgcgtcttcgagctcgtcgccatgggcgccgccggaggtctggagttccaggtgcagatactccgcggcggcctgccggcggaggtcgtcacctccaagggcctcacctccgaccaacccatcctcatcgtcgactagcttagctatcgatctagccacagtactaaatcatcaaactccactattaattccactgtcactagctcgatcggtaattaaaggcaaggagctttaatttggtgtcaagcaaaaatttatccaaccaacttatgtatgatgtactgcagcagctgcaatggctactgtagggattgtagtttgctactatatctgtttgcaggacggatccaggaacaaaaaaataattagggggactcaattacgcaatttcttcaacctccagccatttaggaacttttagtttatcatttatggtgaaaaaattgaagggggtgctctagtagtattttgggtgaaggggggacttgagtcccatgcacccacgttggatccgttcctggctgtttgttgccatatactccctccgtcctataatatagcaacataataccggataagatatttcgtagtacaatgaatctgaacattttatagttatacccaacaaaccccgatagaaacatacatccttatatggtttattaggcatctccatgcaagtgaatatattatttagttgcaacagaaccgaacaatagagtagtttgctaaaaatgtactagtgatcatcatacccagctcaacggaagttatcttaatccttgtttgcttaacaacacatcttagttaagtttgagatgtaaagcttaagaaaatgaacgaggcaaaccgaaaacaaataatctgaagatgcccctagctttgttctcaaacaaaagttgggattaagctagagaacaatgtaaaaatatctgaatgtaattatttgggtcgatggtactgtcaagtgtcaactgtcaagtactccagtataccaacttgtgagttggttaccatctggtgtactactagtaaaaccggaagatgcttttgcagaattcaaattcaaattctccgtatttttgacttgaaacttgcagcgttgacttaccgatctactaaataaataaatggatcagatcgagaaaacagagagaattaggcccagcagaaagcccaagaagcccaagagcgaaatcagcagcgcaatacgcgtagtctagtctcctctctttctttcttcttctcctccgccgacgccgtcgttttctccgcagttcgccgctgcttccactccgcctccacctccgccgccgccgctgctcctcctcctcgcgcttacagtttcctctacttccccctccttggtcttggtctgcctcctcctcgccatggacgtcaagccggtaagcgtccgtcgatccccctcccgcacttaccctttccttaaggcttaaggtttagcttctgcggtctgcggagaaggcgacgtgttgcggcgaatccggtgctgcggcgattcagatcggaatcgcggtttttttgtttttctttttgccggcgaatccggtgcccaatcggtcaaccgtctagtcatacatagcttaatcggtggtgggcaaatgattttagatttaacaagaagaggggagtgtttacgcagatctagtcatggaagatcgtctggagttaggggagagattatgggtgtagcgtagagatcatcaacacttcctactcctccctcctttcctttccttttaataagcgacctaattgatcccgtctgcatagtgactctgaattagggcaaaattaggcaggcggtttgtttgtggctctgtgcttgggattattagtctataaataagctttattacttccataaacaggctctagccgttctgcgcaagtttttcagtgctgtaagccccattttgtcattttggtcgatggtgctagtttgtaactgcacataatattatattgaccttttctggtacgctcagaaaatacatctttacatagtttaggcttcttcatgcgagtgaagtattattatttacttcattcatcattttaggctgtgaattatttatacagatgaaaatctcaagcttagacttggttagaagttggtcaagggtagccccacttgcatgctctctctataaactttcaaaagaaaaaaaacctttcttatatgtgtacagatgctgatctcagtaattgtgtgctgttgcctttgattttttttttcatataccctgttttctatatccctacatacttgattcgaaaattatagtgataatgttttattcgttacaggtgaggactgtgaaggtcaccaatgtctccctgagtgcaactgtgcaagacattaaggagttcttttcattttcaggagacattgaacatgtggagatgcaaaggttcattttttttaaaaaaaattgcaacatgtacccaaccaaggagatttgatttgccctttactagcattctcatcattttgtttgccttccattggcagtggcgatgagtggtctcaagttgcatatgtgactttcaaagatccccaaggagcagaaactgcacttcttctttcagtaagtaattgaaggacttcgtagcattgagtacacttgttgcatattctgtactccattttcgctgttccttattccttaaccttcattgaactcttgtttccttcatcgctacatgtgtatgtgtgtgaagctttgatgtctgatgtttctgattgccttgtcttgtcttaccttatcatgcttttttttaaataaaaaaaatagacttattatctcaatgaaagcaccttgttacctacaagtttggcatgcttgatgtttcctcaatacctgaagtttagcttttgttgctacttatcagttgtgaattaatacccgttttacccatttttttttgctgatgataggctcgtggtcaatcactatggaacttctagtgcatgcattgccaaaaaaaaggaagcagaagcaaaaacaatatctttagttgcatttccatttcctatagtaggatttgatgtccctgtaacaattgtttgttctgctagagcaaaagctgagatgtcgttctatttcattgaaacagggcgcaacgatagttgatctttctgtcatcatcgcacctgctccagaatatcaaccaccccctacttcatctgctcctccaatggtacacaattcctcagttttgatttaatatgctcatattttgatttttcaatatgtgacccaagtgagatgttatcatcaactgaatatggcagttttgtctgcacaataattctcacccatgttcttgattgcactggattttctgctttcttagcttaaatgaaaccttgtctcatgtgcttttacatattccattttcataaccataagtgcaatctataatttcaaattataggtgcaaatataatttagagtagctcccggtgctaacatgggcatatttgcaacattctgttgatcttatggaatatgaatagcttgaattgaatattgtgttctgttctcagtatagtgcaaccagtgtccctgtcagtgaagacaacaatgttgtccataaggctgaggatgttgtcagcaccatgcttgctaaggggttcaccctggggaaagatgccgttggcaaggcaaaagcttttgatgagaagcatgggttcacatccactgctggcgccaaggtggcctccattgacaggaagattggtcttagcgagaagttcactattggtacttccatagtgaacgagaaggtcaaggagatggatcagaagttccaggtgtcggacaagaccaagtctgcattcgctgctgctgaacagaaggtgagcactgctggatctgctatcatgaagaataggtatgtcttcaccggggcttcgtgggtcaccaacgcattcaacaaagttgccaaggctgccactgatgttggtacaatgacaaaggagaagatggcagctgaagaccagcataagggctcgggtccttctggagggcactcgtacacacccatccagtgatgactccacgctctctcatgtgccgcattgtgttgtattgatggatgtaaaacatagatatagaacagaaaaagtcccctcctggcataccacatacttctatcagtgaacttttcgcattgcaggaattttgtttccagtagaataggaaatatgatggtgatcacaatgtattccgctggtttataaggcgtatgttcaaactgtttctggttgtagtaacttgcatgaaccttggcaaaagttgtggaaagctcctttaataatgtcatgttgatgttggttcatggttttgtatgtgattaccgtgtccattgaaaacatattatggcttgctcagtcataatctgcagttgtttgaccgtacaagaaatgtcccaattttatggggtgcaatcgattgtcagcaacaaagtcgttgtagtatagtggtgagtattcccgcctgtcacgcgggtgacccgggttcgatccccggcaacggcgatttcactatttttttgccagtttcactttttttttgtattcttgttgatattctaaagcttttgtttgtattgttttgttacttcttccgtttgttacttcttcctttcattctactcttgtcggtgctttttcagatactacttttttaatcttttggtattcttgttcatactcttcactctaaagcttttgtttatgttttctaatacttcttcctttcattctgctcctaatgaattagctctatgtttttttatacttcttcctttcattccattcctgttcattctaaatcctttatgtattctgattctacttcctttcattctacccttaaaaaaacgctccatgtttcttgatacttcttccttcacattgcttctttcttattatgggtcatcttagcagattcatgagatcttaaatatccatagagcatccaaaaaggtgggcattcacttgttataaaataatatcaagctacaagtgacatgtacagtatgttatatattgatgtatatattgctatattattggtgtggtgacaggaagagtaacttgccactccatctggtccaccactctaatgcatgtgtcaagtgtcaacttaatctcaagctcaagctgaataaactgagaggctgaagctgaagcctcccttgccaagctacacaaaatgccatcatgtctcaagctacaattagcctggcttgtcccttccaaattagcatcatgcatgtccttgatgcggacaagcctcttgtttcttgcgctggcttcttcctcaatcaactacctttatctactactagctccatgtatgtactatagtccactgtactcttctgcttctactaactgcacacacaagattaaattaatccaacaatcaagtgcagaactgaccctaattaatccttctgtgcttgcttaagctcagcactggctggagtactttttatttttgtgccccaataggagtcaagcactgttgctagtcatccatgatgtgtgtatgctgccccttttttctttggctttctgatgcttctcaactatgcctttgaccaaggaaggattcatctacctaaaaaaaaatgaagctgccgcttgctaaattggttacatctccatgaatgtagccatctgggacagtgtaatgatatcaagggatcaagaatctcaagccacatttttcattggctgcatttcagttgataattttaacttcttgttaaactcctattaatccctcttgtgacttgtggataacggttttctttttctcctcctctgtgtcgtgtacaggtgcttgtgctgaggcacttgcgtaaatataattaattaaaatgacaaaatgcttgctatagtattattctctaggtatatatattccagaaactcccatttgtgtggatgtcaagataaaagaacaggtgaagtgagatcctcctttttaattttaagtgaaaaacaagaacactatttcctttggtgagattcaggcagcactgcatttatatggtactatttagagaattaaaatggatatgcaatctcatggtgtacatgttcttgttgcaattgatacttttggcatgttgattttgtacggattaaacaggtgcctcactaaagcacttcatccagtaccatttctttatgtccagaaagcaactataaactactggattccatccctaagcatcaatcctgtggtcacaagtacatgaactaggatctgacaaggacaatcacaggacaaaagaaatagtactaactacaaatgattcagttcatcagttggttataatccaaattatagatgcaacttgcatactagtaccgtattattttagcatctcggaatctgtgccgagagcatttcagtttcacattgctattggctggttttggatatatggtacagtagcttgtgcttgttttgaggttcagacactgacacacagattcagggttgaagcattctctgaaacaattaagaattgaagatttggagtccttccagttttatctgtaaccaactcttgatacctatagtacaggcatgctctgaaacgaaatggttcatcaattgtgcctaaaaaaagaagaaagaaacatcggttcatcaagaatggtctgtcaatctcagcagcactgttttgtttgatctacacgcacaagcatcaagttgacttttggcaggcattggaagtgagttgtacactgaaattgcgctagttaacccatccattcggagaaaatttcaggccggcttgatttgcctgaccacaaaggcaaatgttgtgtcagttgccacagacagatcacctgcttcttaattatttctagaaccgttgtgagatgatggcaaattagcaatgaacaatccaattccaaacctcgtatggaaaattaatattcttttgcaaattgatctgaatgaatatatagaccaggcccctggtttcagtaaggtaaagtcaactcgtgcatgcatgtatgcagcacggcccggctgccccggcatcccctaacaactcagtttaattagttttaagcacaaaattgtgaacaatagttaagttctttttgcacattttcaggtaaagcagttgtcggtttattacacaataccatgacaccatggagaccacacatgcactgcaagttgaaaaatctgaagatagaatgaacaaaatatgttcaaagccacaactgttcttgttttctatggcgagaaaactaaaaactgttcgatcttataatttataagtacaacatgccatgatcttttttatttatgtcgatgcatcaaagatttaccatatccaattatatatactgagatattaattattaccggcaacctgagacaattgcatgaatatttttactggcatatgacatctgatcgatcagcaagttttttttttcctttttcacgatatgtaactgatgatgtcacaggaagaagagatcaaggaccggagcagcgaactcagtctcgaaacggtcttagttgactcatacaaatttatcaaatatcatattcatttctagtttaatttctacacgtctgcattgcaacagtgtaccgttgaatcaacgctaacacccagcattttttaattaattaatgctagctacgtaccaagatcgatcgatcaatgcattaaggcatcaagtagaataagaagtgcgtactatttgggattaattaacatgtaatatgcgtggagatacacgtgaaggggtagataactaaaatcaacttagaagcttaaacacacaaaggctcaccaaattataacaactaacagtgaccttcggagtggaattagatcacgtaaagatctggtcctatttctttatcagattctgtttactaactactcgtatatttatatagtgggatgcagtctctattgcttattgcatgtaaattaatcatggccctgttgagccagatcagccgtaattcaagtcatcataccaaggaaggacgtacatgcatgaccatcatcatattcattcattcatatatattctatgttaagggtgcacatatactaattaggttaagaccctgcatcctaatcctggctaaaagatccccatggctgtgcagctgtttgaggaatcctcttgagtttctgttcatttgacttaaaccgtttggatccctgttttgttttcatatataagtaaccacatcttgcaccaactagctatttgattagtctctgcaagatgaaacattgaagctagccttaatattattgtggccaacgagaataatggtaaccgtagaagcatttggtttttatagattttttggataatggatggaatccggagtatatatatacatatgtaaaggtttcacgaatacttatattccaggtcttataactaataaacaacaaaaaaaattaaaaaagaaaacaaaaaatactagaatactcagttttggttttctgctgcctgatgagccttgttgtaccaaaaacgtatcgaataaatattgaaatgtagtcaaaactcctataccctcatcctctttcacccacctctctctggtttgttcgcaaacctacccctactattggacagatccatttgatctagatccgaaaactcccagcacttacttccttcgcttgctgacatcatcgagtggaggcaaagaagtgaagaactagtgcatttgctctcagatgccatccagcggaggtagagaagaagaaaactctttggtgcattgagttcgggcacaaacacggaaacaccttggatccatggcacttagaccctagatctagggttgtctgttgctgtcattgctaaccagcctactaccacgctgctgatattgctcctcactatagccgccctgcatactgatcaccactggcaccactaacaagcccgtcgtctttttgtttttctcactgcatccgccttttgtcagggcactggatctgaccattaggccgaagctatccaccctggatgtcgctgataccgcctacaataccatctttgttctaggttgtcgttgccaagagaacgttacatatgcacacccttttgtttagaagcattttatatctccaatcttcatgttattctctccccctaaagctcatatgcgcctttttttttttcttatttcctttttcttttgttaatcatcatcttggggcatttcagtttctgctttgttagttttgagaacatataccagaagtatgtagactggttgcacccactctggtctctaccttaatattccaaataaataacacatcttagtctttttccctatactagaaaagatgtccgtgcgttgcaacagttgaatgctatgttaatcttattattgttatacggtttggctagggtgaaattcactgtaggaatccgcttggattttttttctaaagaattatgagctgcaattaggagtccgacattcatctcaagttagcatgcaagtttttttaaagagatatattatacgactccttttgtatttctaaaagcaaatgaacttaaaattcgactcaaacatggatctatattttcaaaagcaaacgaatttaaaaatcgactcaaacacggatgacgtacgaaaataccggcaaaaaaaatatacagtttagttaagatgaaattcactgtgagaatttgcttagatatatatttttttctagaaaatcatgagttgcaattaggagtccgatcatctcaagttagcatgtaagttttttttgaaagagatttcttatacgactcctgtatttccaaaagcgaatgaacttaaaaaccgactcaaacacggatgacgtaccaaagtataccggcaaaaatatctttaatttttataatagtatagatatagatatgtacttttggttatgattttggggaaaaaaaatcaggaattgaattcccaacgatatatagcttaggccataatatatatagtaagacacctcaacataggaattattaggacacctagaatatgatatacaaaattagcaagtagttctatcgcatttctgacattgttgcttccattggtacgcattaatgatgaactgaaaatgagtgtttcattaataaacatatggcagtacatgatgtccttattggatttcttaccagaatggattactcttcagttgagcgcgagactatcaaagatctctttcatttcaaaaggactatcaaatctctcgtacaaataatagagaaggattataaataaacaaataacaagagaaatctgacggaatgttttgcctgcagtagtattcatgtattgcctgcagtagagacaaccactggtactgtatcttgtacgtcctctgaccatactccaatttaatttgtatgtactgatcactgctactatctttgtatcataatataagggattttgctcatgttgcatttagttatatgcctataatctcttatattataggacattggtagtattaattaatttgtaagacatgttaaaaccgatcagaaaactaaagcaatcttttggttcaaattttttttcttccagtagtgctaatgtaactgtgaataatgctttgaatttggcagttaaaaatagaaatttgcgtccatgccggattggtgtagtactgtgcttcaaatataaaatcacactaaaataatacattctcgtctcaattatacgagcaatagcaagacaaccatttcttgtcttttttccctagtagctagatgtctatctagatttttgtttttagatgatgagatgtcaagctagatactactcatatatctgaattctactgtgacatgcttgccaattcatccatgcattagctagattacttgcacactctaccaaaattaaaacacaatttcttcctgccatgtctactcacattatttaaaaggaaatatgctctcaattatttgcgtgaaaagataataaaagtactacaaaatacaaatactaaaggtgctctgtacgtacaaaagcaaactgatgtactgcttacttctgaacattactctgtgagtgtgtgtctagccgcaagtttttagtgaagattgtattaattgtagcaagttaaaatcagaatttcattgttaattagctggtatttgcaccaaataataatatagtctggttaaaccagagatgcaattttaaaaagaaggtagttgaaggggaagactaaccaaataggctgcttaatgctgcaacactaagggagattagtacagatgaacatagtttaatttcacactctggacagtgatagtgattgtcctgacgacgatgctgatacgaaagatctattgacatatgtacatatactattcaagaataattcgcattatatatatggtagctagtctgcatgattagttattgatacagattgaaacctgcagactacggtacaacagggcctgaaacttgtactgcaataactagatttgtaaccagcagctgcagaaagggttgtctgattaatcacttcactaaactttatgggaaggataaattggcagatgggaatatatggctatggccgtgtctagttccacagtcaaatttttttaaaagtatacggacacacatttgaagtattaaacctaaactaataacaaaataaattacagattccgcctgtaaactgcgagacgaatttattaagtctaattaattcattattaacaaatatttactgtagcactacattgtcaaatcattggcgtaattaggctcaaaagattcgtctcgcaatttacatgcaaattgtgcaattggtttttttgtccacattttaatgctccatatatgtgtccaaacatttgacgtgatagaattttcggaagtttgggaactaaacacagcctatatatgtgcagtagaccaagtgaaaaatgcattctgttcagatgttctcttcctttgtagtttcaaactttcaaaaatgcattgactaccacttctgaaactattcatcctttaatttagggacctcaaagagaaagagagagtaataattacactcgtatagtgcataaacttacatggggtgagtgaaacaatttgcaaaatgtgtttccccccttttctattttggcagagtgcatgttttagtagaacaacttaattatttagtctgtgtaaattagggctaaaattggccacacaaattaatgaactgagactattttgattggaacactcatcattccaatttataattaagttgtctaatctgggcaatttacaatccattgtgtcttggccttatatatatatttccttcatgtgggtagaaggagtactggggacagcagaggcaagctcagtgtaaggtggtcttgcaagccaacctggcatcctagctagtcagtatagaaaatcaataatttgcctcggagacatattttggccttgtttttcactgactaattacaccggaataagaattttgcatgtttttaaacgtattttcacccactgtgcaagttcaattcatacaacgtatttgtcagtatttgtcaagaatgacattagcagttatggcagaatctctcagcttggaattgaagcttccgatgaggtgtttgtacgcacggctcaaacttcagtttgcaaatttaccacagcaactcgatctcttcatgtcaaagaaggtagttgtgcgtttggtaaatgattaactgatgaccgtgtgcattgcatctcaaattaaagtcgctttggtttcttcgatcagtaccaaataagaaataaaaaactgggggaataaagaaaacaagctagtatttgatatagacagaagaagactcagacagatcgagtattattgttcatgtgcagaaattaaaaccatcagaagagtacgtgtagccatgcatacacctacctgcaaacatgcatctaactgctggactccgtgcagagaacacgaatcaaatcactttcctgcaacctatgtgtcctgcaatctctaaaccaatacatgcttgcaatttacatagtaatcaatctgtactgttatcatgtgtccatgtcaaagggtctaacattaattccaattgcacaactaattttctggtatacagttaaacaaatagtgtgcaggtacactttggtcccccttaatactatacaaaaatgcccagctagctagctgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacaggattccagtgtaaattatctgataggtgaatatcagatagctaagcatatatatgcatgttccacaaagttcagagagtttgcacgcgtcatgggtgcaaatattgcctattggccataaaggatgcatggaatcaagggatatcccaacatatagtgcatatataattaagttttaagatcgacattctcatcccaggcaacttcaattcgtctttaatcttgcaaactaattaacacacaatatacaaatttgtgttctcgaaggtacttcccataaagatcaattatacatggaaacgacacatatgactcctcacaaaatggatcaacatctgagcaatatagtgtaagtttcaaaagtcaatttgccttgtgttgtggatatgccattgtattgctaactgtaatgctcatgatctcccacaacagagcgcaaatggtgctaagtcaaccattcatgtgtatgtactatatatgtatatatagttactagctagtatacatatattcttttttgggaaaattggaactatgccattataattttgcaaaattttagatatgccatcctgacccacatgtcattgactcatgtgggtcctacatgtcattgagataccgatggtatatctcaaactttgcaaaattataatggcatatttctaaattcttttttagataatggatgaaactaatacactcatatactattaagttcgtttattagcatatgcgattataagttttaaggtcgatcaattatttttttcattaagtataaattgatgaattaattagttttctttagttcatctacttgcattctaaagcatcatctttgtgagagcaaattaactgaggttgcactatatttaattatttcccatgcatattcaaattaaattatatattcgcgaaaacaaatatcacaataaaatcaatattccatacaaaatggatcaacatataattagcttgagctaaaaaaatcagaattcattttactatatgtttgtggtgaatgctcctatatataatatataatgccaataattaatattgggtagaatttgtcactcccatcccatgcatacgcatatatatagctacgcatgcgtgcatgcagttttcacattttggtccttttaaaaaacttatttcgcaaatagacccctaaaaaaactaatcccagaaatggtcctttttagggcgccagagtggctggcgctgtcatccaatgggacggcgccagcctctctggcgccgtcctcctgccaccgtggcgcacgcgaaccgacgtggcaggaggagggcgacagcatggctggccccgccgcctccattcctgtccattcctgtttctctgtatggagttgcaacggtgtcatttttttttattttttcggatgttttttcacactcaggatcacgatacaaccaaccacaaaaaaaatttaaactcgaactaccacttagctaagtctgaaaatatctagcataccacttagtctactttgcaccttcactaaaattagactataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcataactttctcatacggactcggaatcaggcaaataatatatgcacggacatctacagaaaaagttacatccgtttctccccgctctgccgggttcagcgatattaaaacctccaaattccgcttgcaagattgtgttttcaaggagagaagtttttcggtggagctttggaaaattccacatgccacatatttcgtccgtttgagtttattttttacgtggttggttcctgtgagttcctaagtgtgaaaaaaatatcaaaaaaataaaataaaaataaaaaagttgcacatctctctcctctgcactagttcggagagaggagaggagaggaaaaattctatatgtcacatattacgttcatttgagttcaatttttctatggttggttcttgtgtgtccctaagcgtgaaaaaaatatcaaacaaataaaacaaaaataaaaaatttcgggggggggggggggggg

SEQ ID NO: 58513 - DNA, 39766 bp, Oryza sativa
atcatatcgttccaattttaaccaaatttttaattttggtgtgaactaaacacacccatagtatatcagtatggctaacaagttttggcatacgaaactttttacacggttggctcaatcgtggcgaagaacttgccacatgaccagctagcagcaactggtaggccattactgaacctgcacttcgtggaattgtgcagatagccgaaaaaaattctctgccggcatgtgctgaattgtgtgttcagattaatgaatccagttaggcttaactactactgatcaggataaaggtgtcaggggtctcactgatttcatgccagtaataaggctgtctagtttgactattgctgccaatgttgctttgtggaatggcatgtgcactcatggttggtgctggaaatgcaaactgtttgctgtttggtcttgttaatcagcccagcatgtggaagaacatgaccaccatgtactgtcttgatgttttcctcttggatctactcgtggcaatgattactgagcaaaggtgggaaccaacatgtgccttgatctttgcttctgcttgcttgtggcctttagatttgctgatccttgaaagatttcttgtgacgatagattctcgagaaagtgctccttgctaaaggtctcctttagaatgtactccctctgtttcatctatcccatttattctaatatttattttaaagtaagtttatttttatcatttatctaccatcgttcgcaaattgaggaatttgattccttcaatacctttatccatctaccaatactaattttctattaatgagaaatattttggtattttttccagaaaaaaaattaaatctcaattataagaaatgaactttatgtttggatagatgaagtagtaattttacatggttttcattatttcataggaattaaacttattcatgtgaaagtcctcttaaattcctcttgttccaactaagagatctaaacaggaccagaaactgctatcataatccattgaccgaccattttttttttgaagttcatcactggtccctaaatttgtaccgctgtgtcattccggtccctaaattcgcaaatcgaccgctcaggtcctcaaactcgttcaattgtgtcatcccggttcctaaacttgcagatcactcgtttaggtcctccaacttattcagttgtgtcaccccggtctctaaacttggatttaaatatcatctgggtcaaatagaatggtctaaagactttatatttaaaaataattcataactttttcatgttaactctaatgaagacaaactttatatcaaacttgtagccatcgacgcgatctacaactttatagttgatttttttatttcaagtcatttttgtcccaatatgtaattttaaaattaaaatttcaaaatctataaacatgcaacaatattttgggaccctaaacaattttaattcaaaaacttttcaattacaaagttgtaggtcgcgtcgagggctacaattttgatataaagtttgtcttcattagagttcacatgaaaaggttatgaattattttttatataaagtttttagaccgtcctgtttagagaccggtgtgacacaactgaataagttagaagacttaaacgagtgatctgcaagtttagggaccgggatgacacggttgaacaagtttgaggactaaacggtcgatttgcgagtttatggaccgggatgacacagtggtacaagtttagggaccagtgatagactttattcttttattttttttttgataaactggcagacgcatcatattttgcttggacttccgacttcttacatggacggatgcatatgcagagtacttctccggcaggctaaaaattgtcgctcgatctatgtacgcaaagcacgacgatgaagtagtcgctactggcatcgctgtctcgtggaaaatgtcagttgttttgtctacagatcgttacgcattaactcatggccactagcagtcaaacgaccctctcaaaaatgggctgacagaggcaaggggaccccctgggttaactttgtcacgttgcttctgcaacagtagtccacggtaccaccaccaccaccacgccaaaatttcttcgcattggaagcagaaatatcttcgctttccaggcttagctacgttttttcgtcgatcccctttgaaaaaccgatccgaacgtgtctgtctagtgtataccctcgagaccttgagtttcccgtttttacggagcacggtacagtggcgaggactacgaccgtgcaccagaaggaaaaagaaaaaggaaaaaaaaaactccgtccgtatcgtgtcatcagatgtgctgtcagcttcgtgcgcccttgacccatctgtagttaagcgtgtgccgcagctttcatgctttcattcaagcagcatgaatgaatgcactgcatgcagcaggcagcaacaacatcaaagaaaaagaccgcgcgcgatgacgtcgaaacgcacaggagatgcatgtgttgatgattggtactggagacggctgaactcttctcgtctggccaccggccgcggcccggcccgcgacacatgcatgcagtcagccacggtcacacacacacctgatcgacctgccgcctgccgtctgcccgtctgccgcgcgctgcttctctctccgtccgatggcgcgtgcagtgcgtcccattgccccctcgttaattttttttttcccgctcgtctcgcgcgcgctacaaacgcgaacggtcccacggcggcgcgcgtacaggcgtggttaattcgcgcatgcatgatttgtaccacagtttgacggttagcctttgcccatactcgctctatcccaaaacggcacaacctaatttaatcttaagacaattattttattcggattaggtgtactagaatagatcacatcttattttagattaggtaattttttttaagacgaagcgagtataattttctctcagatcgaggatcgagctgctccttttgctgctatgttagtactttgggttagagactactccctccgtcccagaaaataaacatttttagagttggacacaattattaagaaagtatgtagaagtgaatggtggagggttgtgattggttaaatagtggtggtaggtgggaaaagtgaatggtgaagatttgtgattggttgggaagagaatgttggtggagaagttgttatattttgggataaatcttgagggctaaaagttattatattttgggacagatagagtagctagagggttcacggtcgatctgattgtactccctccgtcccataaaaaaccaatctagtactggatgtgacatatcctaatactataaatctggacatacctctgtctagatttgttgtactataatgtgtcacatctagtcctagattcgttttttcggaacggagagagtacgtagttaaagggggaagaaaggcgttaggctgatatgtatatatgtatatgtatgccatgctctaagaagacgcatgggtaggtgtgcttttgtttcagaagtactccctccgtctaaagaaaccaacctcgtactacgacgtgattaggatgcgtcacattctaatactaaggttgtatttttttttttgcggaggaagtatatggttcgactaatttctgtgataaggtagatttatgagtgcgatctgatcaggcgcaatggtgcacacacagttgttgcatacacatatatgtgtacgatggatatgccatgtggtgctgatggcgattcgtgtctcgatcgatctgtgccagggcctgcattgtgccggccggccggctgcagcgacgaccatgcgatgcagggcagaataagcgcctttggagcatgcaacctaactccagcttgcaaaaagggcgtggcgacaaaccgctagcggagatcgaacatgcaacatgaatgatcatgcgcgggggccatttcattgtttgatcgtgcgtgcatgcgcgcggttgcgcttggaccggccggccgagcgcctcctccacccatcgatcgctttctctgcagattggaagcagactttatattaatttgtccctccagggacatcacatcgttttatatatggcgttcaaaaataataataaaaataaaatatttatcaagatatatcaatatatgatatatcttttcgcaaacatacgagttaaattttgacttatacaattcaaaacaaaaataatatgaccgtgaattacacgttctattcgtagtcaaatttattatttttatttctacttatataagttgaatttgaattttttatatttatgaagtgacatataacatattaatttatcctactatatttttttcaattttttttataacctaaaaatggcccaaccatcatcacgctcatcagctcatgcattgtcgctcgataggtgcagttgggagacagtagtagagattcaggggaattgaaacaacatttacaaacaaattaagtgcaaactctaaataatgagatctgctttaattaacgaactactccagtatttaaccgtatgacgtcatacagtcgactgtgctagcgatattttgctagcggtgcttccatatttagccatatgactttgtgcatagttagggcaacgctctaaacagttaatggaggtatgtattattcatgccacgttttcaaaattgcgctttttgggtcaaacaaaattcctacatccacatttgttatatttataatatttaggacctgttttagatccctggcaagttttatcaccatgtcacatcgaatatttaaacacatgcttgaagtattaaatatagacaaaaaaaactagttacacagattgcgtgtaaattacgagacgaatcttttaagcataattgcttcataatttgacaatatggtgctacagtaaatatttgctaatgagggattaattaggcttaataaattcgtctcgcagtttacatgcggattctgtaatttgttttgttattaggctacgtttaatactacaaatgtatgtccgtatatccgatatgacacggcaaaaattttcacccctggatccaaacacagccttaatctaatttacccgtatatgagtaactttcatccagtcataattaataaatcaattcccagttagaagaagttggtagaatagtcgatcttagggtaaatttaagataagctgaatctatcgtcatttctttactcatttggcattctaagattataacttaacaaacaactgtttgagataacctagctaattacttcctccgttttataatgtaagtctttctaacattgtttacattcaatatatatgtgtgtctaaattcattaacatccatatgaatgtggacaatgttagaaagtcttacattatgaaacagagggagtatatgatttcaaacggtaatgctacataacgttatctcattccaaggcatggaatgagatgctcttatgctctttcctccgcaaatgcgagggaggggcacgccttgccgctgcatggttcaaccagcgaaaccgcctaccgccaacactattgcctcttgctcctcttcctcctccgcagatcctcgccaccgtccccatctccgcatgcgcagtcgcctccctatgtccgcctagcaccgccaaacaacgagtaatacacaatgtgacgatgagcctgagcggcatcctctagagtctagacattacggagcaggacaccaaaatgccttgctacagttagagagcttaatttgccaatgacttgatgtcctcctcctcttccacttgaaagaagtttgcgatggacatggtagccatgagcctcctggattgattttgatttgagtcgatgtatttgctacatcctcttgcttctagaatcaatatacttttcctagattccgagacaactgtatgggtacgtacttgtcattgttgcaaaactgggctaagtatgcaaggtggctatatcttgattcatcatggggtagtgctctcttgagaatttacacctgattccgagtttccgacatgtattaggcttgatacacctaggtatcgatcggcctgttaccggatgatatcatttttgtactgatgggtatcacttggtacaaagagggggtatcagatcgatctggtaccggattggcgagtagtactattcaagatgctctagcagtcccctgattcaattatgcagttagcttgtggaaacactaccaaactctcctcttttaaacatgatcgatgaagattcacacgcattattatttttgaacagtattagagcatctgaagctctgaacatgtatggttcatcttcatccgtagcaaatgcatgcacaggagttcagctacttccttatttacaccgttcctagctgtttgaagctgcaaatccggggctggcctgtatagtactacacatatacaccacttggtgtccattaatgtcgaagcatgcgtggcccatttgtctccgaccatgcatgcatgggtactaaccgtgctagcagaggtagattaatggaaaggccagtatatatagcagagtgtgcgtacacatgatcagacagaatgaatgcgtggtcggtctcgacgctgcgtgtagttcctttcaaagttaaaaatttaggttgaaattggtatgatgtactgagactgaaaagttgtgtataacatgttgatgtgatggaaaaagttgaagttttgatctaaagacagccggagcttaatttgcatgctcttcgctgtcacactactacacgtacgacctcgctgaacaaccttagaactgcatgtgatgaatatctagcgagccatcatgccagtactgtgtaccgtagcctgaatatatgcatgcatgcatgcctgacgagctgagtgatcgatcgatggcagcacgttgctgacagcaagcatgcatagacgagatgcatgcatgtgtgatcgatcgaggcgctagctgccgcggtgatagcgtgcatacatgcatgcagtagtgcagagtgcatgatcgaggtactcactccgtttcaaaggccaatatgaacattttcaggatttaaactttattaccacataatagcattttctaacacctaagacattaattccaatatacaaggtgatataatcgagggaaaccaagcaaatcaaaatttaaaatttaaccattaagatgactaatatagtacattttaagctttacctacgctaaacaatatagaggtgtttatatttagaaacggagggagtataagcatttataggatatatataaattttgtaaatactattaagtatttttgaaacattaatttcaatgcacgggattctaagcattttttaactaacaaaatacaagtgttcttaggggtgtttatgagggaacttaggcaattcaattttctttaacgaatcagcacagaccgtgccaatttcattaaatatagagggagtaaaaatttatgtacacgaagtgaaaaaaatatgagttgtacaaagatatgctagggcatcatcaatgattaaggtcgctaaaggaataaggtgggaaccaatagtcttttcttgatcttgagctaggacccactgataaaaaaaactctattcagtagaaataaaagagcatcatacatgttgcaaaggcgtgaactatttttttttattttttatgatctaaccttaagcttaagattgcccatagcaatattccttgctttgctactctcctaataatgcataaaggtagaacaaaaatactactttattccttaaggttactttgcatccagtattagcctgcaacattatagatgccctatgactcttgctttatggtattagctgcgctagccgatctttacaccaacgagcacccaagttttcccttcttccttgattttggctagaagcgatagcataaacaacctcttttgctaaaaaaattctcttgtttcactctttccagatttttagcaaccttatcatgtttgtctttaaatttgttcaacgcggtgactgaatattttcctttatccttaatttttggcaacctaatgatgctttatgttttgaaacgttgggagtagtagctactccctctgatcccataaaaaaccaaactaatatcggatgtgacacattctaatactacgaacttaaatatacatatgttcagatttatcgtactataatatgtcacatccgattctagattcgttttttataggacagatggagtacgtagcatgcaggatgcagccaagagaacccatccgtggccatcgctagatctatccattaatccatgcatggatcgatcgatcgattgtgcagaggctgcagacatgcgtacgatggcagaaggacacccaaattaattaagctcgcgcgcgcgatcgatcgacgatcgatcgctatagctactagctatgtggatgagagcagaaatcgataattaattatgacaattactactgggccggggacgaacagacacagagaaccacgcatatttgcagctcgatcgatcacactgatctgcatctgcatcgatcgcgatcaatcgatcgatcggcggacggcgtactgccacctgctgctgatcgaactgctgatatatgcgaggccattgcgcctacgtaccgcgacgcatcttatgcgttgtctaggctggtctcagctcaaatggggcgggagctactgtcttggcctcaggccctcagctgaaatggggcgggagctactgctagctgtgagggtagtagcttgattgctgctacggatagttcagatgatattgagactggcagccatgcatgctgctgctctgctccctgcatgcatgcccaagggctgcatacccctgcatgcctggccggcctgtatacatcgatctatccatatactacatgcatttccatttcagcttggtttccaggggcagcaggcaggagagggaggctgctggctgctgctgcagctagcgccactgcactgcacacacaaacttaaaggtggcctttcattcattgcccctcgctagtggccgctgtccccaacactgctcctctgcctgcctccatcctccccccccccccccaccacacacacccaaccacaggaccacctcttcgatctctctccctcctttttcagctgcaccagctgcaactctctcctctctctctctctcaccgagctgcattgccgcagtggtcactgctcagatcagagcggtgaagcatgcaattactggctgactagctagctgctgaaacgagctcaaaaggaaagagctgagctgagccgggcgcgcgggcgaggcagcatatgcatgcatgttttgtatgatgggcaatgaaacactgcaggggcaggcactagctacttgcttgactgtgcctgctcacaggcagctagctgtgcgagcctgcatgtcttctagtgtgcctcagcgaggaacagagatatggatattactcgtaaagagattggtcctagaaacagatcgatctgcatgcatgcctttcaaaccccaaaacaattgtttgcttgggttgcaaccatatggtggaaagctgtcatatatgctagtattgctcatgtatgtttttctcacatttgcagcaggatatcgcaggtgtttccatggccaatttctgtgtgtttcctacagcaattatggacttacagcaggtgtacatgtgcgtgacccagttcttttttaattccatcaccaccgccctcttcttatattcattcatccattaattcctgtgcttgctatccattggggaccttcagttagtttgggccctctgaatgagttgtcccaaggaacaatctataatgatgttctgatgactgccactgcatgttgtggtgtgtgtttgtcgccttgatgtgtctgtgcatgctagtagtagtagtatattgcaataaaccttttgcacacaagaaaggggagaatgctctgaggcgagacatggatgatactcctaccgaggaggatcatattcataggttttgtgcggtgcagtgcgtgctagcgcctgctgcaagcaggcatgtatcaagattcaagatatggcatgcaagatgctttgcacttttttactgtatctgggatgatactatatactcgtactatgcatgatcgattctcgcatcgcatgcatgcatgagcatgactttgccaatgggatgtcagtgatatatgcatggctagctcatcgcttctgggtattatgttgcagtgatgcagccttgcttgcacggcccaatgcaacggaaagatcagaatatactctctccatcctaaaagaatttctatcctggctatgaatctgaacacacaatatgtctaggtttctaagttaagattgattttttattggatatatcattgatctcctttcacatactcctacctactcctgaacaggcacaattaaaaatggtgagaaagaaagggcaagatcgcaagaggaaatgtcaattaactaaataaataaatatataatcatcagtgtcatattgtgtgtgtatgtgtgtaagaggaagataagggggagccgtggaggcacaggtgagaactgagaactatgctcgatctttgagaacgtgagaaacattgcaaatgatacactgctgattctgatgggtatcatcgtcactgggtggtagctactattcatatggccaccgtataaagcagctagctagggaacattgttctgatttatgacatgcaccagctagctagctagactgatatttactccatccatatatgttttcttcatccatcctaagatataaagctgctccctctatccgtgaatataagagattatactttttttttaagaattaaggaagtaagaaaatgacatgtgatgagataaaatgtgatgtgtgaaagaataaagtagtactctctccgtcctttaatataaaatcccttatattatgggacggagggagtataaaaattagtaggtgggagaataaattagtataaaagtagatggtagatgaataaattagtacaaaagttggagaacatgatgctgtcttggaattctaaaaccccttatattttggaacaaatttgataaaaaaatctcttatattcatgtatggagggagtatacctctgcagctcaatatacatatatatttcgtaagtacatataacatctctctaaaagtgttatatataaaagtttgatttattttaaataaagcaataataatattgtacgcttattgaggatacattcaaaattcatccttttgtgtcgaaatgacttcaattatatttactcctccgcttcatattatttattgttttagctttgtcctaagtcaaatattcctaagtactttagctatatattaattttagatattcatatagtttataatatatgaattatttatgtaatgaaagtatttatcatggtgaacctaaaacaatactaaattttataaatgttaaagtatataattttctaaaaaaaggtcaaagttagtaatatttggcatatataacaaagctaaaaacaacaaataatttgaaacggatggcataaagtattttaaaggcaaattattgggtaattaaaaatagtttgacttaacataacgggagagatattaattagtaattaggatagcttgagccagcattatgtatttgatactgctaattagctagagcaatgaacaatcaaaatcaaacaactgaactgacctattgctgacagttttctgtgagcatgagaagatgatactaatcccaaatccttttccttttcatagaaatgatcttatctgattatttctcccttttttgggtccaaatttatgtctttactgaggataaaagtaggtgtggtcctgctagctactagttgatgctcaaaagatggatggtccctagactaaactagcctcctagatttcgatgttgaaagatttgtaaaggtactgtattttagtgggaagaagaatattattcaacaatctaacaaaattcaaaatcaagtatacatactacctgccactaaatgttgatttttttagagaagggtatttatacccagcctctaaatccaaccggatatatgcagcctttttaatttagaaacttagccctcaaataatccaatctaaaatttgcttctacgaaaatttgaactcagcatcttgaagtgctacttagttcactgcaaccactagattacgtgccctttcacaccaaatgttttgatatataacatctaaggatcttcctttttgcaaacaactctcatcagctttcaagaccatactaattcaaagaaaaacaattaaaattccagctgatatagctatactcatggaacactaaaaactctttaattagttcaacctaattaattcaccagacgaagttagtgtaatccgaggaatagaaggtgttctatgaaattaagaagcatatctaggcattggcatccttgtatcttgctaatctaaccccatgttaatgctagtagcactttgatttgttgtccactgcacacagggggtgctagttgattaattaggtcaagcgtagtttatttcatcgtttgtttgatggcttatatatcaaccgcaacaaaatttaaattttaaaaattatttttaagttgatttaagttttttttactatagtttattttccagcgttgtctttaaattgttaattaggaaagttataaagagttttccctcaaaataatagttataaagagttttctcttaaaaaatagttataaatagttttatctataaactattttttattgcctagtcatagatcgagcaaacgatgcatgagaggtttagccaggtcaagtgtacatatgtaaatttaggaaagcatgtatatgcccgtatatacactccgctaacatatggcattgagcttaatgagcttatcagctcgccaggtcagctccgatcctctgctggccaaattgccaatatacgatctatacgatcgatcgatcagggagagtgaagtgagccgggggagcaacaagggagagagcatatggtggtaaaaggacagtgacgcgacagcgacgacgctgatcatttattcctcagtgtaaatacccaccacaaagcttcacaggtcgtcttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtaagtgtttctctctctgaatacatctggagccggtttgggtgtttgatttgttaattcttggcgattattctatggatttggggatcacaaaattatgtgtgtgtgtgccttttgagagtttttaatctccccagctttccgtggtccttgattaggattttatgctgtggatctgagcccagatttgttaattcttcttcaattattttctgtgagactgtacaattccctcttggatttctttcgtacctgagttccatttctttttccatggaaggtttcttctctgaacctgcagtactgggtcgccaaccaaataatctttgtttcaattgcaccggatcgcctctctctgatccttttgcttccggaacgacctggttgatcgatctgtcaatttaattatccattttgcccactgctcttcatttttttcctttttttttcctgaatatagtgttcagttctaggaatccccaactgagtaaattaatcctctgtcaagcctccaaaaaatttcacctttttcgctcgccacacaaatttcctccctcgatcgattggtttcaaagagcacaatttaaaagctaatgactgctacagttaaagactgggtgcatgctgcaggccctgcaggattagctagctagcaaaagctattcgtctcggcataaaggctagcactcaatacaaaccccccgacccagccttctcctgttcctcattcccatgggcaaatagtgatcctttgtacgatccaattcatagctcttcttcccaccggcgagacgaatcatgcatggctgctcgattcaatcatggaatcatatcattcccacacatagtgccactgctgatggctcgcatgcagctcacccagctagagctgcaagcgcagcagggaagagccggtctttcgatctcgatctcgctactagctactacctaggtagatcgattgataggagtagagatatagctagctgttgctcgcaaatacgcagcgaataaagctggctcgctttccccattccccaatggaacagtgacacaagcagagagagagagagagagagagagagagataatccgtcgagatcgggtggtagacccttccgtgcacaggagagatttatttaccccgggttaattactagtagtgctggttgattatggcgcgaaattttatgctaatcagtctgcatgcgatgttactcctaattaattaggtgttgttgtgtgtgtaatgattgggtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccgagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttcagttctgcctagccttaattttctttattttttcaaaagggaaacttctttgtgtgtgtattcagttttctgacgccgttgctgcatcccaagcttcctggctgtacacaaaacattgggcaatgaatatctggttgacacactgcatactgaggaagtatgtccctttttccagttcattctgcgaaatataaatacactccctgcaaaatactaatttccttccaggtatatgtagactgaaccctgaagtatacattatttatattctaaatgtgaaacaaagaaacttacagtggatatttcttaatgttggaaaaaaaatgctggtttcttatgtgaaggaagcatatatatacacatgattatttttcttaactgtcccaataaattaaaatggtatttttaaattatttcagaaacatggaaatagtatagtgtgctttgatgtttaaccctatgcttgaatgtttttcgaggaattaaaacttataaagggctacaactcacacaaagtaaacaatttttcacctcatgcatatatgagcttgggtaatagtcaatccatgtgattccacaaggctattaattgcagtcataatatacataatgcaatgaaatatctatatatgggttaatggatatgtatgaataatacatacatgcgtcgtcattgtattaatttgagatctctaccagtacaattaatcttacgtgtacacatcttgttattttgaacgacacatgaggtcacatatatatagctagatatataccgtgccaaagtaacaagataaggttctatctgcaggttaatgtttattaacacccaaacatctttacaactcctacctagctaagtttaactagagaaggaacctctttacaactcttaccctagctagttcagtttagagtttaggccgcttagggacatggtccacatgaatatatagagttatgtaaaatagtaggcattcttccatgaaacacattgatagtacatgcctacaattatgaaaacggcaagcagctcactgaagcatgataggaagataaacataatctagctaagcatcatcttattgttgtacgtacgtgcaagtgtagcattatattgcctagtcacaaataaattaagaacttaatttagaagctagtagcaaagtaaattcgaagaggatgctgaagtacccaggaaaaagtatattgaggctaggaaaggatcagcacaacgttgcaattaattgtgaaattgtaaaaatgcagcaaaatgattttcgatccatttattaattaggtcaaagatacgtataaccgtaccaactgatcaaattgatgatcagattgacatgtgaaaaaggaggatcaataaattatactcctagtatatgtattggggcatatatgttttcacttgattgataagccggctaatcctatatagcttaagaaatcatcaattactatgttttctcatacgtattattgtcaaattaatatatatgtcaattaagttcccaaattaactttctcagtcaaattgatctgctcctcactaattaatttgccaatttgttatgaaaaaaatgcatatgctttacacttttcatttagtatataacatgattaaaggcagattttaccgaaataataaattaaactaggtacaggaaatcatatgactgacttgagttgatataaattcaaataaggaaatattggtcatgtttatttcttaaaatacggacatgtttaagcaaagattgtgcttatcacatggaagatggaacttccttcaagaaaaaaataattaaacttaattaatggtagagctgaaaatgcttttgaagttttatgcggcttgatcgatcccatagaaaaaaaagaaaacaatatgattgtatatatatatataccattctttcattactctatatactatatctggtttcaaataattgtcactttgagtcttcgatcatcaataaatttaatttaatagttagattatgatgtacaaaagtttcatgaatatatttaggatgcaacacactttgttcatatggaatacttctaagcatttaaaaattttcttaacaaaagatgaatggtcaaagtttgaaaatgaatacaatgacaagtatttgaatactcatgaagtatatactccctccgtctcaaaataagcgcaaccataaattttcgcgtacaattttgatcgtccgtcttatttgaaatttacgattagtatttttattgatattatattataaaacatgaacaatactttatacgtgacttatgtttttagtttttttttcaaaaaaattttaaataagacggacgattaaagttgggcacggaaactcatgattgcgcttattttgggacggaaggagtatatgggaaatatatacattcttcatttcatatgaatagatatgtgcacttctggaaagtcaaaatgacctcagatccacaccagttctacaaatataaatatttatatatagtagaaaagatgcccgtgcgttgcaacaggggaaggttttttcatcttattattgttatacagtttagttaaggtaaaatttactgtgcggattcgcttggatatatatattttttagaaaatcatgagctacagttaggatcgtctcaagttagcatgtgagtttttttaatgagatttcttatacgacgaattctgtatttccaaaagcgaacgaatttaaaaactgactcaaatacggatatgtatttttaaaaggaaacttaaaaaccaactcatacacagatgacgtaccaaaatactggtaaaaacattttaaatttttataatagtagagaagagttatacgtacttgtttttcggacaatccggttttcagagccagctagtacaaagtatttcagaagtcaagacctgtcctcagatgactacactcattatatattttgttcgtgcatgcagaatgcatttaattctagacgattgttggcgaaagaaagacaaactgagcagctcaaacactgttcacaccatacactcctacctgttgggactagctagctagttagatggtcacagctcacaaaacataatggtaaagtagcgatgtaaagagagcagtattaccgaccagctcgctagcacattcaactcgaccctgtactgatctgtcctctatctctctctctctggtagatctctgacccgtaaacatcatcctgcgtcacccccaccagcaacgggatgcccaaagaaaacaacaaaataagacacggtggacacactttgttggcgcagacccaccaactaacgcacagccagctagctgctagcttagcacaaacctaattaagctagaggctagtatagacaacatgcatgcatcaacataatatgcatatcacttttgtaaatggtaacatgcctagatagctagcttacctagctagctaaaagtaccaatcgtgtaaaaggaagatcatcagcagaaaggcatgcacagttacacgcaagaaattatctgttaatctaatcacgggtactgtatatgcatgacaattactacacaaccacctaacattcttaactaagaattatccgcagcagcagaagcagtggtaatatcctactccctccgtgtttaccattcgtcttattcaaaaaatttaagtaattattttttttttcatatcatttgatttattgttaaatatactttcatgtttacatatagttttgcatatttcacaattttttttgataagacgaacagtcaaacatgtgctaaaaagttaacggtgtcaaacattttgaaacggagggagtaattaactagtactatggatattccacaacgatctggagtagttgttttagacatatataggctgctccagtctatatagggcccatttggaatgtaatgtattatatatacaagaatttggatgcatgtcatgcatggctagtttaatcatacaagaattaaacatgaagaatcgtttaggcactgaaatttgcagaaattcttaaagaaaaagtctgcacaatttatcttagacacacacacacacacacagagatcagaaagatcagaatgctctgaaacatctcaaaggaaatgaaaatatgaggtctcagcatatgtttgaagtcatccaaaatatggaggaaggaaagggattccatggtaattttcaatctaaaaaaatccgataattcaaaaaggttctacaggaaatattctatatagtttaagcctatgaaaaaaactacacatgcatctcttaacaagtcctaagttttagaaatataatgttcctcattgttggattactactgtgtaataatgtaaagttttctaagaaaagcttctacacaccattcattaaattgagtgggtaatacacaaagacctagctaaccacaaaatttaacagtatggtgtacgttaagaagcaatggcaaccaacagaccacaaataaattaaaggagaagagaacaaaccgaacaagtgaacaacagctataagatctcgaggcacacatcaaagatctccatactgaccatatatatgtagccaaaaatggaggcaatgaacaactcccactgtactccaaattaacaccggagcagatcaacattctcgacaactttggaggattgattggtacgaccagtaaattatggtgaagacaccctctcatgctttaagataatcggtcccatatttgccaagcaaccttggtgaaaatcataattaagacgtactatcaactcgcactgaagttcttctttgaaaattctgtcttacatgttgagccaccaatatccatgaatggagaatcaccgtgcggcataagaaaatcattcctgagacaagaaagctagccactgagatactagaatacattgacaatgtgtatgtattagattaatattattcaagcaaacttaattaacccaacatgacagttattcttcttgttgtcagtcaccaccaatatttgaccgatcactaattggtaattaagtgagattattaattagcagaccaaacagcagctaagacctgcgtatcagcggttcattctgcgtgccatcatcctacccatttgaccaagaggaaagcgagcactgcgtacgtgggggtcactatctcatcttgcgtgccggatcgatcgattgagagcaatatatcagggctaggtagatctttttccctccacgtacgcacctttgccaaagctgaacccaaatcccaaagcgacctttcttttgtgcactgatctaacaagctatagctactcgatcatctgcacgtatatgtgcttctctgcttatttggggaaaaaagacgctgttcccctgccttagcagcggctactactagctagtagagccgaaaacatttcctgacaaaaacccttccaaacaactcctgctgtctaccgtggacaagaccctgcagggtcaaagacaagctaagagtaattaggactttgtttcaaaaagaaagccagggttttgaagatactacttcgtaattactaggacttgagccttaggagttaggctttagctccataatcctatttacatgctataaaaaatactatacaataattcaaaacataaattaagaagtagctaccaagggcacattagctctgctctaggttcagctctacacccctgaataaaacatgaatatctgcaaagacattgcccagctgagaaaagacagccttttggttgatttgtatatgtacacatgtatatacagaggcatatatacacacacacacaaccatgtcttatctttgaatggcatacctaaaacaaaaggacaagcatcttaagtttgcaaaaattttgtctccgtgaccaccaatcatctagcctagcagttccccaagaaaaaaagaaaaatcaagctgctatagctagcaagcagcaagcgaagggaagtgaccagtgagtggggttgatgagtagtaaaagaccagcagtggggctggctctgtggctggcctggcctggccggggggctggtctttggaggcgagctgagctaggccccctacggttaaagcgctctctctctctctctctctctctctctctctctctctctctctctctctctctctctctctctctctctctgcgtgcactgtgtctgcatagccctgtagctagggtttgcatgcatgcagcaagcagttagctaagcagatgtacccttcgtatcttttgccacggagagacatggaccaatatataccctttcacatgaatggtcccctgaggctaccacgattcctccccacatttttcctatcaaactcatcttcctttcatctttagtttcatccgtttgttaactttgagtatagctaactagcttagcaacaaaccggtaattagctagactagctgttctcatgctggaaaagtaacctagcctacgcatctagtaattatgtaattatatgcatgcacacacatgaaccgattttgatcaacaatgtagccaactagctagagcaatagattgcacgctggctatccttaggtgtgaatatatggtgtatggcagttaaggttgattattattaagggagatgatgatgaactgtgtagtgtgggctgtggcaaatggatgtgtcttgcatggtacgtgacagacgagcaaattggacacacgagcaatgatactctcgtaagattatgctttggagagcagtataggggagtggcctaccaaatgcatagcctgtaccatgcattatcctcatttcgttgatcactctttcgtttatctcttctgtagcatgactaattctatagtaggtacgtgcgctagccgctaggtacagatcgaaccgtgagtttcttaactagaaatggggagaaaagaaaatcagctaccttaactagctgctaccaacctaaattctgtaagcagatgcatgcatttcattaattaacaggatgcgatcgatgcatgcaaagggcggttgctcctcgcggtattttagtcgtcaaactgattctccccatgatctattgcatattttgagctatttttcaaaaaaaaaatcacaaaagcttaattaagtggaacacaaaaggcgaacatattgcaactgcgttaattcgttttttattaagaaggaaaaatcacttgaatgtcttctgaaggccgtcgtacgtccatatcgcgaaaaatcagtgtgttaaccgacggtcctgacgaattctacctgtgaaggaaaaaaaacggttccaatataatgtagtgattgcacgtgtacgtataactactgcagcatacagcagacccattgcatatgtacaattaacctggcgctacagtatgcacgggtattacttcctccatcccacaatataaacatttttagagttaaacatggttattaagaaaagtaggtacaattgaatagaggagagttgtaattcgataagtggaggtatgtggaaaatttgaatggtggagggttgtgattggttgagaagacaatgttagtgtaaaaattgttatatgttgggacaaattttagaggctataagttattatattttgggacggagggagtacctgacggaggattaattggaccttgttcctttgcagctgacgcatgtgtgtacaatcaacctgtcgccggcccttaagaggctggtacatctgtgtttgcagtggacttcgagctgggcctgcagcctgatgggccgacttataggctcatcaagagaacatgcatcgatggttccatccatgccaggcgaggcgactggcaaatggtaatactgatgcgtgacacagccggccgcacagcacaggtgtaccgcgtgtagcatcgcattatcattgcaggatagagcagtagtggcgagctaaaccctctccaacgcagtcggaccataataaaccaactgtgccatctgcttggagccttcgatcccgacctcccgttccctggcaacttctgagcttaattactacagtaccatctgtccagctaattatagcacccgcttgcacgcgagcagagacatttctgcatcacacatgttagtatgctattgacaaattgtgatgaccagccatgaaaatgcccttgcaatccaccacagggataaatgttattatgttaaggatggtttcctgccaatcagtcaacaatatctagtacgatgctaccgagatattctccaggaagtttttaagcattcctacatcagagacttggacgagtcgcatggtccatgagtaactcgtcaaatgacatgttgcaactatcagcccaccagatggagtacatgatcagatccaacccttcctgattcgagcccatgcaagagcagctattagggcaccacctaaatgagaagtacctgatacctgaccttgcctctaaaaaataaacagatatcagcctctgtacaactttttttggggaaaaggaagtatatatataaaaagcataaattagataaatgtaatcatcaagaagaaagatataaaacatagaatttcaactagccaggaaaggctagtacattctagaaacagaaacatcacatggaaaaatcagtaaaatattcctagccaccctaaatgtgaatatcaactttttaaaaaatatcaggttaatttaagaccagagctactgcaggcaggaacttcacagagtaagcgattcacaaaaatcccaaaattgaaataaaaatgaaagtagcagtgtccaacagctatactgtaatgcatctgctgaaccagcacactaccacagtcaaaactcatggaaaagcaacagggtagcaccaaaaaaccaaaaggagcacttattacattagcaaatccacatgaaaagaagtcacattttaagttactgcataccttcaccctcagcaaatcagcaccgatcaaaatagccccctgaaaagtcaaagagtttttgttttacatcatagcaaccatgcttaacagaaagttttgaagaaaaaaagcttctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccataaggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgatgttttaaattcttgtacacaattgtttgctttggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacagaagaagtatgtattttccaataacttgaaagacacacatgcacacacgtcatcacgcacgcacatcacagtcacacatcctcgcaaacacgctaacacacgctcaaacagaagaggctaacggcgtaactgcgacatcaataataaattctaattgataaagctacaacttgtgcacaatatctatggacgttaggatttaaaaccttagcagacaagattatgcacctatgacatcactaacacatcatcgatggttcctggttagaaaactatcaacaacataacaaacatatttttgtctcgaatggatttgaatatggtcatgatggatgtggagtagttagtaaatactccatccataaaaaaaacgaatctagaactgcatgtgtccagatttgtcatatcctagtacgatgtttagtttttctttgggaatggaagaagtatgtcttttccaataacttgaaagacacacatgcacacacgtcatcacgtacacacatcacgatcacacatccttgtgaacagctaacacacgctcaaacagaagaggctagtggcgtaactgctacaacttttgcgcaatatctatggacattaggatttaaaaccttagaatacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatatatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaattctctcggccaaatagtgtcgatacgtgcaacacagtaaaatgcttgttgaaacattttgctcatatgcatgaaacatcaaatataaacaattgaaacatatacatactttttattagaatatagtcaaacgagatgtcattgtaaagatttaatcataagaaacataattgtataataaaattatagattagataaattgtttagaagaaaaatcattttaaacaaggaggtgggagagataaaaagctaatagttggttacatcatatccattgcatgctgcagctcatcacatcacatccttccatgctttgttgcatgctgccattatctccaccataaataatccattttcgtgctacgttttgcttgctccgacggaatgttcgattttttgtcgggcgtcggatgtctgataagaagcattttcgtcacaactcacaacacaacctaaaaaaaatagcagtccaaaagtgtaccataatttagaaaggaataagtccattttgcctccctcatctcttgcgcttgcgtgaataacatccctcaaccggaaaaccgggtataatgcctccttcttctctgaaaaccagagcaaatcacctccctcggcggtttcggaggtggttttgtcctacgtggcggctctgacttccatctgcgcatcgacgtggccgcttacctcgccactaccctcaaaacaacatgtcaatcgcgccccacatgttagtgagtaaaacactaaaaatcaaatattgggcccacatgtcagctaccttcccccttcctctctatcctcacggcaagcgcagcatggagagagctagctcggcggcagcaggacggcgggtgctcggtggagcggcggggcggcgggagcttggcggagcagcggggcggtgggagctcggtggagcagcgggagagtcggggcggcgggaggtcggtaggagctcggtggagcggcgggagaggcggggcggcgggagctcggcggagtggcggaatggcggggcggcgggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccgccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggaacgttgggttggggatcaggtcgtcgacgcacgcctgcgccccgaacgcgcacttggacttggcggcgatgt

SEQ ID NO: 58514 - DNA, 53834 bp, Oryza sativa
aatctctttttgattaggcctcatttgggagtcccatactcccgtacgtgtacatgtcgactagggtttaattaagtactccgcacagtcaccgcgcggcttaactaacatttggatgaatccctttcaaagaagccctttttagtgtattcttgttaccggcctcatgcagctcaccacgaatctagacgcataggtagtacggagtgataaatactagtaatacgtgctccctccatcccttaatatttaacgccgttgacatttttacatcatatttgaccattcgtcttattcaaaaaatttaagtaaatgttttttttttgtggtttgatttatcactaaatgaaatttaagcactatttatatttttaagatttatataatttttggttaacggcgtcaaatattaaaggacggagggagtatatacataccgcaatctttgagtaggaagctatagggtgaagtcattttgtcgcgctacttacttattgtgaagtccatatgtagtaataattaataatacatatatacacgtacgtacatcatatctcacacttctgagaaaaccctcttttgtccggtttataaccctttagtcccggttatagcaaccctgctgggaaaaccctcttttgtcccggtttataatcccctttagtcccgtttaaagcaatcgggaaaaaaaggcgggacttaagatgccccggtttataaccccttttagtccaggttatagcaaccgggacaaagaaagtgggactaaagatggcgatctttagtcccgattacctgtgatctttaatcccggttatataaccaggactaaagatgtataataagaaccaggacaaagtaagcgggactaaagatgacgatctttagttccggttatataaccggaccctgctgggaaaaccctcttttgtatcggtttataaccctctttagtcctggttatagcaaccgggaaaaaaaagcgggactaaaaatgtcccagtttataacccctttagtcccggttatagcaaccgggatagagaaaacgggactaaagatagcaatctttaatcccggttatataactaggacttaagtgaaccgggacaaagaaagcggtactaaagatggcgccatctttagtaccgggactatgtataataagttgcaaaaatatgtcaggtgtgggattcaaactcaaggcctttcacttcagccctcacgcacgcaaccatcccaccaactacactcatctgacatagataggggtgctttctttttaactagcactgaaggcatctttagtcccggttggtgactaaaaatcaatttttaatctcggttcgtaataccaattgggactaaaaatgttttgaaagattttgtgcatctttagtaatggttactattcaaaccaggacaaatgtggttttatccaaccgatcaaagatcatttctccacaaaccaggacaaatgtggttttatccaaccgatcaaagatcatttctccactagtgtcactactctcgtgtatgtttccaaatgtcaccaacaccggtaatgtacgaactaaaactgagcaaaatccccaaaataacatgcgccacaaacaaacaccgtaccctataacctgtgtgagttccaatatacttgaaatatagcattcccactataaacacatttgaaatatagtgtaggagtgcgtgcgcttgaacactgtttacgtgcacacacacacccaggcacactttaatactctctgcattgtgtggcgacattgacttttcatataacgtttaatcattcgttttatttaaaagagtataatttattttgttatgacttgttttatcataaaagaaactacatataattttaacttgtatattattatgctaaatttttagataagataaatggttaaatgttattaaaaaatcaacaacatcatacattttaagatggaggtaatatatattagtgctatgtctgtctatgcaacaagatctaaagaggggtttagttttttctatcttttttttttcgtgggattacctgttttttggtgcgttaggattttgaggtagctagtgtgggctttttatatgggaaaatgcgatggttgggaaggagaacgaagagttggtttttaaaaatattagagatatgtataactaattaaatctcgtatacgctatccctccatcccaaagtatatatttcttttgtcaataatattgagaagtaattaacttatccatcatgtgatgaaaccaagaaacatgtgtgtgtctatatatatatagtcaatgagtattaatatgattttttggattctgattgtaggatcgaatcataagaactaagccaaccagaggggagggtgaatggttggtatacacaaaaacccaaaacttttagtggaaataaaagttacctcaaattcgacggattgcggtctgaccgaagtagtcgtaacggtttgactgcccaaagatcgttggtctgaccgaggtagtaatacaggtcgaaccgccgagatcaaaccctgcctcctgaagccgtcgccggtctgaccgcaggtatgccgccgatcggaccaccgcgataccgccggtctgaccaccggtgtcccgtcagttggaccgctgcacccgagaaaacacgaatcgaagaactctcaaagtagatgacaactttattatttctctctgtgtttacaaagtgcaacaacaacactcctcacgaaattctcgactaaactcgaaaccctaactaaaactatcaactcaatgctctcaaaagtgataccgggaagcctcacgctccctctctatttatacatgaggtaggcatcctaaagccgcgaaccaaactcatactagaagtcctaaatcacttaggaaaccttctcgtataagaaacaaactttacaaactccaatcataccaaatttgaactccttccaaattcgactccacatcccatacgcacacaatacctccatcgtatgccatatggaatctttaccaaccacgtgcattgaactctagcaaaagtatcccgcatgatatctgaccgtcacggacatcgccttatccccaagtcgactcccgatccatcactgcaaatactctcctgaggcatcaaatcacctacacatgaatcaaacaaagaaaccatattccgaaaccaaactatctccaacttgactcattgttagcaaacaacagtattacatacatatagtatccatctagaagccataaacatgaaacaatcacggatatccaaataaacaacccgaaaccgaaaccgacacagcgtcggccggtcagaccgccgcgcgatacacgccggtctgaccggcaaccactgcccggtctgaccggacccaaatcatagcattacctgcatatcacctgtaaatccaatcatctccaaaaccacttcgccaataatctccaaatatcaaaaccgttaatcacagatgctaattgttcatcacagaataataatcaaaacacgctttgattttacactgatcaataatttagtttagtacatagagagactacaaatatatccatctcatttagaaaaatcagaaaataaaatataccttacatttgttttgatggaggattttacatgcataattaattaatagacagagagagcagcagataaataattaaagagacactagtagaattgcaggcagcagagcagcaggtaatagcaatcgctagactgtttccggcccagctgcgacgcaatcggctgtattattatgattgaatgatacggtagggcgtttgaacaagtcgaggccgaggtagcaggagacggcgatgtggtaggacctggtgcaggccttcccgatgaggaatcggacggtggccgtcacctgcgcggtgatcgggatgtcgttgcctctcatcatgttttggacccagtagtcgccgctgacgaacacccgcaccgggatggccgtcgtgttccgcggcggctgcacgaacggcgtccgcaccgacgaggcgtcgtcttcgttgagcagcgtgggctcgccgtcgaacggcgtgtaatgcagcttcacgtcgaacccgcggtactccacggcggcgcgccacccggggttggcggcggcgactgtgaggttcagctccacacctccatccagaggcaggatcatgcgcgaggccttggtgacggagaagtcgatctccccggggctcagcagcgcggagatgccgatcacaatgacggtcgccgcgagggttccaacgacagcgacgaggatgtactgcttcgtgctccaatatgatttgtgtgtgtttggtgatgatgaagccacctgcagcttcttcgtcgtcgtcgtcgccgccgccgccattgctgccatgcctgcttaattatctagctacctacgtgtacctccttactagttagctagctagctagtgatgcgtgtgtgatcgacttgtttaattaattgaagaaagctactctctccatcatatcgaagcatttccaaatggtttaagtagagattaaggtttataaagaatatactttcgtgccgatgaggacggatgcaagggtagcttgagatagaagacagcataagaaattcaaatgagagataattgataggagtacttctatatagtacttcatctgtttcacgatataaatcattctatcattgtctatattcatctagatatataacatctatatgaatgtgtgtaatgatagaatgacttgtagtgtgaaacggaggaagtatatatgaatggagctgaatttttgactggaggcttcctctcgtttgtgcatgttataaaaaacattgttattatttaagaaaattggtgaaaataaattaatatgtaatacgttatttcacgaacatgcaatctcgaaattgtttctagctagttgtataaattgaatttgaacacaaatacttatggaataatatatgacattttaatctatctcgtttgtttttcatattgaaccagatagctcgtgtgcgaattcgaataaagtatttgtttttctctagaaaaagaattcgaataaagtagaaataattaattcttggctatcttgcatgcgccaattcgaataaagtgagtataaataattgatgactagctacgtacgatcgagctgcatgactgcgatatgcatggtcgaattcgaataaagtagcttgtatttctacgctagctaggtgggtgagcgggaattggaataattaacttttagttaagctgttttttttgttaattaagctactacgttactagctttaactaatttgtatacgatcctcgcgtcgtgagctagctagctgtagctaggtagacaccacaccacagcatgcgcaacgagaaaaaggaggcggcggaggaggaggaggaggaggagaagaaattccggtggctggacgtggtgcgatacgcggcggccggggttgtggcgttgctcgccgtgggggtgctggtcggggccatcgtggtggtgctccggccggacgcgctggtcatgaaggtcatccacggctccatgttggtaaacctgccgccgccgagcttgacgttcacgttccagctggaggtcgacaacccaagcgggcgcgacaccatgagcttcaccgacatgtccgtcgccgtcttggccgtctccgtcttcggcggcggcgtgatcagcatggctaacctcttctacttgcccaacatcacggacttgcagccggggaagatgatgcaggtggtgacgacgcagtggacgaccaacccggaggcggaggtcggcgactacttcgtgaggaggctatcccgtggggaaaccatggccgtcaccctgcgagtccagggcatcctcatcaccaggttggacaccctcaacggcgacgggccggtccacaccagcaaggccaacgtcacctacacttgcttcaacgttaaactcggcgtcgacaagtccttgaactccaccgacgacgtttcttgcaatagcaagcagtggcggatctagaaaaaaatagtagtgggggctgaataaactacatcagcataaatcgaaccttcagtccccacatcctatagatctatggaaaaaaaatttagtgggggcttaggggggtctccactatccctgggtaggtagtggggtctcaaaacccctccgcccccattgtgaatccgcccctgccagcaagtagctacgtacctatcacttactgtacttacctacgtacgctatatacatatacttatatatctgcatatagatacatacatatgtatgtatgtatgtatgcgtgccgcgcgtgtgtagatatatatatacatacacacgtaaaataaacaaaaaataattaatgagctactctctaagaattcaattttgagtttgaatctggctatatatccaggatttgatttttttttttttgacgaagggagtactagctagcactgtgttgtcacactcgtcactacttacagatccggccaacattgatgtcccatctatgaaaaggttacaggtcaccgaggccatcatctcttatgggtgcaaatatagtccatttagaatgtggatatgaaatatgacatgccgtaaatgtgatgtcatccataatgagttatggttgtgacacgttaaagactattttgtaatgtttgttttgatttcgatgatgagtgaagtttcaagttctgttacaaggtataaggtgcggttttattttgttgacaaatgtatgcacttgcacctatataaatatggaattgcatattttagtagggaaggtctatatacaattcgactgaaataaaaacctccatcgttcttatagttgttagtaggctggtgtgagagtgttgttggtggagttgttgtggtagtcatgatttcgcttagttgttctaattaattatgtactataaggtttggtcttgtttcttcttaaaatgggacacatttcttcctttatataaaacgtcagcaaatgtctaaccgttcaaaaaaaatgatagaaacaaaaaccactaaatcattttgaatgttgtgtcgtcggatgcgctttaagatttgtgcatatggtaaaaccttctccttttcttcaccctcccccttctttaggttgagaggagaaaagataaaattttaaaaatatatgttctttttaatttgaaggtagagaggagaaaacctgttttttcaattttattttttccccatgtgattgacattggatcccactgatatgtagacgccaacgcggcataccacatcagttcacatagcgtattagagctcatttggacaagttcgaggatccgaaaatacattttgagagttcagcgagtggattgaaaccgtttagacaagtttagagacccaaaaatacattttgaaagccaccattgcatgccacatcagtacgtggagcggattagagcccatttaatttggatatattttaatttggattgatcaatttgttcgaccacaatatatatatatatatatatatatatatatatatatatatatgatactcatatggggcaccatggtattaaatacataaattcactcaaatttttcaaaatttttaaattgtgagtatatacctagttataagaattcgattcatatctatacctatcaacaaagcaactcaaatttagctttatttcacaatccataattgcatacctaactaattatatgttttatatgtttggatgctatatacctagaatcaaaatctaacaaaaacaagttcaaatttagttcaaacttgctttgaactagttagtaaagtagttaatgttaatacccaaacatttataaaagtttcatacccatttaaattgagtatatactcaattttaatcatggtgcccgggcaccatggagcagcaaacaaatttaatatatatatatatatatatatatatatatatatatataacacattacgcttttgtacttgcttcaaacaaaaagtttaaacttggtatcgatcggtaaaagttggtcaagcgctatatcctgtttgcaagctgctgcctagctgcttcgctgcctctggcttgctggcctgctactgctgcatgcatgcggctgattgatctgctagttagctgccactgctggccaagcacacgcatgggccaacggcccaaagccagtttgctgctgcttactgagcccaaagcaaatcaaaggcagccactagctagcttttttttttacttcctccatccaaaaataagttaatcaagtacggaatgtagcatttatccttagtgctcgtcatagattaacttattttaacaaaaggagtaattattttgggcgtcgctgttcgggcacttcactctagaaggaaaaaaaatagcatcatcccctccaaaaccccaactgcagttgaggtgatgataagtattctcgctagatccttcacaccacgtatactcttaacaccattcacaatgcgtctatatggcatacgtcccaaaccagcctcgtagaagattccccacatatgcaagttccatgcacacacaaagtgttggtgctaattatcttgctaagtgcgaaccatgactgggttggcgagccactctggatggagaacttctctgatgaagccagctttgagaagtctgtcaagctcttctcttatagcttgtttccgatcaggtgttaatctccgcagtttttgcttaactggcttggcgtcgggtcgcaccatgagtttgtactcaatcatctccctggggacccccggcatgtcggacggttgccaagcaaacacgtctgcattgtcgcggaggaaggtgatgagctcgatttcctatttgctggtcagtgtcgccccgatcttgacagtcttgtcggggttagtgctggtcagcgggacgattttgatcgccccgtcgggtcttgacgtcttgttgggcttgctcactttcgtaggtggcacagctgtggtgggtaggttgggagtttgctcgaccatgtcaaggctccgcttgtcgcattgtgctgctagctttgcatttctttgaatagtgattttcccttttggtcctagcatcttgagcaattgatacgcgtagtgggatgccgccatgaacttcgtgagcgcagtccttcctaagatggcgttgtacgccgtgtcgaactcggcgacatcgaaggtgacctgctatgtttggaagttatcggcctgtccgaaagtgacaggtagcgtgattttgcccagtggcttggacgatgattctggagtgatcccgtggaaaggttgacctgatagtgtgtcacgcccagaaatttagcccaaatttccatactattttgtgtattaaatccctatccaggaccagccagggtacacaaaacgacaagtaatatacagttccaaacgtaaataaagcgtaaaatacttacagaagaggctcttagtcctcgcaccgaaaagaaacgacagcagcggaaaaaggtgatcctaacggggcttcagctccactccacaggcaaaactcaactggggtctgagccttggtcttctaacttcatcttcagctcagaagcactacacttctgaaaagggggaaataatagcaaggctgagtacaaccaccgtactcagcaagccacaccaatgatgcagacgtgcaaggggatacaaggacggtttgtggctatttgcataaaggcggttgtaaaacattttattgagcaaaacagtaaaactgttgagtaattaaagtaatattaaatctccactgattaacgctacactacgttacacaggcccaaccaacccacctgaactacagtgcattgggtcgatttattaggatgggactaatcacggtgaatcaggtcgaccgcccataaccgtgggcatggctattcgaatagttttactctgatcagaggtgtacaactgtacccacaagacacagccccacgacacgtttccgtgcgccgacatgccaccacgacataccggaaagaggccgtgacaagacctttcgcataaccccatctaaccaagcacaccacacctcaggtttcacctccactcctcgcaaggcagcgagcagtcccctctcgtgcctaggtgaatccggaagctgcataggccgtcgcagggcctatccaaactccatcacgcccacccttgcctggatgcgtcagctagaggaaagctacactacaagctcagccgttgcccacgctggcttgtggtaagtacgataagttcttccagggcatcccgcgaaccggtccttaattgccatgggtgcgactagcaaaaccatgcacccacagcccaccattcagtcgcattttagttggataattacggccatgaagcatggccagatgtctcgagcacgcagcccattctgatactaaaaaggtctaatactgcaattatcccatcaactgagctagtggtaattaagcatggctaagcatatagttctagctaggtcacataagtaacatgagctagtcgatttattacccaaggttgacaaagaacagatatcaagtaaacatggcacaagtgagcagataggtaatatccagatcccatgtaattagcaaaacatgcatatttatttgcaaacggtaaaacatttataaattgggataaacatgctcaaggggaatgtgtgacttgccttgcttcttcaaaacaatcttccgaactcttttcctcgtgaccgcggacttccgaaacgacggattctacacgctggcacgcaaaacgaggaaaaacactaataaaaaccaagaaaacagtacataaaaagtaaacaaacttgtagagcttaattttagatgaattttgcaagttgaacggcccaatttggagttcgaatgaattagatatgaattttagaagttttgagccattttaatggatttatacaattattaccgatttatgacgcaattaataattattttctcaaaggaaaaggcattcgctgacgtcagcaaggggcgccggcgccgacaggcgggccgaacgcgtcagcgggtcaaggaggcaggcacacggtggacacggcccaccgtggccgaggcggcaccgtggaccgagaccacgggtggtccacgggcagcacccaaaagttggcaacggagggagggggctggctcgccggccgacccgaccaggcggcggcggctcccggccggacactcgccgctgatggcggcacgtcgtggcgccggacacgggaggcagaggggaaaaggaaaggaggagggaggcctcaccgtgcgccgggtggcgaggggcgacgagtgcggcggcgagctcctcgggacgacggcgggacggcgctcccgctgcggctccacgggcgggaagcggcggacggagactgggatgacctggggagggcggtggaaggattaggggaaaaggaggaggcgcgaggcggcggaaaaaaaaaggccggaggccggcgacatggggagtagctcatctcaacgggaaggagaggactccggcggtggatggcgagggcgatggggtggccgaggtgcggcaccagacggagaagccgacggaggtaatggcgaccgacgacagcggctagggcggcgatgattgttggccggaggcggcaaaagcagcggcaacctcgggcttgcggtggggaggtggttccatctatggagaagggaaatagagcggaggccaaggtgcggtggggtgcggtgagcgcggtggaggcagtggcgcagctgggcgaagcggcgcttgccggcgggaagcggctggagttggcgacggtggcggagagagatggtgaatgtggcggcggcgtttcggcaatggtttggggaaggggagcggtggacggggtgcggcaacgcgcggtgaagccggcggcgcaaacggcgcggcgcggggacggcggcagcagcgacagaggcgactggagggtcgccggcaagcggcggcgcttgggctcacgtggggagagcgggagagagcgcggggagctcggggaggagggggaaacggaagaggagagcccggggatcccttttataggctcgggaaggcgggatcgagcccagtagaggcgacaaccgacgatggggtgggctccggcgacgtgggtgaagtggggcggtttggcgctggttttggaggggagaagagggggaaggggtggagaacgtgaaggggatcgtgcccacggccggtggactcgcgcgcggggtggagaaggagggcggaaacagcggcgtcatggggaggctcggccggccatggcggcggttggagccggaggaaggggatgacaggtggggccttgggtcccacctgtcggggagatagagagagggaaaaacgggctaaggaggcgaaatagactttcgcgagggagatgggaatcgggccgacggcccaagaggagagggggaaggcggccgggccggaggaaggaaggggaagggagggagttgggccgaggcggcccaaggacaaagaaagggagattttatttgttttctttttattttaattggttaaatgaactttgtgcttttaaaattatttcttgagctccgaaaattgacggaaaaatccggagagtatattagggcacaaagaatattacaaaatattctcggccaatgatttttaagggaaaatttaatttccttataatttcacttgattaaattgatttaacttttatttaatttctagaaaatgcattatttaatgatttttattcccgaacgaaaattggggcgttacatagtgtcaactcgcttcgcgggattcccattgcgtccagagtgccagcaaaaaggagattgcttgaactgccgccatcgatgagaacccttgcgaccttgatgttccgtacagtgggttcaaccacgatcagatatcttcctgggatagttgtagtcttcgggtggtccgcctccaagaactcgatcttgtgctgcgaccacttaatcttggcggtaattccttgtgatgtagagcaaacttcgcgttctatctttttgtactctctttttgaggagtacgacatagaaccgccgaagatgtgcgtgacgtggaggtcaaactctgagaacgcgaagtcggaattcggggtactcgcatcagcaggtgcctcgactactcgtactcgctttctcttctcgaccgccaattgtcttgcaagtgccttcttaaagacgttgcaatcctccatggtatgcgtgttagtcttgtgtatcgggcaccattgtcgccgtgaatcgtcgcgctgtcttcagctccctcgatcacgttcacatctcgcggtgaactcggagaagattcctggtctgccagaagtgtagaaccgagggttcgtgggggtcgacatcaacgaatcccacaaaccgatcgggtgttgtctctgtgtcccgttcctctgcaacacatcgaggttgagctcgtggttgtcggatctgaggtcgctgaggcttgaccgtaccgagaaagactttgcagcttgagagatcatgcttctttgatttatgtatcggacaccaggtgatatcggttggtgaagcatgttgaattccgcactctttgcatgccttgagttcagccgccacatgacgtaccaccgagcaatccgacagagagtgcttggatgtcttatgaatgtgacaccaagtgctcgatttctgcgtagctatccttgtcggcgcctgattctgatttcttgaattttgccgcgggaggaatcatcgttggggggtcgtttctcgaagtcacgactgctccgttctcgttcccgacagagattgggttcgatgagatcggtacgacagtatagatcggaaagacaattgatccgacttgagtccacatcagcgatgtcatggtcggaactcctggagcagtattgatgttgacattgttgtcgaaacgttttgaagtcatgtcggcagaaccttgagcaccaagtccccctacctggcacgccactgtcgacgggtgatacccgtagaccagctgaatagggtatttgggtacgttggtatgagaatctatacgatacgacatcaagcaaacaagaaaacaaggattatactggttcagaccccttatcaagaataaccctacgtccagtttatatgatattgatatggaaaaccacagattacaaatagaacaaccaaacttgatgaaaccagcgagatcgtagtcgatggtttcgactagatgccccggcgagaaggcttgacgtgctccggcttcgtaaactatggtgtatttgttggtgggaagattcgatgcctgtaacccctcggggggtactccttttataccgtatatcaccttgatctccaagtaagactcggagatatcagaccccgtacgatatagaaagagccaaaccctctccgagtaggactctgttgtcttcagactcgttgaggtattttccataatatctatagatttccttaacaaatacgggaacaatacccgtccatcatggtataccgtatccgtatattctatgagtcgtaggataggaggtatgccttatccgtaaccctgacagagatcacttggaataggactcggctgtgttcggtaggtcgaacgggatcgagtcggaagagctccccgactggttcgaatccaagtcggagagagaaagcttgccgaagtcatcggtgacgagctcaaggctaccaaagacgtatgtctgcccgggtgggaagacgaagtcatcgacgcttgatggagatcccattccactagtcggtgaagaaatcgacactgccctacctggcgcgccaactgtcgaaactagttttcggcaatatgaattgggggttgcgtatgagctcgaaaagtgcgattgggacagacacaaagctttagacaggttcaggccctctctcttgagaggtaataccctacgtcctgtttcggggattgtgtccgccgggtgtattgattgtggaaaaagtcttatgccccttgggggcgtcctgccctccttatatagtcggaggagctaggattacaatgaaaatacctcacctcatacggttcggtattgtattgcctatgttacaatagtataggactcggactcctaagttattaccttaatacataaggaatcacgtaacttgggcctttatccgtataatatctatacatgaactacccctacttgtaatcagacaatccatgccatgtaggtatgtggtatccataatctcctgtttccattttcagagggcctctgaaaatcaaatattttaggtgttttcttaagaaaaccactctttagaatcacccaaatttataggcggtgtttgacagcagtcttagccatcttcataggcggttaaaaatttaaaccgcctataaaatgaaaggactgcacaaattattttttaatgttttgcacggtattttcttcgtgtgattgtgcactaatttcatgctgccttagttggttattttggtttcgtcgagatgaacaaatatatctgaaactctgaattggtctgtccggacctagaaaagtgagatggtacaatcattgtttaacgatgcaaaacttatttcaaaaaataaaaagatccgatggtgccgatcgatccaaagctgattatctaaaagaaaaacagatccaaagtagatgtaagctttggaggtgtattaaagtagactaactaaagttttgtgagatgctttggaaaagatagtaaaggaagcagtggtcctaagcgaaaagttgataaaggtctatttatatattcctttaaatcttttcttttgagcttgccaggtgttcttttttttctgctacatcacatttgcatttaccaatgttaacacatcatacatcaatagtgagtaatgaagtgatgaaggggcctcacgaagattcatgcttttgtatttaattactatctgcttatttttccatatatgattgtacttctgtgttagtttgggatttgttaaatgtgtctatcagatacaataagttactctctctcaatcctaaaatatatatacctttagactttttaaattaaaagaatatggtgaaattaaatgattgtcatgattaaaagttttaggtggtgtctaatttagtaactaggtttatatattttgaaatagatagtccaatgacattcatcaaaaagctattccatacagacacacgacttcgttaaatatgacgcattgtgtcacatgtacttcatgtgggaagaaaatttggtaagacggaggtcctacgctaataggaaagacttcatttccaagcgtgacacgtgtgagcaccaatcctaaagcaatttcatcctcttcttcaacctcacgcctcacgacatgtgtgggcaccaatcttgcagtccttgtctgcccccatgttcctagcgagcttgcacagaggagcacgcacatgggagcttgcccttccttggtctgcgagcggctcacagcaggccattgggggagcagtggcgaacctccagcagtccagatgaagtaatttgtagcaagcttgagtagttgagtaaattgatgggcaattgagtctgaccgtagggtgaggagattgctgacctctcgcaggccaccgcttcgcctccaccagtgtggcgttgctgctacgctgaacaagaaggtgtgtgagctcgttgagacgctgaatgggagtgaggaatcgcctcccgctgatctcctgttctctatgagcgagagcttgccgccggactgaactggatgaaggaatcactgctgtgccatttcatatgtgccaacagaggagaactgagagattgctttgagattgtcacgttttgaaacaaagtctttatgataagcataagactttagtcctaccaaattttcttccattcatgtgggcttggtgggccaccgttgaaaacagacaagaatcaaaatcatgattggcgctaattaccgattctgcgtgattttaataaccctccatgcaacttttttttcctcaaatggttgttaccattttttgctaaataaattgaaatctatatgaaaatttgaaacttattcgaatcaaatttgatattttcaagcggacttaaattctgtaactttcaacttaatttttgaaactttcaagtcaaatatcaaaaccttcatctcaaatttcaaaaactgttaacatgaaattcgaaaatctcaactcaaatttaaaactttatactcaaaatttaaaactttcaactcaaaatttagaaaaacagtccccatattttgaaactttgaactctaatttaaaactttgaatgcaaaacttaaaactttaaatcttaaatttgaaactttcatcttatattttaaaactttcaagcattaagcgcgtgaatagcgctaaacatattaacctgcacctaacagatatgcatgcattaggaattaacccgtcatttatactactacatggtactccttccatattttaatacatgacgccgttgattttttaatcaacgtttgaccattcgtcttattcaatttttttttaaatataaaaatatttatatcatgcttaaagaacatttgatgataaattaagtcacaataaataaataataataatattttttaataaaatgaatagtcaaacgttagtaaaaaaattaacggtgtcaacattaaaatacggaggcagtactacgtttggatgtagcgagtatcaatgtaaggcaccgtccctgtgtcggtgcgtatagccctataaaatatagccacatccctagggcaaggctcaaatcgtagggtaacccacagcttagctagcaagcagcagcaagccaacatagtagctagcacgtacaaatgatcgccatgactcctcttggactactgctagtgcttctcgtcctctgtagctccattcttgttgcccatggaggagacgctgcagccggcgcctatatggtcatagcaaccagcaccatgaaaccgaaaactttctgctccggccacaagggtattattgaatttctaactttatatatatatatatatatatatatatatatatatatatatatatatatgggggaccagaataaaatatacacttttgtataaatatcatatgctcctaaaatattggtcaaagtaattctcatctctaatttttctctactattataaatattgaaaatgttttcgcagaattttggtacgtcatcagtgtttgataaggtatttgagatccaacgagaaatttagacagatgtttttattatgtgaattgtattttctcaaaggtaaattacaaattcatgtaaaattaatctcattatagctcctaaatagttgttgtatcattgaaaaacgtctttacccgttacaacgtacgggtattttttttaagtaaatatataaagccaacatattttttaatggaattaataaacgtagctttgctgtcaacgtcatttgatgtgtatgaacatgtatatactatacccaacgtactgagaggtcggagttatgtgacatacgggtatgtttggatggcatctacacattgccacacttcgatctttttccaaatcttgtcacaagaatgactgacaatttacaatttaacatatagccacacttgtggtaggtttggaaaaatgaagtgtttgatacgtacgccagataaaagtatgaaatggcaggtcatagttgtgacactgaatcaaacatactacattgatacttatctagaaaactatatatgacgtacctaacatttgacataataaataaataattaaaaattgtggcatccaaacaattgcgcatatatatatatatatatatatatatatatatatatatatatatatatatgcgcaaaatctccgcataaattatggtctttttttatcacttggatctccatacggttttattaattacaagggaacctctcatcaccggccgcatgcttgtaccacagttgctccaggggacgtgccgtcgccgaacagcacttgggcaccgttgcatcacctgtatgggccatgctcgccggcgccgtcgtcggccaacagcaccgccgccgacgtcgccgcttccatggccgacatggtcgacgacgaccaacgccgcgcggactacatccaaaagaggctcaccggcgccaccgacgacaagcagccgatggccttttcgagcagaacctcgcaatacgagaagaacggccagtacgccactaatggtggcttaggcagtgtgcctcacctcaaagtaagcaacgtctctccttaattagcttgcttgatctgtcaatatagtaggagtactaaattaagtgtgtatattatactaattgatttgttaataaataatgaagagtttatcaacgacggcgacgacgaattcggcgccggatggcacgtcggcggtgacccagacggtgataatcgactccggcagcgacgtttcatgggtgcaatgcaagccatgccccttgccgatgtgccaccggcaacgggaccccctgttcgacccggccatgtcgaccacgtacgccgccgtcccctgcacctccgccgcctgcgcgcagctcggcccctaccgccgcggctgctccgccaacgcgcagtgccagttcggcatcaactacggcgacgggtcgacggcgaccgggacgtacagcttcgacgacctcacgctgggcccctacgacgtcatcaggggcttccgcttcggctgtgcgcatgccgatagggggagtgcgttcgactacgacgtcgccgggtcactggcgctcggcggcggctcgcagtcgctggtgcagcagacggcgacgcggtacggcagggtcttctcctactgcctcccgccgacggcgagctccctcggcttcctcgttctcggcgtgccgccggaacgcgcccagctcatcccgagcttcgtctccacgccactgctgagcagcagcatggcgcccacgttctacagggtgctcctccgcgccatcatcgtggcggggcgcccactcgccgtgccaccggccgtgttttccgccagctcggtcatcgactcctccacgatcatctcgcgcctgccgccgacggcgtaccaggcgctgcgcgcggcgttcaggagcgccatgaccatgtaccgggcggcgccgccggtgtccatcctcgacacctgctacgacttcaccggcgtccgcagcatcaccctgcccagcatcgccctcgtcttcgacggcggcgccaccgtcaacctcgacgccgccgggatcctgttaggcagctgcctcgccttcgcgcccacagccagcgaccgcatgcccggcttcatcggcaacgtgcagcagaagacgctggaggtggtgtacgacgttcccgccaaggccatgcgattcaggaccgccgcctgctaagtgctaattcaaatttgcttgcttgccaaactagcgtattgttagcttattattcgaatataagctagctagttgatgaaataattagtcaaagtgattgttgtttatgttttgatgccatgtttatcctacatggcgtactagtagagcatctatctctatggaaagggattaaagtagctagcttaattgcagcattgtctgctaaagtttaggctagctactaaagctcttttatttatcttgtctgcaataatttgttatcttgatgtgatttcggtcgtgtgagattgtaatatcgagttatgcatctccatcttgcatgtcaagtgatgtactactttttccatatctagcattttatgcataatctgttgactatttgtgcgcacacaattaactagagatagattctaatctcccgggtggacgtccacctagggctgctccgccaacgcgcagtgccagttcggcatcaactacggcgatggctcgacggcgaccgggacgtacagcttcgatgacctcacgctgggtccctacgacgtcgatcgtcagggtcttcctcttcgggtgcgcgcacgccgaccggggaagcaccttcaacttcgacgtctccggcaccctggcgctcggcggcggtgcgcagtccttcgtttagcagacggcgacacagtacggcagggtgttctcgtactgcatcccgccgtcgccgagctccctcgggttcatcacgctcggcgtgccgccgcagcgcgccgcgctcgtcccgaccttcgtctccacgccattgctgagcagcagcagcatgccgccgacgttctacagggtgctcctccgcgccatcatcgtggcggggcgcccgctgcccgtgccacccaccgtcttctccaccagctctgtgatcgcctccaccaccgtcatctcgcggctgccgccgacggcgtaccaggcgctgcgcgcggcgttcaggagggcgatgaccatgtaccggacggcgccgccggtgtccatcctcgacacgtgctacgacttcaccggcgtccgcagcatcaccctgcccagcatcgccctggtattcgacggcggggccaccgtcaacctcgacgcggcggggatcctgctccaaggctgcctcgccttcgcgcccaccgccaccgaccgcatgccagggttcatcggcaacgttcagcagcgcacgctggaggtggtgtacgacgtccccggcaaggccattcgattccggagcgccgcctgctaatcgatcgatctagctgcttctaatttgcttgcctgccaaactagctatcttggtttattcgaatataattaagctacctagctagttgatgaaataattagtcaacttatcaatcgctgtttaatttgtttttcttctgatgccatgtttatcctacagtactactccagtagagagagcatctatctctatggaaagggattaaagtagctagctagcttgcagcattgtctgctaaagtttagggtagctagcaaagctcttttgttgtctgcaataattagttatcttgatgtgatttgtgctcgtacgtacgtgtgagattgtaatatcgagttatgtccatcttatcaagtcatgtactttactacttttcccatatctagcctttttacactcatttttaggttttaatgcatgatttcattaatttaattttatcatacattaaaccatttttgttatttaaaattttatgtaaaatatacaagtcatgtttatagtatctttaataatgaaataaatcacaacaaaatgaatgataataacataatttattaatggtaaattttcctacatagcacctaaaatttatgtaatttgtttacagacatcgtaaaaaatgtatcatggctaaacgatatttttaaaaaatggtaatttaccgaggatattttcgacataattagagagagaaattcttaaaaagacgagaataatcaaatatgtctccgaggatatatcctggactaaaaactgaagggagtatttttagtgtcggttacacggcctaggaccctgaattcagacagtgctttgcatttatatatgaccagctttggtgctctacaccctgcccctttaaaatgcgtccgaacaaagtgtacgtctatggaccaacatacatagttacaaaagaggatctcactccgtctctttctccgaaaagcgaaagaacgtgcacatggctcaatgataagccaattaactcgccttcatgcttatggctagttttggagagctgcacctgacactgtatctctatcgatctcaccatttttatgcctatgattgatcaagtttttttagataatggaatataatatcccggcctttactcaaaagagctacagccaattattatatagtagttttcatgaacatagtgtaaatctaaatgaatagaacgcaccgaagagaaaaacaaagaaaccagcctaacgtaaggagatcacaattattgaagtctatttgtaaatctccaaccataattggcaaatagttgcataaccgtggtctccaactttcagcacgcaactttcagaaactcttcatcttcatcacacctttgtagttgtgcccaaaaccggagccaatgagttgccctgaaaatgacctgcatataggaaaatgatggtgatttgtcaaaaaccatatcgttcctactcagccatattgcccaacaaatggcagaagctccaacaagtatcagtttactcattttcttatcaactcccaaaagccacacattaaaaatatgagatatactaactggaagattaaaaccaaaagagaatagaactgctctccataaaaacttcgcaaaatgacaatccataaagagatgttgaatagactctttcttcaaacaaaaagaacacctcaagctaccattccagttacgccttgccaaattatccttagttaacacaacccctttaagcaggtaccacatgaaaattttaatcttaagtggcaacttaagcttcgaaatacacttgtttctctcgatatagccattattaattaaagctaggtatatagacctcaccgagaacaagcaattctgatggaaattccatctaaaactatcagacgaatcattcaactgaatatgtactatagaggcacacaactcatgccaacaaacaagattctgaccaactaaagctctcctgaaagaaacattaagcggaacagatcccataacagtggcaatagaagatgttttcgtccgaacaattgcgtacaaagatggatatttatccttaaaagccaagttaccaatccatctatcttcccaaaatctaatttgttccccattattgacaatccaagaacccatatttaagaaagtacttttgacattcataagaccagactaaaaatgggaatcaccttgtttcctgtcaacttgggttatagatttattataaagatatttcctcttcaataaatcatgccaaaccccttcctcattaattatcttaaacaaccatttacttaaaagacatttattttgtatctccaaattatgaatcccaagacccccctggtccttgggttgacaaacaacatcccacctagtgagcctgtattttttcttatggtcatccccttgccaaaaaaaccgcgatctataataatcaattttatgaagaaccactttcggcacctcaaaaaaagatatcataaacatggctaaacttgaaagaacataattaatcaacaccagtctaccaccaacagataaatgcttgcctttccaactactaagctttttctcaattctctcttcaataagtttccaatctttattagaaagcttcctaaaatgcatcggaattccaaggtatttaaaaggaaaggtacctaacttacaaccaaaaatatcataatattgttcataacattcctttgtctgaccaaagcaaaataattcactcttgtgaaaatttatttttaggccagataacttttcaaataccgataaaatcagtttcaaattctttgcctgttgcaagtcatgttccaagaagataatagtatcatttgcgtattgcaagatagacaaaccatcatcaacaaaatgaggaataaccccattcaagagtcccgcctctttagccctcttaatcaatagagtaagcatgtcagctactatattaaaaagaataggagataaaggatccccttgcctaagacctttgtaagtttgaaaacaattaccaatttgatcgttaacttttataccaacatgaccaccttgaacaaaagaagctatccattcacaccatctaggagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccataatatttctcccaggaatgaacgctgtttgagaaggactaattaccttttgggcaacatccattattctatttgtagcaactttggtaaaaatcttaaagctaacattaagtaggcatataggtctatattgttgaatctttaaagccttagcacacttaggcaaaagaatgatagtaccaaagttaagcgaatataaaggcaaactcccagaatgaaagtccttaaatagttctaaaaggtcaaatttaatgacattccagaaaacatggtaaaactcagcaggaaatccatctggacccggagctttgttatgttccatctggaaaatagcatccttaacctcattttcagaaaattctttagttaaggcttcattctctaaatatgaaacttgaggaatgtcagcaacataattctcatcaaactgaaggtcagactcatcaggagggccaaaaagacctttataataagtggtaatatgcgactttaaattggcatcaccccttattaaatgatcaccctcctgtagttgataaattctagttttcctatgttttccatttgccactaaatgaaaatactttgtattagagtcaccctccaaaatatccttagtcttagcccgctgataccatttaatttcttcttcccttagaatgacagataacctactcctgaaaaaccatctaatatcaacttcctcttgagacaggagaacagtctctgcctttttatccagtgcctccaacttatctaaaatctgctttttctcttttttgtataaaccgctggtatgtttagcccatcccctaagatgctgtcttaggcggcgaattttcgcttgccaacgctccataggagtattgccctcatcaaccccagaccaaacttcttttaccatatcaacaaatccatcacgtaacagccaaccaagttcaaacttaaaactatgttgagcgttactaaaagaggaagattttgtatttaggagcaaaggagtatggtctgaaatatctctatcgagagcaacaacagaggataaagggtatttttgctcccattccgtggacactaaaactctatccagtttctcataggttgggtgtgccaaattatttgcccaagtaaaattcctaccagtcatttgtatctccctaaggcacaactcatcaataatagcattaaacaagaagggccatctatcatcataattatcattatttttttcattaggactacgaataatgttaaaatcaccaccaataagaattggtaaggtctcatgactgcacatgttaactaattatgcaaggaattggtccttaaactcattttgtgcaggtccatacaccaacactaaggcccacttaaaattatcagctttatttcgcaaatgaaacttaatgtaaaaatccccctcatcaatcaaaccaatgtcagaatttaataaattaatacccaacagaagaccactagatctgcctctaggaggtttacaatgccacaaaaaatctttaccagcacaaagattattaagagcagctgtagaaaattctttcttaacagtctcagataaagcaataaaatcaagttgatgttctttagttaaatcagaaacaaacttatgttttttcgggtccttgaacccatcacaattccaaaagattcctttcatttaaaactaattttattattcttcttcttctttttacccttcttaccattagaaatactattagaagaaggtaccatggaatccaaagtggactgaatattaccactattcccacttaaatccatcacctcctccataatttcaccacataaatgttgtagtagagtattatcatcgaactgatcgtctaactcaccttcaacaattacatcaggaatttggttaacagaggaactaatctattcactcaacctatttttctctacacactttaaatcttctataacattattgagaataacatttttatttgaagtaatcacacctagattattaagggaagcagaaatttgatcatttgtaaattgtaaaaaagaaacattaacatccatattacctttagcatggggtttctccaagttcttttccgccttcaacctttcagctctttcaaggacaagctgatcactgtcagaagctctcctctggcttttcctggatggagaaattaacgcctcgggaatagcagagattttttcaaccagattttcttgctcaaccaacacggtctcctcatccaacccgtcaaaatcttcgtcagacgcagtcaaaccttctgactacggtatcaaactcaactgagaagaggtaaaagaaggaccacccctctcagtaagattactatcagtagccatactcacatcagagacacccggtccagacttatttcccatgtccttctcattttccccatcgtcatttctcttcccatcaccatccccaaaattatccatatccaaaggaacaggatccccagcaccaatatctgactccactttaaaagacagctaatacaaatgatcaccaatggccacatcaacaacatcagggattagagatgggtcaaggaccaaaacttgtaaacgagctatctcataccttctagtaaataacatatcaataactttagtaatcccaagaatagaaccaactgcacaaataattaaatattccctcaactcagaaggaagccccttacactgaacccaaacttttggaatgacatatttcacctcattcccaacacctctttatatgatctccatctcagcctcaccaactttagtgtgcacctttccccattccaccatgcgattcagctcagcagcagaaggaaagatagtacgaaaagtgttatcaccattgtcatgtaccacccacctccatttaccaggaattaacctctccaattcagatacaacagccttaactgtcatctgaccattagatattttaaccaaggccgccctagggtcatgcctaatcctttgtccagctgggaggggaatatgaaaaaaactcaaaccatcacccccataaccacataactgagcagtcaagaatatgataataagttctttcttaattagtatcctacatttttatacgttaaattaaatataaacagtatgaaagaggatgaatcatgagtaagggatggttgtcatgttctctcgtgaatttactacttcctccgtcctaatatataaagcacaatcaccactaaaatgaatttagaaaggggcgagcaagttcgagcgtgacaatgtactttgtttgcggcgttcgaccagcacggcgatggcaaaatctccgtggcggacaggtacaatatttttaattatccaaatagttcagttgaaaagaatttaaagctaggtactgcaggtaccataggccaatagaaagtcacgggttgctatctctttattatttgcagtataattggtgtggtgttgtagttgtggttttcgctcaattttctctgattaactaggcactataaggtttagtcatgttttctttttaaaatggaataccttcttcttaatataaaacgtcagcaatggcctgaccgttcgaaaaaaaattatttgcagtatatatatttagatcacgtcgaaaccaagtagtgaactgtttacttttgtgtatggaattatcagcagacaacaggcaaggagtgaactgagcaaatttaatcttgtatgtacttcctccgtttcataatgtaaattattctagcattgtccatattcatatagatgttaataaatctaaacatatatgtctgcctagactcattaatatctatatgaatgtggacaatgttagaaagtcttacattatgaaatggagggagtatatgttatttaaaacacactctggcctcgcctgtatggtggtagctaggcaagtacttataaattaaattaaagcaaccactcactagtacatgttggatcatacatatttgtagtttggtatagagataaaccacttgatctctgtctaattgtagttgtactttcaaaggagtttctttttgttatttagcttaattatcgatttacaggaaatcaatgccatttaaagggtcaaatacttcaacctttcagccaactgttttaccataaggctctgtacatgtcataattaatccaaaaatcctatcggtcgagtgcccgacggattaggaaaatatcgggcgctcttccaactacccccacccatttccgtgactctctctcgtttctctcgctctctcttctatctctcgtttctctcgtcgcagtgctcgaaccgcttgagcatggcgagcagcatcgccttgaggagatgcgacagcaccctgtggccggcccccgtgcctcctccggcgacgccgccgaacgccgccacctccccaagccggcagccgccgccaattgctcctcctctgcgacggcgacgccgccgaatgccgccacctccccgagcaagcggccaccgtggcagaggccacagccaccctcgcagcgcgacgcccctgccaccgacgtcggcgacggtctgacgaagctccgcggcgtcgacgacggcggctatatggatgtggtggagctcagcatggcatggacgcagatgtggttgctaaccataagagtggtggaagaggtagatctaggttttcctcttgaatttgttatgtttcaatccatgtaccgtgatgttttatcagttaaatttgaaacgttgcagtgggtttttcgatggtgtttcatctttttttggatgtacttggatttgtttcatgtttcggtacattcggaaccgttgttttatacgttgtagaaaaatgtttcattgtgtgatttgattgtgtttcacaattttcagcactgaaatatttttaatttgatggtgtttcattcttttcctcgatgtattcggatttgtttcatgtttcaatatattcaaaaccgttgttttatacgttatagcaaaatattttataatgtgatttgattgtgtttcattctacccgatttgtatgcgcttcctaattaatctcaacaaggtgtgggcaaatagtttttggacatatgaatttaattaatttctggctttctggagtacattttatttctgataagctgaacttccacttgagattgcattgcgcatgcactgagccatctatccatgcttggacctgtactgattggaaaagttttttttttgtttgaacaagttgtaatcttataattagttctgatttctgaattaacttttatctcctcgcattactgccatagaaagaacatacagaagaaatagattgccctgatgctgtgctgcttgtttcagccatagaaacagaaatacgacattgtcttatttcttcccctgtttcctctcaaaaatgtttatattgtagaaaagtgaatttttatcattcttaagaaggtaccaacatataccattcaaatttaaccgttgatttgctagatacacaatgggccaagagtaaaaatagcgatgctcggtatctttctctgttccttgcggcagacgtgggaacgggatgagcggataggaggctacccaggtacctacaggtgcgttatggcaacgcaagaacgagtatagagtgattaattgacttttaattattacaaacttaaaaaatagattaatctgatattttagaacaactttcatatagagtttctttcctacatgtgagattagattgatcaaggtgtaggatgccttgcaaggggaactcacatgacggcacacaatttgagtttaatgctttgatctgaaaaggggaggaattgggaggagggtgaaaggaaataatgcctaattcaaagaacgaaactctcatgaaacgatattatttacattagaccaaaatttttgggtaattttaccatccttgagaaggtatctagatgtatcatattttctagtataaaatttggtacctctagataaccttaaggtaaggtattttctcaagtatcgtaaaattcctcaattttttaccttgtttttagttcatcaataccaagctgccaattcagcttgtagctggtagcatacaaccatttacgtttaattcagcaaaccccacaacacaaatcgtagcagcaagaagggccggcggaaaaaagaacaattcaaggtgtccgccacggaagagatcagccagagattgagggcggcggggatcagctcggtactgaaccagcagcgggaggagcggagcaggcggagggaagttgagctggtccggccactgctgcatctgccatgctcagctcgtcactgtggccatctcctcgtcgctcttgttgcctggccgcttgcaaactcgaggaggcctcccagccgccgccctcaaccagatctcggcgtggtgaggtgcgaagaggaagggaatgggctgcccaggcggcgccgctaactacgagcggagtagacttgtcaaaggagattcaacgcaaaaaatacaattttacccctcaattaactcatccatgcggagtacctggttgacgcgttggaggcggtacctctcaaccgtttgattctagtatctacggcttgtatttggtattttccttaccttaaggatggtaaaatttctcaacagaaaataccttaccttaaggaccttgttgatcatcttgagaggagattttgcaactctttacttggtgttgtattgctttaaaatataaatgcttaatttgctcatcaggtaaagttggtaatttactctatatattgtgtcccgccttctccgccgtcccctccgcggcctccttctctgctttccgcattgtccctgccatggccactacggtggcctttcctgccatggccaccgtcgcccctgccacggccactgtccctgccgcagccaccgataccatgggggccaccgtccccttcaggcaatggcggagctacgtataatctgtggggtcagctgacatcacaggtttttgcaaaatagctcaaaaactattgatatttgtgttgcaacaataaaaaacttaagaattttacagcttgaccccataggtttaagcagctggctccggggccaccctggccgctaataccatcggggccgccgtcaccagcatgtggtatgcgtacgccgtggaagtacacttctgcaccgacatacactacttcgccaccgtacccaccgacgccgcctggtctgagggcgtcaccgtgtggcggccgcggtggccgtggcggacgccgaggcacccaccaatacctctacatccgccggcgcctccacggtcgttgcggccaccacagccgctgcgaccagctctcctggttggcagggctcgccgggttggccgtccaccggaaactctcctccgaagttggcggccatggctgctacggttgatcgattggggcgagttgggtgaggaggtgagatattccgatgcatgggagggttgggggtatgtagcaggtatcgtatttatgggatctccttcttttttttttgaacaactcgcacgagacggtgcgaggtaatattgatagagcaggaaaaaattacaaaattacaaccctggagggtcgtaaccaggaaaaaggaaaaaaaaaaccaccacccacacatcgacatcgccaacacaccaacccaggagaaggctagcaccggaacggccgccgctaagcgtgaccgaccgccactagaccaacaaagggacacagacgagatcgcccccctaggggatgccaaaacgacgtcttcaagaagagaagcgacagaaaaccgccgccgccatccgtcgaagcttaaaggagccaagactgggttttcgcccggcaaccacccttgaggggtaagacagcacgacaacgccctcagaatcgttgtcggtccggccgaggccagactaggttttcacccgccgctcaccacttgtgaaaccacggctgatacaccgatgctccaccaccacacaagctctgccgacatgtggaacccctgcaccggcgtcccccgccggccagccttcgtgcgccgaagaccgcgccactcccactggcagctcctcctcacacctaggtcgcctcctccaccgccggccgcgccactcacgccaaaccggcctcctccaccggatgcgcctctcgcgccattccagcctccctccatcggccgcgcctctcgcgccaagccggcctccatttccgccgcccgcgcctctcgcgccgagccggcctccactgccatcggctgcgcctctctgcgccaagccggtctccgacccctccaccaaacgacaccacgccggccaaaagcagccgtctgccacgccctcggctagccatccgagtccgccatgcctccggtgaccgcagacacggtcaccgccaccgcagccgttgctgccgaacgcccagccacctcgctagcaacccgcatccgccgacgtcgccaccgtccacagccacggccgccgtcgccactgccatcgatgccagcctccgcctccgcaaaccgttgcgccgtcgtcctccgccaccaagcagccaactcgacgccaccgttgccagccgacgacgctgccaactgccacgagcaccacggcgggcacgattgtcgccgccgtcaccagcagccgtctggccggtcagcctccgctgcgtgccggccgggctgctcctccgagccgcgttgccgccgccgccgcgagctgttccgccgagtcgcgcccccgctgccgtgagctcgaggtcgcgccgccgtcgccgcaagcacgaggtcgcccgccgtcttgccgcgccgccgtcgtcgagagctcgaggccgcccgccgtcgccgcgagctcgggccgcccgccgacttgccgcatcgccgtcgccgcgagctcgaggccgcccgccgtcttgccgggccgccgccgcccctctacagatctggccggcggggggccagatcctccatcggggaggccggatccgcgtccggcgcgaccggattcggccccgcggccgctccggccgccgccttccgccgtgcgtgcgtcgcgccgcctcccacgccgaggggttgctccgccgccggcacgttttccccgccgccgccttcccggccggccgcacggtttccggcggcgggctccggcggcggcgaggtggctggaggcgttgggagggggcggcgcgggcggctagggtttcgctcccgagccgctcgcgtgagagcggcgcgagagcttggggaaaaaaatttaggaactccgtggcggctggtgaccgacacagtgctgccaacctgatctccttcttttggtaatcagtccaatctttccttaccttagtgtagtgataatgatatgatatgtttccaaatggaggggatcaccagctcagtcttcatttcctttccgaattaaggctgatgctccatctccgcgcacctctgcaattcgaaacacgtggaaaatacgccttcgaaattggcttacgcacttctagccgatctctaaagaatatgctctcatttttaactttcaagtttcaattctgtactggaaatcatgtatatatcttgcgcatgttaattttaaaagtaagagcaattttaaagtccttaggaggtaccacgaagtatcaaaaatttagtgtaaaatttagtacgttatagtaattaaatactaagagataccaaaattacaatagaaaaagtggcccctcatggtattttctcaaggagtataaaattactctaaaagtaaactgtgcaaaaatcttctttcagaaccagaatgaacatgctgacacgcataaggttcaggctgaagcatagcccgccataattcccgaagtaaaaaaggatcatgtttctttgtcactttatatgcgtgtcaccatgttcattttgttttgttttttttttaaaacgtaagagtcttgcttgtcaatatattagtataaaaaaaagacttctacacaaccgcgacccgttgacgtggtcatggggttacaggggggagacaaaaaaaacattggactgactaggagaaaaccgggcccggaatgttcattctagttgaggaagaagatttttgcaaaacccgtattacagtatggttacggaaaagatcacagaggtagagtttgagaaaagaaaacctacacgctaccgggctcatccacgtcgttgaacaactttgttgcggcatttccaaatgttccagagaatacaaagcagcattgagtgtagtacgacttgagcgtatcctgaaggtcttttttatacgattatacggtaggcatacacccactaaaaaatactcacaaatctgcaaatacgtccctaaaacacgctcaaagagaggtccgtggcatacattttggaagcacgtgtactgaggcctgggcttaaaggcatctacaaggcccagtgccagccagagcacagctgcagcagaatccttcaaaaatccagcccaatccagcccaggaatttgttcacctgggcctgatcaccatacaaaaatcgaataaagcaaactgaatctctctgctgagccagcttgccagatcacctacctaccaattcgaacaaaagcatcccattatttgatcgatcgatcgatcgatcgatcaattagctcgatatccattagcaagctgttgttgcatcgatccatggttgtatccattgattaatttgattagctgcaagggcaagaacatcatatctgctagctagcttgtcgtcgcaatcaacgatggactacttcaacgggacggacgcgcactgcggcggcgccgtgggcgccatgggctcctacgtctacaacctcacctcctcctacgccgaccagaagaacgaggtcaacatcgtcgccacctccctcgccatgctcctcctcgccgcgctcctcctcgccttcgacctcctcgccggcgccgccacgctgcgccccgccgcgcgcctcgtcctctccgtctccctcgccctcttcctccccgtcacctcctacctcttctccgaggccaagaacgacgtccccggcgccgccgccgccgacgccgagctgcccctgcgtgcgcgcctcattcttgcgtggatgctgctcgtcgagctgctccgcaagaaggtggaggccacggtcgccggcactaagggcgccagtggcggcggccccaccagccgtgccggccgtgtcgccttcctcggctacctcgtcttcttcaacgtccacggcgccggccggaaggcggtgttcggcgtgctctgggtgttcgccgctgccaagctggtgcagcgcgtcgccatcggtgagttcgtcaagcgctccttcgccttcggcaagaacccgcagctcctcgccggctacatggcgcagacgctggagcagcaggagcggcgcccgcggcgagacgacgagctcatgacgagctgcaagtacgccgtcatgggagaggagaacctggagagggaggccggcccgaacggctacctcgtcgacctgaacaagacagtcgccggcgatgacaacgccgacgacgccgtcgtcgtcaccgtgggcagggtgtggtcgctcgccgagagtgaccagctgctggtgtccaacccgaagctgaagcggctctgcctctcgtacgctctcttcaagctgcttcgccgcgagttcgaggagacgccgttgaccgccgcggaggccgccgactgccgtgagctcatcttccgaggcctgtgcaacgacggcggcgccgccgccgacagggcggcgacgctgttccaggtgttcgacgacgagctcgggttcgtgaccgagtactaccactccgtcctccccgtgatgctggcgagccccttcttcctcctcgtcaactacatcgtcttccccgtcctcgtgctcggcctctgcctcatgaccgtcgtgctctgcggcaacggcgacatcgccttcatcgccggcagcatcaagagggacaactacgccgtgtcgttcggcttgctgaggatgacgaggtgcctcctgagcagagtattccggtcgccgtcggcgctcttctcctccattgacctctccatcacgttcctcctcttcctcaccatcctctacgaggaggcgtgggagctcgccgtcttcctcctctccaactggctcaccgtctccatggtctgcgactacgccgtcaagccgccgagccggctccgccgctccgccatccgcggcgtccagtgggtgacgaacaggatgagccgccgcaattacctccgtgtcaagcagtactccgtgctctggttctgcaggctcccgctgaagctgccggcggcggccgtgccggaggaggcgaagcaatccatcgtggagtacctcgcggcgtacgacggcgccgtcgccccgctcagcgccggcaggtcggcggtggcggcgaggaacaccctgtgcaacgcgtcccggctgatctcgtcggcgtgcgagagcggcagcgtcgccgaggttatactcacatggcacatcgccaccagcctcctggaggtgaggtgcccgccgcacgcggaggaggaggcggcggcggcggcgaggtcgagcacggtggcgacgcggctgtcccgctactgcgcctacctggtggcgttccgccgggagatgctccccgacgacgtcgactgcacggcgcgggtgtacggcaccatgaccacggagctcaagcgggagctgggtctcaagggctactacttctcgacggacgccacccggtacgggaagatgatggctatcgccggcggtcaagaagacgacgaggcggcggcggaggagacgacggtggtgcgcaagggggcgaggctggggaaggcgctgatggacgaggcggccggcggcgacgaggcggcggtgtggaagctggtggccgacgtgtggacggagatcgtcgtgtacgtggcgccggcgagggacgccgagcaggtgagggcgcacggcgaggcgctggcgcgcggcggcgagttcgtcaccgtgctctgggcgctcgtcacgcacaccggcattgcccgccccgccgccgcgtcggtgtgatcgcggcatcgatcggatggtgattgaggatactgatggttggagtggtacagtaaagattggtttgcatgcatggattggctaatttttggattgattgattgttaatcacttcattatgattaatttgcatcccaatggattggtgtaacatcatatatctgtgtgttgatgcatgtgatatatacatacatacatgatgtgtgttactgtgttttttttcatgtaaagatcatgttgtgtatgttccgaaaagccatcaaaatgtttgaaaaaaaaacaagataagccaatatttgatatatgctcaacaaacatataaatttaaatttaacttatacacattattcacagttttttgtacttgtattgtaggttgaatttgaatttgcatgtttgtgtaatgaaatatatctatcattctatttttaaaaaaaaaacaaatagtgactatttaataacctagaaaaatgagaggatactctaagggatgaaatgagttttcccatgttatatgttgatgatacgtacatataaatgcgtgtgttttaatggaattgatttacatttgtacccatggaatggagttactagtcacactacaattcgtacaaatgtagacattacacatcatcgatcaacccatgcattacaccaaacatgttattgatgttatacatattaaaatttcaatcatatttgcaaaatatgaggtagcgtcacaaacggttcagaccagacctcgcaatacaccaatcacacaacccaaaatcaaaccatatgcacacgcatttacaacacaaacacatgaaatcagccatggcaatcaatgggcgtagacgaagcggcggcggcggcgctcttgttgtcggcgacgacgaagtagacgtcgctgcaggacaccctgacgttgtacggcctggtgtacacgacgccggcgaccttgaaccgcacctgagccgccaccgctacgttgaacggcccggttctcctcccttcgccggcgacgatctcctgcacaaacctgtcgtccagcgtccgcgccgtcacctccacggccgtcgcgttgcgcggcggctgcaggagcagcgccgcctcgtcggcggcggcgaggccgacgaggaggaggctggtgttggtctcgatgtagtcggtggtgccgtaccagagcatgacgtccagcgcctcgtactccacggcggcgcgcccgctcgggttgccggccaccagggtcaggttgaggaacgccgccttgttctcgtcggtggcgccgctcctcgcgtcggcgacggagaaggcgagcggcggcgggcggaggacgaaggaggcggcgatgacgagggcggtggcggcgatggcgccgacgagggcgccgaggagacaccgcctcggatgaccacggatcttggtcatggcgcccatcttgacacagctagttcttgctagctagctacctaatgtgcaagcgacgttgcatgcaactagaattaaaaggcgccattgaaccagcagctgatcacagcctccatcagttcagttgcatggattcgatcgaataaagttaggcaattgcattatttctgaattctgatcggcagcaggaacgctaatatgcatgtcagtaggaattatattcgaataaacttattattagctgttcgtataactaaaattttctagtaggacaatgcatgagacagcttaatgagcaatttttgtatctcagctgcgacatgtgagcagaataggttctctttttttttcgccgggtcggagcagaataggttcttgcagctgcagaaactagtgattagcagattgcattagctagtgagggtgaatgtcaattcgatcagcagtgacgatccacacaggcatatataatccatgcattatatccatccgtgtgatgagcagaataagttcttccccctacggacggatcggagatcaaacatttaataagatgcttgaatgaattacgtaccatacaggccttgttcggttaatcccaatgaaaaaaagattggagaggatttattctacatctattatggtggagaattatttcccttcaattctcttcaatcccctccaaaccaaataacgtctcaatggtgaatagtgtaatggcatcaacatcgcacatgatacatataaagggaaaacacaattcatcctaggggatatcccctatttttgcatgttacttaaaatgtcataaaaaatttgaaaaaaaattagtaggatatatcaatatgtgatatatcacttcacaaacatgcaaattcaaattcaacttatacaagtagaaacaaaaataacaaatttgacaatgaatagaacgcgtaattcacagtcaaatttgttatttttttgaattgtataagttgaattttaactcgcatatttgcgaaaagatatattatatattgatctattttaacatttttttaaaaaaaattttgataacattttgaacgccatatatagaatgagaggatatctcatcgagggataaaaatccacttcccatataaagttgaaatgactgatcaatgacaattactaccaaaggaaagagccccaacgtttgtcggagaaatataaacgagattcacattctatcagctgctcggcgcattataaggtgtcaaagcacgaactggcgaaggaacttttgtactaccctgaaggcctgaaccaatggaaatttggttctcatctttgactactcctttcttttcccgtgcctaaatatgaatttttaattcaaatgccatttaggtattcaaaccatccctctcaaataaatcatgaaaattccgaagtgtcactattcatctaggccgttaatttatccccttctttctccccaagaagcccaacccctccttcccctatgctcctttcctttcgtctaccgagtcataactccttatcctttgattgctctccatcttgagttgccttcctgattcatcccgcgggcgctttgcccagtaggccatatttgacgcaaccgagccacctttatgggagtggattttgatcactcgaggggatgtcccctcattattgcttaccacttaaatagttatgaaattttttaaaaaaattaagaatatgtattaatatgtgatatatcactccacaaacatgcaatttcaaattcaacttcacatctcgtaacgaaaaaacaaatttgactgtaaatatgcgttaactagctgttgtttactttgtttttttcgttacgagatatagatgttgaatttgaacttgcatatttatagagtgatatatgatctcatgttaatacatcttctcaattttttcataattatttaagtgacatgtaaataatcgaggcgacatcctctctagagatgaaaatagtctcccacctttctgcaaccagtctatatatctgcctcgtcatgaagtcataatgtctctcaccgtcatcttgcgccaacaactttgaagaatttccccttccacctcagtgaaaacttagccacacctcggtaacgtaagtatggtacatattcagcgttacaaacattttccgaccaatggacagaataaaaatgcatggaattattaattcatgaagatcggtagtatagcagactctataaccacacatactcatgcacttacagtagtagagacattttcacaacaaatgaataaaagaaagaaagaaagagaaggggaaaataacattaaagaagagaaagctgcaggccaaacaaacacacattcacgcatccaaaagcaatcaatcgatcaagcaagcaagcaaatttacacacattagctagtgacgatggatatcgatttcgtgctgcttatcgatccggtccggtgcggatttttgttgggacgacgacgtgctggcgtcgtcttgggaaattttgagagcgatttcgcggaggcggcggtgtcgggtaatgccggtgtgagtcatgagagcccaaagcacggtgatgaactcgcctccctgccatagcacattcttgtgcgccatgatagtacgctcctcgttggacggagccacgtacacgatgatctccgtccacacctccgccagaagcgtccacatcgaatcatgatcattcgtgtatttttctagcaacttgttggccaactctgcgcccttgtccacggttccctccttgttgttattcttgctgttgatgttgttgatgatggcgtcggctcgctcacggccgcacgagaagtagtagtggtaacatccgagcctgtctttgagctccattttcatggccttgaacagatcctccgccttctcatggtagtccggaaggagctccggttggaacgccaccaggtacgcgcagtatctggacagcgtcgtcgcgacggtgaaattgtcactactagtgttcttcttcttcttgttcggacagccgcagcagctcatccgcttgctgtcggactcggtgatcatcacctccggatcaggcggaggattgaggcgttccaggagaccggtggcgatgtggcatatgaggatcacctccgcgatgctgccgttctcgcacgccgtcttgagctcgtcgaagctcgctagagcagacttggtggaggcggaggcggaggcggaggcgagggagctgaggaggatggagtgcttgactgggacggggacggggacgggcttggtggagacgagcaaggtgatgagagggatgggcatggcgagggtgagcggcggccaacggaggtcgagcgcggagaattggttgatcatatcttggggatggagatggaagcccagccatgtccggacggagaggatgcagcgggcgaaagcacggaaggcggagttgtcgcagaagcgggtcttggcgacgtaggcggagagcagcgagaccgcgaaccagttggagaggaggaagacgaacaactcccacacctcctcgtagatgtagatgatgtagaggaggaaggtgacggcgaagttgatggtggcgaagaaggcggcggccgagtgatgcgcggtcaggaggaggcacatggtggtgtcgaatatgcccgaggagatggtgaagttgtccgtcttgatgctccggaacgcgtacagcacgtcgccgccgccgcagaggatgatggtcatgacgcagacgcacaggacgacgacggggaggaggaagtagttggcgacgaagaagaatggggaggccaggacgacggggacgacggagtggtagtactcgctcaggaagttgatctcgctgttcatcacctcgaacaccgccaccgcgtcgccgctcttgtagaggccgttgaagatgacgtcgcggcactcgctggtctccgcgctgctcatctccggctccggcaccggcagctgctccagccttcgtcgcagcagtttggatagcgcgaaagagaggcacagcctcttgagctccgccttctcgtcgccaccattatttcccgttccaggtagcccttgctccacccagattttgccgacggtgacgagggacgacttgctgtcctccttcaacttgtagccgtcggcggtggcttcaacacgcgcatcttcctctcccgtcacgatgtacctgcaaccctttagcatggcgtcgccttgggccggcagcgacggcgaggtggacatcatgtaggaggtgataatccaagggttcttgccgcaggcgtaggagcgtttgccgacctcggtgaaggcgatccgttgcaccaccttggtggcgcagagaacccagaggacgccgaacacggccttccggccggcgctgcggatgttgacgaagacgaggctgccgagccagacgacacggccggcacggtggatggtgcccgagtagcctttcatggcgatctcgtccaccttcttgcggatgagctcgacgaggagcatccaggtgaggatgacccctgccatgaacgggaggtccgtcgacgatgcgcggccgatgccgatgacggtggtgacctggtcgagctccttggccgtgttcttggcctcggataagaggtaggacatgacgaggaggaagagggagagcagggaggtgaagaggaggcgcacacgcgggctgagtatggcgcccacgttggagaggccgccgaagaggttgaggatgaagaagaatccggcgaggacgaacatgagcacggaggcggtcaccatgctgccctcgctgctcgcgtcggcataggtgaagttgccggcgacgctgcttgttccgattgaggatgagttgcagtaataattgctcatctcgatccctcccttccgtttattacttcattcaattcaattcattccagctactagcttgccttatataggagtattatactagtagtgcatctcgactacttcctccgttccatggctcctaatctaaaaattcttcagcttaatttgacctgcttttcaagtttatgaaaaataaatgtaacgagaataaatatattctcaatacggtggattttaataaaactagcttgttttcataaatgtttatgcactttttctataaacttctttaaaaagtcagaaatttcacgcagaagaaaaactaaaacacattagttatagatttttatttaatcacattagaaacacatacactcttacacatctgtgcacaatcacccatatgagagcacacatgtgcttcctatccctacgattgcatccgttttatattataatgttttgattttttttctagttaaacttttttttaagtttgaccaagtttataaaaaaaacatatagcaatatttcaacacaaaacaaatatactatcaaaatatattaaatattagttttaatgaaactagtttgttgttgtacatgttgcaaaattttcctataaacatggtcaaactagaaaaaagttaaaacgacttataatataaaatgaatggttatcttatgaacgcacacatgcacactctacttttatgatcacctccgaagactagtaccttaagaacgcacacatgcacgctctactttacaaacacttccagagactagtccggcgtattttgaaattgacgaagtcactacggacgacacaatatcaacaggtatgtcagctaccactcgaaaaataactagccgtaaatacgagtattacgtaaaatctgaaacttgaacctggatgagcatattataccacaaggtaccttactagctaagctacgcccagtttgctcttagttataaattgtgatataataaaacaaataaatgcactatgaatacaaaatttatggtggattttaatttgatattacacatgcatgtacatttttttataaactttatcacgacagtccaagtttccatcttctacttcatcctttttatgagcacgattcctaaattgctaaatgatgtatttttgaaaaaaaaatctattagaaaatttctgtgaaaaatcatatcatttttttatgttttttatagctactccatccattccgaaatataagtcacaaccacccttaactcaaagaccaagaaataattgttatcacctcatagtttggattaccctaataaataaaatgcatgcacccagtaaaattagagatgttgatggtggaggatttaaatagtaacattttagtggaaaagatgtgctagttaatgacatgcatgcatacacgtcttatattatgaaataagtttaaaaagtagttgtgccttatattatgaaatggatggagtaatacttaattaatcatgcgctaataaaacaccctattttccatgcctgacaaattaaaaaggatccaaaaccaacgtatattggctgcgttctaaggtcaaggttcccaacttctctcccttattttccgcgcgcacgtttttcaaacggttaaacggtgcatttttacaaaaagtttctatacgaaagttgtttaaaaaattcatattgatccatttttttaaaaaaattagctaatagttaattaatcacgcgctaatggactgcgccgttttccgtgtgggagggtagggttcccaacaagtgggaacgaacatagcgtgtggttgtggttgtgaacttgtgataattatttgaaggtagaaatgactacttaactgttataatgttaaaagtcgttggggtacatattctaagaaattaaaatttatatatataatagttttgtttttttaaaatcgtttagtagattggaaagcatacgcgcattcttctattaagttaaaaagaatataactatgcatgcgctgcaaattaaagaaaggttgcttcattcttttttatacaatctaggtgcgtatacaacggcccctgcatgtgaaactcgttcactttaataatgatgaacagaagtagtaaagcaaaaaagagacgcacatatataacgtcgcgcacgttcacccagctaataaggaggacatgaataggattccgacgaccaatctttggaaaataaaagaaaaaaaaaggaaaaggaaataaaataaaaggaaaaagagattaaggaataaattccgaccaatctttggaaaagaaaagaaaaaaaaaagaaaaggaaataaaataaaagaaaaaagagattaaggaataaataccaaagattgaaaccaaaaaagctggtagctttcacgtgttgaagatactgtatgagctagcaaaacaacgatgatatgatgtccgtcggcaactcggaaacctggctagttaagctctttaaatatatattctcctctccaagaaacgtgagctacccactactttaacaattgcattctttatatttttattctaactccattccatcctatctttatctaatagtaccggacttgctatacaattaactcttagattcctaactcacatacgtaattatattatgtatataacagatattaaaagaatgatgatatttaatatacaactctttttcttctgtaacgtatttttttattatactagcaaacaagcccgtgcattgcaacgggtgaaaaaaacataatgataatatacggctttcatgcataaccatatcgatgacaatcagaaaatcagaaaattggaacatcttaatggcccaacctcaatgatgacaaccttaccgatgtttgctttacctaaaataattggattattcatatgacaacatgcatataatctaaaatattcttttaatctcattcttgcaaccaatcaaatcctacaccgcctcgcatgttcaagtctatacaaaatagagtcactatgcactcttctctaaataacaatagaaatattttttctcgcatgatttttatacggactacggaaacctttttttccagcgcgttttcttttgcgctttttttgatattttttcctcgcgcgtttttttaaaccgtttttattttcccgtgcattttttctttttaatatacgatggaaatttctcattttaaataggtagattagattagattagagatagagaagagatatgtacggactactaaaacaacaaatagaaattagactttttttgccgcgcttttttctgccctttttattttttttttctcgtgcgttttttttatgaacggtttttttcgccactttcttatagagtcagatctttctagattttttttggttttttttatttttttacggattttgtttttgtttttcgctctataggaatcggacttttttttcattgtgggaatcggatctacgtttctttttttgtttttttcaaggaaacggacttttttttattctgttttaggtgggaatcggattttttttctgaatctacgtttctttttttttgccaggtatcggactttttttttctgttttttcccgttttaggtgggaatcgattctattttttgctagggaatcggattttttaggttgttttttcgctttttttttattttaacggacgatgaaaacatgttaaattttttaagtagtagagatgtaagatttacacatgcagcgcacaccacactaaacattcaagagtgcgcctactaacatacgctaaaaaacaaaaaccaaagactactggtacatagggttgaaagtgattcggataattttcgtccgaacggaccaattttcggattcagataatttcggtcgaaaatatctggaaatttttgaattcggaaacgaattcggattatttttttcagaaatgaaaacgaatactgtagaggtgatatccgttggaatcggaattcggtcggaaactatccactattttccttcggatatccaagctatacctcagaccttatagctatccagcccagccagcccaacccaaggaggcaaggaggcagcgcagcccaagtacatgatgtaaccctagctgcttgctctgctaagttgatattctggtttgggtattcctccgtattcaatttcggttggatggctatgtgtcacgcccgagctagccccgagcggaaccagcccgtgacgctccaaattaacctgttaatcgataccagtcccaggaaacagtgctggtatcacaggaagacagaatatcacagccacagaggtctctttattatagagtaggattacagtcatgttgggctgtggacagaccccgagctcacaactgcactacaaaagaggaaagcggaagccaggacttggaccaatcatcacaggcgcgacttgggaactagatcgaaaccctaaaactcatcgaagccgacttgctcctggaagaactcctcatccgcgggatccacttcatcttcttcggcaactgggggggattatttatatagagcaagggtgagtacaggagtactcagcaagtcatgggaattaagtgtttaatgcaggcttcaagggagaggctgttgtttttgcaattgattttagttaaactcctttctgaaacaactaggtgagtgcttctcaaacaacacggatgagacagtgtgtctcgtccggtcggagtatgtgcaatgtatcagtctttgattttctcaaggttggcacccggccaacagctttcaaacggccacccaggcctggctgatcccaccagcggcagagttccaaacaacgaacccattccacaacagcaatttcacaaagcagtagtcaaacaaaactacgctaaggaatcaccttacatccgcccataaccgcgggcacggctgttcgaatagtttaataacctttgcagagggggcacactttacccacacgacattactaacccggatcacccagcccgtgcagaacagccacgtctggtgaccttgaggctttcatgacaaggcatttcgagagccgacacaggtttaccatatgccgacgagaggggtcccagaccaacaacaggttaggtcccagaccatcctgtgccagaaagcccaggggtcctccccgacaccaccccagcaaatccacatgtctctcgacatcaaggctcccctgattagctaattactcagccaggggtgtcccattccacccatggtcgtacttgttatatgttcggatgaaattccaaaggaaacggtccttaagtgcaagagcgggaaaccgtgctcctggcatgtccctcggtctgcgattttggaaattcatttagttcgcaagcaccgacccaggcgtcgggttttccaagtcttttgtaaaacccaagttttacccatcgttggatattttaaatttgaggggaggcctccgatgtgcatgcccgaaggcccgtacatcgaagtaccacatttgacaaaggagttttaagtattcgatcattaaggagggtgattgcaacaattaggattggggggggcaggctaccttgcaagccgtagccgaattactcgtgttaatcctaatcatgcaatatttgcggaaaagaaatacttagatttaaattataggtgcaagatgatcaaaggtgacttgccttgctcgagatcttgagcttgatcatcgaaatcctcgcactgcgggtcttcgggctccgaagctatacgcgaacgagacgactcaacaaacggtgaaaataaggccctattattgacctctaagtgtgccattagatagaactcgggatttgagaaattttggaagttgaacggagtcaaacggatgtacggttgggaagatatggaatttctaagattgaaggatttattgaaataaaggaaaaggatttattaaaatactttttgaattagaaactaaagagggaggggatttagacttcgcgggcggcttgagcgcggcccgagaggggttggcgtggctcggccatgctattgggccggccggccttgagaggcggcccaagggggctcgcggggagggtgaggggagagagaggttctagatggacgcggtccatcgtgcggggtccggggcgggcccacgagtcagggactcggtgcacgagggagggggttcacgtggcgcggtgctaaggtttcaggagggggaggtgtggcgcacgcagggttcgcggaggacggaggtgcggcgggcccacgcgcagcctcttggctctccgtgggttgcgcgcacgagcggggcaacggagggaggcggctaaccgaggtcagcccgactcggtccgaggccgagctggcaccaatgtggcgccttcgtggctgccacgtgggccggctggaggaggacgaagggaggctggccggaacggacggcggacgacggcggcgctcactggagctcgttgggacatcttcggccaaagggagacgcaccggtgtgatgataagaacgagagggatcaagccttcagctcggatgcaccggaaatggctcgacggcgaggaatcgcggcagcgcacgccggcgacggcaaaagaggggaaaggcgacgggaccacgagggaccgattcctcagagcaagagcatctacacgacctcgggattgcattcctagcaccggattgggcggagctacaccgagagaagctggcgacgagcggcggcttgcggcggcgagcggcaacggtggtgatgccacgccgggcggtgggaagggcttgggcggcgcccgcgagcttctaggggtactacgagtgctaccacgtaatctaaggggaggaggaggagcgaagagggagaacggaggagagctctaccgagacaggacagggcgctgtgacgagaggccgacggcacgttagtgatctctccggcctcgggccagggaagaggatgaagacgagcgccctgagtccccttccgcgtccacggacgcgctggctcctccggcacgcgtggcaacgaaaggcggcggcgaacagacacgggcgaggcggcaatggcgagagacgaaaaggagagagattggtttggggaggggcttgggtttatagggtggcaatgtcggttcggaaaccgaccttgggtggtcaaagagcgagctggcgctccgacgctcgcggccaaaatggcggcagagggcatgacgccggcgagggagaaaaagaaggaaagaaggagggaaaggaggcttgcctcttgccactttgggaaaagaaagaggaagagaggccggcccggcagagggagaaggagctctgcctccatctcttgaaagcatgcgcgcggtagtggcagggccgggtcgtgacgacgacgatgacggcggggcggtttggagtggagcggcgacaagggcggcagacgcgggctcaggcgcggcaggcgctgacggcggcggcgaccggccggtcggccaccacggcgcgcgcgcgcgggaagcaacggccggtgtggtgatttgagcggcgtcggcgggaagcgacagcgagagcagagagggagggagaagagagagggagagggagagagagagagagcgctcagcgctcgagtggcgcacgtgcctcgcacgtgcgggcaaggatggaggaagggggagagatgggctgagagggaatgggccgggggagaggagatcggcccacgaactcgagggaggcaaaatagactttttcgagaagatttgatttgggagggatttgagattagggtttggatttgacgatggatcggggaattgagatctggaatggcacggacactagacaacatacaaagaaacaattttcgcatttaggatttttaagagatagttttcccactagacgccacgacggaacgggcgctacactatgacgaattatcataagaaactcgcagtcaagggtagtgtctcgaaacaccaggagggcattgtaaaggggtattggttgcatagttttaatactagaaagtatagactaatgatgttggtatactagaagtataggaatggattcttttcttattctttctccacttagtttagtgttagtattagtgagagtattttagttcttctgcttcgtgtcactctacccctgaattaactaacccttgtttagactctgatttataaaagtaacatataaattattagcatggttttctcttataaatcttccatcgggattaaacaaatacgataccttggaatagtctgcatagttgttacaatggtatatccgtacgcttgtggatataatctgtaaccataatatactacggatatttctacgctattgctgggaattatattcatagtaatgtcgttaagaaatacccacgctctccttcactctcacattggatagagatacaacggatatttctgcgctattgctgagatctatattccttattttaatttctaatttctattatttctaaattgtatttctatatgaactctaaacttatgtttcaatatttttttaattacgaatttcagttattgttaaattgcatttctatatgcactctatattcttcttctaatattccttattttttttaatttcgaattttcgttatttctaaattgaatttctatatcgactttaacctctacttttaattttcttattttttttaattctgaattttcattagttctattgtataccggtatggactcttgtctagcttctcttcctatatttttttatttttaatttcgaatttcagctattttaaaattatatttactctttttttttctttttctatgctatgagatctaacgtggaggcttattttttattcctttaataagttaatgtatagattaaagccgtcgttccatctcctccgaccgcaagcatttgtggatacccatccgctggactccttgctcctggccaattaaacgaacatgctgtactgttcatccgtccatcgtgctcaccgcgcgtgtccgcggttacaacccggctttgggtgcggcggcaaccaacacgccaagtttaattatctagctaataattgaatcagctgtaggtatgtagacttaggggtgggcattcggttagactgagaaattcggttcggttttttggtctttttaaaaattcggtcttcagaatctcaagatcgattggtctccaacaaaactcaagactgagaaaatcggtcttcggttagtttggttcagtctcgcggtcatagaccgaactaaccgtgacaaaagtttaacagcaaaaaaaatggtacaagatcgatgaatcaagcaattaggtcatacataacacactacaaattgatgtcaccagcaaatcgagcactatttggataaaaaagaagcaaatcgaacacgatttataaaagaaatcgg

SEQ ID NO: 58515 - DNA, 33791 bp, Oryza sativa
tccaggcggaggcccccgcggccggagcgggtcatggacaactggaagcgcttggtccgcgccgccctcaagcaccagcaccgcgccccctccgccaccgcttcttccgccgcgggatcggcctcgcctccgccgtgcccccctcgctcggcaagaccaccaacatcgagcacatcctgcaggctgccgacgacatcgaggatgacgaccccaacgtcgcccggatccgtaacttactttacccctcctcactcatccacctttgcttcctcttcctcttcctcttcccacccccctaatttcgggggtttagggtttccgctgctctactttttaccacttgttgttgttgatgatgatcatttcatctccttgcactccagtttgtgagcaagcctacaccatggcacagaatctcgatcccgacagcgatggccggggtgttcttcagttcaagacgggtttagcttctgtcatcaaggtatatatgcttcttcccacccgtgccactaactctctctgtcaatgccatttctgtctaacttgctcccatcgcattctacagcaaaagcttgctaagaaggatggcgcgcccatagaccgccagaatgacatccaagtcctctggaacttctatctacaatacaagagtcgccgtcgggttgatgatatgcagcgtgagcaggagaggctccgcgaatcgggaacttttagtacagagtatgccatctctccaatcgcaccacaactagttttgaccagttgatgcgccctttttttttgtttcctaacaactaacttctgcagtgcccgttgtttctgccagccatttcttaacaaccttgttcgatgaaatcgatgttgcatcattatattgctctcgtgtttacactctattgcagtattgtgctaaccatagaaagacaacttatgcacattctaataattctcatgactattttatttttaccagcatgggatctagggctgtcgagatgaaaaagatctatgctactttgagggctttgcttgatgttctggaaattctcattggacaatcaccatccgatagacttggtaggcaaattctagacgaggtaattgtgcagtcattacagaacccctactcctgttaaacccttttgttgctgctgctcgccaacacctctgaggatttttttttcatatactcactcaactagtgtttttccccctctcattttcgttttacagattaggagaataaaaagatctgatgcagccctgagaggtgaacttatgccatataatattgtaccccttgatgcaccatcatcagtggcaaatactattggttttttcccggaggtacatgttgcaatgcttgttgtccacacagcacagaccgttatcatcttgcattactttgccaaacagaaaaatatttatggtgttgtctattgtttcatgcaaatctattaggtcagggctgcaatagctgcaattcaaaactgtgaggacctgccacgatttccttctgatgcacttcaactacagctaagacacaaagatgtttttgaccttctgcaattcgtatttggcttccaggttaggaaaaatctcataccatatatttcatggcaacatttgctatgtaaccatccctttttggttacatacgtgcaattgctttttcttgttgcactgactcaatatgacaaatctaaaattagggatgtagttattgatgcattttacttatgcatgaaatttgaagtctaaattcattctacgcaaacagcaacaaaaacgagaaaattgtatgacaatgaaaaggagaaaaagacgcatgccactatttggacctacttgtaatttttccttatacattttcaaattaaaagtttaatatgcagggtgcaaagacatcctgtagactgcattgtcattttttggaagctgttatgttctttttggtgccaaaacaatagttaatttcaagggtgcacaaaaaaatctgtatgcttagcatacgggcaattcttctttagttgaccacattatgttggtttctatgagaataatttgaattgattatgcgttgagttgacatgtgacagttacaactgttactttttctgaaatcgtgcaataattttcctttaatctttgctggtgtgacatgttggagtatttagcaaattccatactaggaggcatcctctctgcagatccagtcataaatagaacctttggaaatcttgtactagcttagcagttaaaaattgattggcatgacctgtgtcctttccatgctgcatctgccagcaaatccttgttctgcagtatgcacatactacagaatatttattgttcactacgccttattctctgtaacgatcaacttcacttgattacatgctgctatagtgctatggcaatttttgattggtttcttaagccagtataccatctagcagcttatgtgaatcctgatcataatccgcttctacttttgaagattaaaatgttatggcatcttctagatgttttgtgaatttgcaattgcatcaacattcttgatttatgttggagcttgtgagcaaggtttgcatgtcgagtatcctattctaggcaggattgttttgtgttgactgttgacaggatatgaattacaggatcaaacctgaaacatcattattttaaaggatggccagatctggactactatttagtacacttctccctaatttagatcctgtacaacatcatgattggaatgattgcccaagattgtaggatcattacggttctactattcagaaagatagaaaccttgtgaagaactaaagattataaaacagaaataagtttggtgcaaatatgtgctttgtcataatttgtttggtgatcttatgttatttaaattatttactcgtcgatctattgtgtgagaaattgtttctttctgttttcctgcttctgtgtactggtctaatttatatcactggttactgcctttctatcgagtttctaattagattaaattgtttttccaggaagataatgttcgcaatcagcgtgagaatgttgtgcttgccttagccaatgcccaatcccggctcggcttgcttgatgtgacagagccggttagttcttcccctattctcatggagtatcatttggacttgtagtacaataagatctttcttcctactgacatgatacttcctctgctactaaatatatatagttctgcatgtaaaaaaagggagcacatgcaacaataatggtggttaccatttaatactgtctcagctttaaaaatgtcaccagccttttgcttgatcttcactttagctctactggtctaaataaatttcattggttgctgtttcccttcatagaatcaatgaaagttcaaacttgtttgtagaatagaaatataagtcagtatggctaatctattataattgcctcggtgcagcggccagatgttttatgaaagcaatgttgaaaccttaagtaatgaataaggtatagttactagtaattaacagtgcataggctgattactcttgttcctttcttttttggcctttaaattccatgtacttgcgatttttgtctataaattcttgtgatacatattattatacaatgaacattggcaatggccatggctcttgtagaaaattgatgagagggctgtgacagaagtatttttgaaagtgctggacaactacatgaaatggtgtaggtacttgggcaagcgtgttgcatggaccaggtaatttaacctctcatggttaattttctctgtgcctgttattatttcaatggatgctttctaattaatttccttttctattagccttgaagcagtcaacaagaacagaaaaatcatattggttgctctgtattttcttatttggggtgaagctgcaaatgtccgttttcttccagaatgcctatgctacattttccacaatgtgagttcctttctctcctactaatttctgccctttttcttttcatgtaattgcagatgatgacacgtagaaattatttcaacataggatccagtgttatatatatatggtctggtctgtttctgctgatgaccaaaattattaaatacagcaaacatttagatgactagttatctcagctttcgccttgtcaagttgctttttttagggttcaatcttatagtactgtgagaacacatgttggatgttgcacatttactttttctatgtcgcaaaatgataatgagcaatattgtttgtggagatcattattgactgtacttttctacttttctgttgagcgcttttccttcaggaaacttccatgtttcttgataatgggatattgcactactacattcagggaagcttgctttatgctaaaaaaggatagtcaaataagttttgtcgataattcctcatttaggcaaatattagatcatgaatttcttttaggttaaagtccatttgtaaccttaaactgtgctcaaagtccatttctcatcttgcataacaccctaaaccatattttatcgtggttctaattgatatgatagtggtttttcgctagcatgaacttcagttaagtattatgattttcgacctaattaagtaccatttgcatcaacaaaatatgcagctaggaaaaccacctccatttcaaacaaaaccactaaaaaatatgtcccaaggtgtttcttgtcccattaagagttgaaggtgaaaaatatccagttttctagtgaaggtgaaaaatggccattggccaaagtttaaaggctataaatggactttacccttagtttttattctttggatgaacaaaacaccatgtcctaaagtaaccaactgtatatttatgccaaacttgagcttgactgttgatattagacgattcagtatatctttgatgcttggacatgggtatctcgtcacagcattgcacatttacaaggattcagaagtcacaaacatggtgacatgggtatatattttaataacatgataaaattaattagagcagatcttgtttagaacgttagcacaattccaccgtgaaaccttaagcttgggcctttgctcttcaatcagcgtacttacatctagcttccatctcctaaggataagatgggtgcagtgcgaagcaactaagttacccagatcgagatcgaggatgacgggtacagagctgagattgataggaaatcatcaacaggcagaaaggaaggggccgggcactgcctgatcaagggcgaagaactcgttggtgggaacatgggagaggatggagagtggatgaaatgccgaatctgtgttctctcttgaatatcctggcacttgcgcagtatggcgctctctcagagatatatttgtgtgaacacggtgtccaacactgatacagcaatcggatggcattttggtgttacgtagcagtatatatacttattaggagagtagttcttttggttttagtggcaatttcctgttgtacaatacgctgagcttactgatgctgcttgcaaattgtcagatggcaaaggaacttgatgggattcttgattcatctgaagctgaacgtgcaaagagctgtactattactaatgattctgcttcgtatctggagaaaataattactccgatatatcaaactatggaagcggtacgttcagttattgaaggtctatctcaatttacttttgggtttagatgatgcttctgctaaatctaaatcagtaccaattaagttgaatcttctgaaatcttctcatgtcttattgtctacggccactactaggtggcatttcgttgtaactgcgcactcagtagttttgtccaattcatttgtaattggttgattattgtgaggcatgtgatgatttaatccttttttaaaggataaattgagctagttacattgcagcaaccgttttctgtatgtttgatatttttcttctgtattaaagttatatccattatataccttctacaggaggcacagaataataataatgggaaagctgcacattctgcatggcgaaattatgatgacttcaatgaatatttctggttttttccctttaaactgctgcttttatgctgtttcctattatatctcttgcttctctgtatttaatctcttgcatatatttaggtcacgctcctgctttaatcttggttggccacctgctgaaggttctaaatttttgcgcaagcctgctaagaggaaacgagtaagtagtcatccatagtattttagggctagcaatgtggctgtgtgagttgcaaacctatggaaaaatcagcctatgtgtgctttttgtatcatttgagattctcctttctatcagttagccaacagtactttcgcaccactgggattagtttccttagagatagattgtgtaacattattttttttccgtaatattagataatagatcagaatcctatgtattaatttggaaggttgtcggtttaattagtaagttagagatagggatgaaaacggatcggaaacggacggaaactagctttatcatattcgttttcatatttttttcggaattggaatcggaatcgaaaactcggatacggaaatgaaatcgaatattatcgaatacagatacggagcgaatatgagacggaacgaatacggtagcgaatatttaccggtatataaaaaacccctcaaattgagtttcttgatcaaggaagagatatcgcttattattttagttcaaaatctccaacatttatatcgtcaattttatagacggtcccacaaccatatgtgaaaattgattttcatggctgttcctctaagagatccatatgcaaatatgatttatcattttctattcccaagaccttttactagatgtataacttacttaccattgtataaattggagattttatttattttacttcacatcttcgaaacttgtaatgtttgtattatactttaaatgctttcaaatacaaatgttataagctacaaagtggtagatcccgttgagctcttcaactttgatatggaacacatctccatcagatgtcgttgaattgtagggcctgtttggcacagctccagctccagctccacccctcctgaagctggagctcagccaaacagtttcagctccaccaaaactgggagtggagttgggtggagctctctcacaaaatgtactagagttgtggagctgagtttaggcagctccacaactccactccagactcaactcctggagttatatttaggagttggagctgtaccaaacaggcccgtagatatgagattttgtaaaaattaatatggtatattataatgaatatttagacccataaatgacctcaaataataaaatagtcaataataaagttgtagatctcatcgagctctacaatgttgatataaagtttgtcttcatctgattccgtatgaaaaagttatgtatatatacgtgttttttatataatttgctcaatgtctgcggatatccgaaaaaaattccggatagtttccgactgttttccgattccgacggatagtacccttactgtattcgttttcgtttccgagaaaaaatatccgaattcgtttccgaatccgagaatttccggataattccgaccgaaactatccgaatccgaaaaatgactatctgaaccagtttcatccctagttagagatatgccattgttaggaaagtagagactgtcttaagggccaaggcatggtttctattcacataagttgtaccacaggtactgtagaacaggagtcgttgctacaaaatgggcacttacgtaccctactgcaatcatgtaatgaatatgtagagtgagaacaataagcctcagtattaaaaaggagttgtatgtatctattgactgaaaaggagagtattaaaagaatatgtattctgttaagtaaacatgcagtgttcaatcttcatcctaacctatccttatgcctattacttaaaagatgcacttggtgattgtgatggtaacatggtgtgctctacactcccactgtccactaacagtggatccaaagtgggttgtgcgcggtgtaaaagagggcaagatgtaggtagtgcaaggccgtagaggcataacagaggtcaaagcggagctcgttcagtcaccatagaagaacatatggtgtggcatgtgttgggatttgtgacaagggcttgctgtgctatggaagtaggatttttaacccatagcaaacttacgggcattaaacttagttatgtaaaatattgggtcttaccgatgactaaggctggggcaatgactagaaggaaatggacacatttattttactgaaaatttgtacatatcttgtttgcattatggttatttatgtgcacttaactttgcttttaattttatatttacagactggaaagacaaactttgttgagcatcgcacttttctgcacttgtaccgtagttttcatcgcctttggatttttctaatattaatgttccaggtcagtggtttgatatcgtacttgtacacatgtatagcttaaatccaagtatcatttctgaatacagtttatgatgctaaaagtgctcttttctgatgcagtgcctaactattatagcttttcatcatgggaagatagacattggtaccattaaaatattagttagtgctggaccagcatttttcatactgaacttcattgagtgtacgctctctatttctttgttcatggtttcacttttgctagttacaatttttggcggatatactttgtttcatcacgaagcttttcatgcatctcattttttgccactgggttcatctgacatgtagccttaacagtcaaaatgttaaaccaagatgaatgtacagcttagtgacataaagagaatcccttttctaattgttatgtggactagaatcaaaggatacttcctaagctgactttggtggttttgttcttctctaggctgcttggatgtgctgctcatgtttggagcatataagacagctagaggttttgccctatcaagattagtcatccggttcatttggttgactgcagtctcaacatttgtaacctatctttatttgtgagtattcagtattttgttcatgtttttttaatgtacagcaagtcacctcacttgaatgctgaatgtcaaacaggaaagtcttggatgagaaaaatgcaagaagctctgattcaatttatttccggatttacgttcttgttcttggtggttatgctgctgttcggcttgtgtttgcattgatggccaagataccagcgtgtcacaggctctccaatttttctgatgggtcacagtttttccaattctttaagtggatataccaagtatgcacattgtcatcctgcgcagtagtttgcaacatatctacattgtgaaatcgtgtacttatattgtttctcctgtttgcatttaggagcgatattatattggacgaggactttatgagagtataggcgaatataccaggttcttttcttttactctagatgattcttggaaatgtacaaggcattcttagtttttctggtgatctctccagattaggaaaaaaaattctaatacccagtcgttatgtggaaatcgcaaaaaagaaaaagcttgaatattttttctgatttgttaaccatatacatgattcgttaccaacctgttagtttgaataattcaccagcggttctcttatagctatttttttggtcatggtatgctatttacttgtgacattctgatgcagatacgttgtgttttggttggttatactggcatgcaaatttacttttgcatattttctccaggtggttataactgtgtatttcagaattttaatgtttattatttttttgtgttatcaaaatttactcttgtttattgtgttatctcatttctgcagattcgacctctagtcgatcctacgaatgtgattgtgacactccgtaatctgcattattcctggcatgatcttgtatcaagtggttagtacattttgcacatatcactaaaagcattgcccattttctgctacagctttactaagaagaaaactattttcttcttttttcctctaagtacgagataagcaaattccttcctgacagtgtttcattttagggaataaaaatgctttgaccatcctgagtctatgggcaccagtcttagctgtaagtttcttgtgttgacatgtaattttctatgaaataataagatgaactttgaaaatgatacatggttcatttcatttctatgttagatatacctgatggacattcacatttggtacactcttttatctgctctcgttggtggtgttatgggtgctagagatcgccttggagaggtacattttgttctgatgttctagaactatcccgaagtacttaataactgtatgctcactctttgtagtttgcaaactgtaatcatcgttacatttgctaatttaacgcagatccgttcaatagaaatgcttcataaacgttttgagagctttcctgaagcttttgcaaaaaccctttccccactgaggtactcgctcccactaatccagaattgctattctgtctgctcatgataggagctgattaatagatcttatagtttcttttagatctgtcgtttggttaatttgattttgatcttccgatccttggtttttattctgtttttgtgtaacactgcaggatatctaacggaccagttgctcaggtaaataaacttacattttgcttctaatactaacttcaatagattggttctgacatgcaattatttaaacttcaccaaacatgtcattctaatttagtttgttccgtgacttctgtctggagctactaggtttattcttaacttgttaagcaccagatttgttgtattcttacattattctcgccgctacctctctaaacttatgatagcctgaacatattagtatgacctccgttttctatccacttcaaagatctggcttttttttgagtgagtacatttggacacacaccgcaatcacactatcacacacgcacacacctgcgcgcttcaaatattatgggaggcaccgaatggcccctagagtgtgcatccactgaatttgcatgcatgtacactcctaaaattggtggacaacctccaaatctaggatttgaaccgtagagggttggatgcacaattgcgccacttagccatctgaccacaatctagctccccaaaatcaggctagctgatatactagtcttgtttttgacgttctatcaagtgtaatatctgtatgtaccattgctttggttgtctcaacattagggtccagaaattactaagatgcatgcctcgatattctccccgttttggaatgatattattaagagcttacgtgaagaggactatatcagcaacaggtacatgtaatcacagccatttgttattttgttatatcccatttgcttcagtatcatgacaaagttctctttcagggaaatggatttgcttatgatgccaagtaactgtggcaatctaagacttgtacagtggccattgtttcttctgactagcaaggtatcctaattgaaattagctagatagatcccttttttgcatatatattcttttattggttgctatgaatctgttggttttttcttttgtagattatgttggcgaatgactatgcttcagattgtaaagactcacagtatgagttatgggacagaatatcaagagatgaatacatggcctacgccgtcaaggaatgctatttcagtgcagagagaattcttcactctttagttgatggtgaagggcagcgttggtatgctttcctactgaaagatgaaatatctgatactgacaccaatattgtgttgtatttcccccaagttttctttacttaatgccaatgcatactattgatacatgtacagggttgaaaggctttttcgggatctgaatgaaagtatagcacaaggttcacttttagtgaccataaatctcaagaagctgcaattagtccagtcgaggcttactggtttgacaggacttctggtaaagactattgcactttattttggagtaaaatgcaaatagagagatatcgtgccttggttcttgtttaattatttcctattttttctgtttggtaaatttaccatgaagaaatcttatgtggtaaattgaatatcttttagatacgcgatgaaactgctgatcgtgcagctggtgttacaaaagctctccgtgagctttatgaggttgttacccatgagtttctggcaccgaacctgaggtatgtggtgagaactcgctgtttaatttgcaaaagacatagctccgttttattttcttctgaaaatatgctctttcttgttacagggaacaattcgatacatggcaactactgttaagagctagaaatgaggggcgtctgttctctaggattttctggccaaaggatctggaaatggtacttctcttatgcaaataactgaaatttgcttggcctttctatatccttggttgagtgactatgtttgcctgcagaaagaacaagttaagcggttacacctacttttgactgttaaagactctgctgccaacattcccaaaaatttggaagctcagagaaggttgcaattttttacgaactctctattcatggatatgccggcagcaaagcctgtctcggagatgatacccttcaggtactgtaaatatgtatggacttcattctatttcaaaaataggaacctattgacacctaattatcttgtgcaacagtgtgtttaccccatactacagtgagacagtgctttatagcatgtctgagctatgtgttgagaacgaagatggcatttctatacttttctatcttcaaaaaatctatcctggtattgttatgattccgctgctttattacaatatcttattgtctctgaaggttctttacttttggacatactttgctccttctttacatatttatatttagtgctcacctatataaataagtggatagcgctgggacttgttaatactataattgcttatagattatggttagtagttatccgttgattgtaacgggttaaagaatcattattgcaataaataaatgaaaataaaataaaaccttgaatccctttagaaccataacagaccacagctaatgtcttcacataacaattttcaactccaaacaacatataataattagcattttcaaaatcaatatttatctaaagatgcttgttttcattataatgtggtgagttgttatgggtttgtggcatggcgttttatttggtttgcagatgagtggaacaacttcttagaacgaatcggtcggggagaatcatccgaagatgatttcaaggaaagtccaagtgacatgttagaactgcggttttgggtatcatatcgtggacaaactttggcaaggacaggtcagtttgttgtttcatttcttttgtctgcaatataaatgataaagttgcaatggagttcatatccaaccaatatagtatgtttaatgctacacctgtatatcaactttattctcatatcaaatttcatgtcttgtcctaccatttgattgctatattccttcatattttgctgaaacagtgcgtggcatgatgtactaccgaagggccttgatgttgcagagttacctggagaagagatatcttgggggtgcgtatttggtattctgttggtactagattaattcaatacgtttctcggctatcttcatcattttgattgttctaccaggcattgaagatggatattctgcagctgaatatattgacactcaaggttatgaggtgtctccagatgcacgggcccaagcagatcttaaatttacttatgttgtttcttgccaaatatatggacagcagaagcaaaggaaagcaccagaggctgcagatattgcgctcttaatgcaaaggtagcttggtaaatttgtgtggtgtgtatggtgtgctaggtgttcttggttccgtgttcattatgcgaagttccctgattagtgtcttatcttaattgttgctgttacatgctgtaaactgtaccattgaataaatgctgatttttgttcttataacttgtagaaatgaagctcttcgggttgcttttatacacgaggaggatgtgtcaagcgatggccgtaaagagtactactccaagctagttaaggctgatgttcatggaaaagatcaagttagtatattctcattaattttcttactgatatttaccctatatggtgcatgtttctgaaccctgctacacaatatgctatagtagatactacctccgttcacaaatgtaagggatttaggttcttttggagagattaaagtcagggggaaagactaagggatagttggggagtcagagggtaggtggagccgtggaggtaagggtgggtgaaaattaaatgaagggtggttggaatcccttatatttgtggacaaacttgaacccccaaatcccttatattttgtggatggagggagtagacaatagtttattggattgaactgtcaactatttagcgttattacttgttggccttactggctgtcaaaagaattagtgagtgataggtaatcaagtgctcacaggttcctgatgtcctgtagtcctctttccttgtttgcaatcccagaaactactgtgattctcaactatttgacattgtttcctctagatcaaattttcttaggtttataaagtatttgcaacaatgtcttctcaattttcatatgtcgagtaagaggattagaaggaaacatgatcttggtcaccatttcatagtctcttgctactgcattatgtgttcttgctaccaaaaaccagctccaatgctgtctgcattcagcacttaactcttctagtatcttcaaatgttattgctcgacattgctgtgtatcaatcttgtcttctgcatatattgctatatagctatttctcctctgcccttttccaagccttgctaagtacttcatcccaaaataacttcatttttagcctccaccgtttgtcccaaaataagttcacttttactctctaacctacccactatcagcaaatcgatgagttttattccttcaataccccttgcctacccacccactaatactacttttctgctaatgaggggcacttttgtagttttttttctcttaccttgtttttcacacctagagccaaagatgaagttatttttgggacagagggagtagacataaataaaaaacttatgcacaatctgtagaaaagtagtgttaggtaatttttaattgtatcctctaataaattaacagtttatgaaaatataactcatgtattccgttggtgttaatcatggtagtctggttactaattcatgttactgtgctgagagatatcctatatgattttgaatgaaatatacttttgaataaggtcttgagattagaccgttcaactatatgacatgcttcttattttattctgttccctgttgtggtgcactttaattatccataatccgaactctagaaggaattttcttgtcaatctatgatgtattttactggtgtattttgcatcagttatgttttacttaaccatactgttgcacctgtaggaaatatactccattaaactgcctggtaatcccaagctcggcgagggaaaacctgaaaatcagaaccatgctattatattcactcgaggagatgcaatacagacaattgacatgaatcaggttttcttcttatcattatcattaacagtagccttgtccactccccttttccttaatgaaattaggtcgaccaaatcttttggccgacccggcaaaaaaacagtagcattatcctttttgttgatatattcctcatgaaatgtcgagcttgtctagattcttatgtgtaattctatgagatagattctaaaaatatgctcatgtagtacgctgcttgccatttggattattcacaattcatgctgttattaaccatgattctgacggtgataggtcctcttcatgcttggtaaattggtgtaaacaactaaacatgaagatgagttcttgtttttttctttgtgatggaagtattaacaaaatcactggagaaaggtatccattgtgtacaaaccaggggccacggggaatttacactcaatacctcattgagtgaggtagaggacatctttaggtgctaacatgtgacatgcagattagattcaaaagagatgtgaggatcattgacccaggctcatatggagaaataacatggggtcatattctgacccatctaccttatcttgtccattggtccatgcaatacattagtttatacttgctctacgtagatgaaatatacttggcactcccctctttttcgaaaaggtgtctgtgcaccagaaaccatcttggatccttggctgataaaatttctcctgtaggataactacttagaggaagcaatgaaaatgaggaatttacttgaagagtttcgtggtaagcatggaatccgccctccaacaattcttggtgttagggaacatgtgttcacgggaaggtatccttactatgactactctcagttattcactagcttttggttttgcttttatttttgtattaacctattatattttattcctgctgcagtgtttcttcgcttgcatcatttatgtctaaccaggaaacaagttttgttactttggggcaacgtgttcttgcttacctcaagtgagtcaaatttagctagttgcagggaataatatctcattcttaccacattctcttttttcccccgcaacaaacctgtgacaatggttttaaccaaggaacttaattgtgttttattgttcttattacagggttcgaatgcattatggacatcctgatgtttttgatcgcatatttcatataaccagaggtggcataagcaaagcatccggggtgattaatataagtgaagatatatatgctggttggtattttgtatgctccggttaagaagttacctgaatgtggttattgctgcattgttcattgaaaacatctcatggcctcatgactgtctaggctgcttgtttaacttggaaaaggaatctcccatggtctccgtgaaaataaaaaccataactgaaaaaaaaaaactattgggttccttgatggatctatttttgttgcccccctctcgtaggttaagtctacattcacgagacaacccatcaatcctgcaaaaagttgaggtgccattattttgataagactgttctgataaaccatgcctgttgttctttcacagtatataaaccatatatggcttattgagaactaaacattagttacgtcacttgtgcatgcttagtagtgtatctctttcaaacttgacttgtatgtgttatctaatctgcaggattcaattcgactctgcgccagggaaatatcacacaccatgaatatatccaggttatctgtttaatttttttgcactgcaaatgtgtataacatgaataatgtgcactcattatgatttgtgtatgagattggtcctgaggattttaaatatgcatggttttggaatatggcatgtgcacttgcatttttttttgttagcatgtctggtacagagaattaagcggcttggacgcgtattacacatacatcaatatggtcttcccttttcttgggcatgcaaattagcaaatgcacttgaacagatgaactaaactttcttacacttttgatttatttttttttggaagtgcaggttaacacatttgcttaatgggtgcatatgtcatcttgtgtacacttgcattttaaaatcagtatatctttgttatcatttcccaaaataataatctaacaatctatttcacttcttttaaggttgggaaaggacgagatgttggtttgaaccaaatagcacttttcgaagggaaagtagccggtggtaacggtgaacaagttttaagcagagatgtgtaccgtctggggcagctgtttgacttctttaggatgcttactttctttttcaccacagttggttattatgtctgcacaatggtaacccctcgccccaatcgcacatgattacgcttgaagcaacttacatggtctatgtgatgaaccagctcggcttgaacacttgagtacatgtgtgcactgcatccagacaattatttgattgatataattgctgttagatgggatgagagcgacaaattgcagttagctaatcatatatcatggtttggtttaattgcattgcactatcctaaactatcacctgtttgcttgagatcaaacacagggatcaagatacgagaactaggtctaaatcatataccatgaatgggtttacaccaagttaggccctttccagggatgggccgggaatttatttcaaatttctggccaactaaattcctggaccatccagggaggagccaggatttggtagtttggcctttgccaaacaaggtcttaaggtttgaggatgcaacatctagttgaaggcttaatacacctgtttgctgcttctcttttttaatcaatgggggtggagctttctactcttccaaactctcatcgagtgatacgcctcatattttagtataaaccctcatcatattttagtataaaccctcatcatgcatacgcctgttaaatcataatagcagtatatgttaggggcataactttatatttagcaattagcaaaagatagtttcactaacttgatggaatatagtgctatgtgaatatgataaattctgatcgaaaatactagttctcatccgaggacctgtgtgtatgatttcttgattgttgctggataaatagcttctataactgcaagattttcaatctgtcacctgatacctaatgtctcaatgtccttataagcattgttttgaggaatggaatattgcatgtccattagttatattgttgcctagaggattttggacacgtttacatcatagacatttttgtagttttgtcagcaattcttttattttgtttactatcaccagttatttactataactatattatttatgtgtgcatgcagatgaccgttctaactgtgtatatctttttgtatggaagggtttatctggtaagtatttaaattataatgtgttatgcttctgaatgcaagtaaattttgctgaatgttgcttgtgttgtatattatatatttcttttaccattcttactagctattgcaaatttgtaaattcaggcactctctgggctcgactatgaaatatctcgtcaatttaggtttctgggaaacactgcactcgacgctgctttgaacgctcaatttttggtccagattggtatttttactgcagtaccgatgataatgggtttcattttggaactggggctactgaaggtgggctttgtttccttttagagaacgatacatgcttttcacagggttgctgtaaatcatgttaggattcttttttgagatgataatcatgttacaatttcaattgttttgcaggctattttcagttttattacaatgcaactgcagttctgctcagtgtttttcacattctctcttggaactagaacacattattttgggagaacaatacttcatggtggtgcaaaggtataatttgtttgctagtgtacgtatattatattaccttttagattttttctgacgcatggccctttatgcagtatcatgctactggtagaggttttgttgttcgtcacataaaatttgccgaaaattatcggctctattctcgaagccactttgtgaaagcgtaagtttctacttccaagttttcaagtgaatacttaaaagaaattcaacttatatgagtagttgtcatttatagatatcttcgcctgatgaaatggagcatgcatttcattttgttcatattggtcttttagtatgttgtattacagtgacccatgcctacctatgttatcagacatgagctattttgtgagagtgattgaatgaaatgtttccttatgcatcttacaatatgaatcaaaatctggctctatcccatgtgtcgatattggtggagggaagtgctagatacctttactttagaaggctcacaagccctcttgcaaacacgcatttctgttttcttttgtctggatactgtagggatctgactcaacgaatgaaatctgcaattttaattatggtgtgcctgattggtttcttgactacttgatgattaatctgatatatattaatatttgcaggcttgaagttgctctcctcctcattatctacattgcatatggttatacaaggggcggttcatcttcctttattctattaactatcagtagttggttcctcgtcgtgtcctggctcttcgcaccatacattttcaacccttctggtttcgagtggcaaaagtatgttcagaatattcctatcttttagttaatttctctttagttgcctaacattcaggtaatatcaccagtgattgggtaaaatcaagggattgttcaatttgtttttgtgaagaaacataacactatgtttgatgaaataccttttctaggagtatatagggtagaaacttacgcttggggtagttttagagatgttcttggggctggataaattaatttccacaattctcactcttcattggcttccatttccaaacgtcaggactgttgaggactttgatgactggacaaattggttactttataaaggtggagttggtgtaaagggggaaaacagctgggaatcttggtgggatgaggagcaagtcagtaactatgactgtttggagtgttaaccgtatacttgatttaaccatatcttttgactatttcacttatgcactgttttattgcatgcatacaggcccacatccagacattaagaggacgtatcctagagactatcctaagcctcagatttcttattttccaatatggcattgtttataagctcaaaattgcttcacacaatacatctcttgcggtaagtcagggatctccccattgttttgcactgcaaatttttaattgctatgttagcaaaccatttcgtcacatcaaaacctttgttaaaaattcagttaagcacgtgtctgcctgattctttttccatcttgcattcttccattcatgtcgaatgcagtattaaatgctgtagctcttctttcctggcctaaaaaacattcatgtgttttcgttaatgtgaaacacttggtactgtgaggcctcatgttagctgaaaaagaattttttgttagttttggcatttgtctggagcacctgatttaaaattcctatgtgaacaatagtgttataaaccacaaaagactgcatggtatggattcctatagcttctacaatctagcaaatctatccttctgatcttctattatatctaatgcattttttggataggtttatggcttctcatggattgtacttctcgttttggtgctcctatttaaggtttgttacgttgaagtcttaatatctctacctgttctgtgattttaatttatatgggcaacatcatctaagctaatcttttgctgtatcgtgctgcagctttttactgcaactccgaagaagtcaaccgccttgccaacttttgttcggtttctacagggcctccttgcgattggaatgattgcaggaattgctctacttattgcattgacaaagtttacaattgctgatctatttgcaagtgcgcttgcttttgtagcaactggatggtgtgttctatgtgtaagtacagcattcctcttgtttctttcctcaaatgttgcagggttaatgctgtttgtagcacagattttagttgcatcactggtagttagtttgattagttcttacagatgcggtcctggcttatgcaaacttctctacttgaatttggttgccacattttctatgctttgttgtttggattttacccacatgccttctaacctgttgcatatcatggcagctggctgtcacatggaagcgcctcgtgaaattcgttgggctctgggactcagtccgtgagattgctcggatgtatgatgccggaatgggtgctctcatctttgtgcccattgtgttcttttcatggttccccttcgtatccaccttccagtcacgtttcctgtttaatcaagctttcagccgtggtctggagatctccctcatcttggcaggaaacaaggcaaatcaggaggcatgaaaagcctaaccacctaaccgcctggatatttttgttgtatattcttggaattgattagtggtacttgatttgaacaacacctttgtacataactgcctgccattttaggagcaaattatgtatccaaactaacagtgccatgccagtttagatgtgagtattcatctcttgtttgtagccgtaacgacctgtaatttgaacattccggtaatttggatgcgacaattcagatagcctgattgctgtatttgagcaaacaagtgtcccgaatctttggtgctgagacgcatataacgccgtatcagtttacctagtagaaacgcagttgtgttacagtcgtttcactgcatttacttgcatatgccacctggagtcccggagtcgtccagaactccagatcgttcacagggaagttgtattaagttcatagtggctgctactattacatgtctctgaagaacctgggtcatcgctacatgaaatgtgtcgcttgtgctgtcgttattgttctgctgatccttccgttcttctgtatagatctactgctctaggatgggcaagcaagagtgaactcgccatgattgcattgcaacatcctagcggaaaagaaaggcttttcaagaactccacaccgttgcaacattgacaaagaaagggctcttggaggatctatcaggtactatttatttatgtggaggagatggctatggtccttgtcatttcttccttctctacatcacctagctaggtcattttctaaataagctcccgattcactggcacttctggattcgtaagccacagcgcccacagttgtgttgagtataccttacgttatggaccatcaggcaggcatcagcactatccacagggatgtgttactatctaaaagcttagtgccccttacggatccattctctctgccacttcatatttaccatttatttcctacttgttgattgttacacgtgctagttttaccactaggatctttggggtactagtttaggcctcctttggaatggaatggatgagattttgttttttttcgtaggaactaactaataaaatttctattcctttgtaactgcgttctaaagaagtccttaaataacgtagtctgctttgaaatccatatagaaaactacctcagatgcagcctacatatgtgcaaatggcatggcccatctgttttgcttattgtccccttgccagatgaatcctggtcatgccactagattagctgtctggctggacgggtaatgtatgccatgtgccgaactgccgacaatgatgatgattgtgggccattagtgtcactatcacctctcttgtagttaaccacctagctatgcaatattgcaatggcataaacacctgcatgctagtaatagcccaataacggtttcctagaatccagacacaacttatgtttgtcctgcagtgaagttcgactctgttctgcattcatccctttcctgtaaccattcagagaaaatcctgcttaataatctttatggagaaatgcagtgcttctacccccattctagaactacatcaatatcctactggtgatctagcctgccaggtgcagttcgtatccgcctatccggggatctgaaaattatcatgaacctactggtgattgctatgctatcaggagatgccagagcactagcttttttctagttgcatttcgacaattcttagtagttacaggaacaatgttggctacatgtttattggtttgcacccaatttatcttagcatgcatgcaggaaggagctccgtatgctcccaacaagccattgaaccgaaccactgtttgacagaaacagcctaaacggaagctgatgagcaccgttgatgtgcctgcctgtcacacttcatataagccatgagcaccatcatattgtcctactcatcattgcatcactcgggtaaactctgtaaattccctctctgataatgaaatccctctttaacttttacagattgtgaatctctgcaagcaacacttgccgataagcaacaagaaatcaacagcagtagcacagctaggtgtgattaaaaaccatgacagtgtgcttgaatatattttagctctttcctcttgtctccatgtatgcagccatctctgtctgtttggtaaaaactcaactgaattgtaacaccttttgtttatgagcttacaagaaaagttttgccctgcatgagagtcctaagaatttactctcttaccacgtgaaggattaaaataccttttgatcaagatgatgcactggatgatgatctttgatcattatctgttacaatttacctgatccattttaccgcgtgctgaactaaaacaccttttcctttctccctcaagctttaggtgattatggttgttgttttactgctactgaaatggatggtaaaaagaaaatgtatgatgtaacttctatacttttgcaagggcaggaaatgtaatcatacctatgtgtacgtttctacttctctagaagaaatatgaccttattattgtgaagaaatgagaatatgaagggtttatctgcaccaaataacagataacacttgtgcttaatgatttgtgtacttctaaaggaattttacggagcaactgactctgatcatgttttttccaagactaatcatgtgtacgaaactacagggaacaaccaagtttcaacaaattaacatgcacaatgattcaagaaagggtacttcttcaaccttggtacttatgaattatgatgtactactaggcttacaattatagaactgtgttatagatgataacttgtactttcatctatcattggatcaataaagcagagcactttcagaaatgtatcatttctcccttgccttcattgatgatgcaacgaggttgagagtgaggcagagcaagcatcggttggaccacaggattattcttgcggaaggtaggtacgtggttgttccattctaggtccatggtttacctactaatatcttgtcatcccttgtgggacaaggcttttttgctttgtgattatactgccactttgttatcctcttgagcactcctgcgcattacaattaattgcatgacaaataggagctatagctagctacattaaagtcaaactttatgatgtcttaatagtttgtggattaatccatttttcaggtaaccggtgaagatgtcgccattgagaggttagtttcatggaaaggctgtgccttgccttgccttccttgttagattttgcttatgtatcattccaagcgagcagttgcagattgtgaaaatgacaaaatagaaactacttcatgtagctggggaattttaacggatgtgtatatatatatatatatatatatatatatatatatctaggtcaaatgatatgttcttgacttgttaatcatatcgtgtgcttatggacagtattcagcacaaccaaactataatatgcacgttttcttgcatgctaatccgacaagaagaagaaaaaaagtttctttggacagtaatattctcctcggtggtttaatgcaggagtggaataagaggccactgttgcaaacttactcagtagactgaatacttacgactaagattatattggactattggtggacggtggcactcaggtaacgggagctcaatgattcaaaaccgactctacactaatttctttcaggtatgtagagccaaagaaaagttgtttacttattccattaaactaataattatgttcttgtcagtttgtgtgaaacaaaaagtttcagaatctgcagtgacaaatgcaacccataccatttggaaacttttgagaacaccgagcaagtcatatatacttaatttgatagacagctaatgatggttgttcaaagcgtatcctgtatggttgattagcctatgtcacaatgcactatttcctaacaaatagcaactcgaagtctcccttcttcaacatttcaaaagcagcacaatttcaggaaattttctaaaagttttaaattattcacactttatgcataagaaagtctaggtttgacacattggtagtcaatatgtgaagttgaccatgctctgcagccatcgcatgcatattttatattcctttttcatcggttaggtaaatctgtgtatgtcaccatactgtggactgggttgcgtagatcgcatgccaacgattgagaggattattttcaggtggtagaagctacctctgtaacttaatttactttttcgatctgtacacgttaattatatttacctgatgcatacagtttaggatatcttaataaaagttttacgtacagcaatgatcgatgcataacatctgcattcgatttctaaccatgttgctattgaatgctccgcttgttagaccagttcgtgcagaaaatactgctactgtactaccaagacatgtgcctttctgatcgatccctgtacattaatttgttctctcttgcacatcaattctgttgcacagcaaactgtactagtccctacatgaaagtcactgtagaatgctttctgaagccgccaaacctgagctatatattaatgcctttataaacgtgtgcaaaggaagagagagaaagagaagagtaggttcttcctgttcaacaattatccataggctgtctatgctttgccccaacatggacatgacaaaacctgcatgatcagaaagcgatatatacgaaaatttccgggtacaccagatataactaaatgtataaaaacaataaaacgtatatatagcccatttaattaaggcaatagaattataaatggtggccgtatgtttcaattaatttgtaacaacgtgcaaaatttacattgtatgcataaaaaataatttcaccgagcaaattagttgtttgattactagctgcgtcaggaggtggaaaataatgagctcgatcaaaaccttccaactcaacaactctgtcaaattcagatgataagcttgtaataacctatgaccatgcataaaatggatttgacaggcatatatatacatatagttagggctgctaaaggatgatgctaataataattaaagcttttgatcgagaagagaggtctgcagccagcagatgagagagatgaagcataggcaagcgcaaaggtgggatagtcaatggcttgtggtgtcgggaaatgaggtatacctactggctaactaattgtctgacttgtgtttcaggaccagagaaaaataatatatttattttttatggaaagcaaaaggcacaactaggagccattttaactacaagtacactcaagtagctaatgatatttccacatccgatttctaacgaatctaacaatacatgcacaagcaatgaagcaaacaagatctgctgaaacagcccaaacacatatcggatacatggaaatatatatatatgtgcatttatgctatacacattaattaggatttgctagatttgactttcattattattaactacggggctagcttaagtgttaaaacttcccttgattatttgactgtgctatatatactgaccaatatattaagaactgattaatatatgtaggttcattcttgtggagagagttctagaacataggggccggccggtgattaaccttttctactttcacaagctacccatccctctccatctccaactaactaaatctttttaagtcatataccgtttgcatgttatctgatgcatctaataaccgccctggttagtgatatgatgtgtctaaccagtaattaacctcgtttcggaaagacacgggctaaagctagctagggaagctgcatatgcatgcaggggccatgcgtgctgatgtatacgtccgttgctttttttagtttctttttttttatcatttattctagacaatgatatatattaaatcccctggcaatttaattagagggtatacatatataatactgtgcccgaaaagaaaagaagattgttctctgtcgaagtcctgctgtgaaaatgaacggcttaattacttttttttttgcggggatgaacggccggcttaattactgttctgcttaaaactggtttcgtatatactatattaactagagtaaacttgagactatatatggattatatattatagccgtacgaaatcgtaaaatatatatatatatatatatatatatatatatatatatatatatatatatatatatgtacatatagtcatttgattgattttgtttcaagtgtatctagggattgggattttgaaatggtccaaaaggaagctagcgaccacatcaacaataacagttttagatatctgttggagaagcaatttatatattgtttatttttgttctgacaacgcatacctagcttaattattccgagatcgagcaattatttcaataccgtgacgaccaaaatttagcttagtcacacacgatattagtagtaaatggtgtgtcaacaagtacatatctgaacagaagtcacacttggacataaaaatgggaaaattaatgtcttaatttcatgtcccagctatctaatcattacatatattttttcctccttgtaaaggggtaaaaaagaaacgataaaactaaacaaacaaaaaaacactactgatcgagtgttccatgcatgttctttgtgttctttctacataactaaaagtggaccaaaccaccttttctgatgtgaacaaacaaataaacttgacatcaaccgatccaatagttctcttcttcttttttttttgggttcatattatctccatttagtatccctttaattatctagttcttcacatctcacttgtgttgttttttgaaatatacatctcacttgcgttgttgctgctgatcaaccatgatgggcattgcctgcatcaaattagtatcatgtgagataagtatatataagtagtaaccattaatctgtttaatttggcaataaactgcatgcagggttttaaaagaagatcaggggcacctaagctagctacatacagtagtactgaatttctaaactaatatatatagtatatattagatcatgtattagaatcttatatattgtcctgacattattgttccacctcgaccagtctggtgaactatatatcagagaggaattattggaaagatttttttttttaaaaaaaagatttttggataacaattgaactcgatataaaattacttttttaattaattagaaagttgatgagagtagctactcactctgctagcaatatgtccgtcatcgcccaacaaccttccatgtcgatgtcgtccaggttcagcccgtcgaacgtgctcgacgccggcgtctgctcacacgacatgccgtcgccgccgccgctgggggtgttagtattgcactgatgatcatctgcagctaccattggcggcggcggcgccatcggtgaggtcgtcatgttgcttgcgctcgggccgccctggccgagctccggcgagctaagcccgtccccgccgtggcaaagctccggcgagcccagcatgtccccggaaataccgctggaaattctgttgagtaggctgtcgggggacatgctcgacatggccggctgcgtctgctgcgtgcagctgtcgttggtcaacggcggcaggttgtcgtagttgccgttgtactggccgaggcggctgaggtcaacgccggcgagctgctgctgctgtccgagtatgccggcggagttggcggcgagggtggcgccgaggatggacgtcatgaggtctgtgccaggtagcacagcggcggtgggcggcggggcggtggtggaggcgagcacgcggaggaggccctgcagaatctggaacttggcggcgtcggcctggagcttgatggcgttcaagtccaagggcagctggtgggcggcgccgccgagattggcggcggccaggaggttggggaggccggcgaggaggtcggtgcgcgggcggtgcgtgacggggtctatcccctggctgagaagcttcttgcggaggtgcgtgttccagtagttcttgatctcgttgtccgtcctccccttgagcttcgtcgcgatggacgaccatctgcacgaacacgaaagcaactcccttaattagcatatgtatgagctagctagctagaggtagacgaagaagaagaagaggctagtggttacttgttgccgagggtggcgtggaggtggatgatgaggcgctcctcgtcgtcggagaagccgccgcgcttgatgtcagggcggaggtagttggtccaccggaggcggcagctcttgccgcagcggttgagtccggcgagcttcgggaggcgccgccagctgccatggccgttcttgccgatgtactccaccagaagcttgtcttcctccggcgtccatggccctttcttcacgtcggcgtcctgctcacaacacggtgatctccccatctcgatctctcttcctagctactactcctcgttcgttagctgagctaggaggaagaagctagctaagctagacgatggccacaagagtatgtttaatttggatgataggttagatggacggctatggtgggggtggttttataggagaagaggaagagagagccctaatattatttaacggggctaattaatttaagtgataaataaactagacaagtacacaaagaccatagcattagcatgcatgcatgatcgatcatatcgagtcagctagctagctaagctaagtgagattaattgtgggctcaagcaagcaaacatccttcctttctgtctctagctctgactcttatgcctggcactaattgatttctcactttgggacttcaattagtccaaagacttacgtccatcgtgattagccattagctcatgcaaccaacgaaccaacggaaagcagcagagagcaggggccagcttgcttaagcatgttgtcaatgtaggtagctaaggttagatcgatatgcatttgctctgggtgtcgtgtgcttattgtgtcctgtttttctttcctccgtactttctgtaccttaaattatttgggacttttgaacatatacatatatggcccaatgcaagtggggttttatttaggatccccccaattacattatttttctcatgcacaattatattaatataagctcacaatactatagcatacgaattgatatatattactactagtatatataaggatcagtgtatatatatatatatatatatatatatatatatatatatatatatacgtacttctgtacgtatatactccttatataactttgccctacgtacgattttattaacgtaccgtggatgcatgcaaggatgatggtgataatggtatatatatttctacgtataaagacatgcatggtagatactgtacaaagatagatgtgaaaaaggccagcacattagcatacatatatactagtacatcgatgtgatagtaatattttctactgtgtgtgcgtctacgagggcgacgtgttacttggaaaaatacaagaaaaacacctctctgatcaagtaagttcatgcatgatttggacgtcatgttacgtacacaatatagtgcgttgacacgtacgcttgacaacttaattatccagccaggaaacttaattagcaagagagaacaaactaaaggacaccattcttttcttttctttttttaatgatactttattaatatactatataccacctgtggtgtgcatactatattaattctattaattgctacatccacccaaaagtaagttcacctatatgtctaaattatcatataaaagtatgggctatatgtcgagattcacgcataaaagtgaatttatttagggagtatctatctatatgtaagtgtatttgttcttactaaatcattaatgcatagagaaaatgaataggggagaaaaataaagagaagtgcgtactaatggttgaatgactaaaacgagaagaaaataattaataaacccaatactaagaggagcatgtgtaatgtttatttcataacaaggtcccataagtggggcccacggtgaagatagcatgcaccttgtgaaaagctttgtagtgtataaaaactctcagaggtgatatatatatgggtgtgatccactgctgttaaaaaaagaaagttgtgaaggatgacaaatagtcaaaatactctctctccttaattaattaaggatcaagcactatggctggtaccggtctctatgttgaggacagttgaaaaaacagctgcagtgtttagggtgggctctatccctttttctccccttaattaggaccttctctaaaactagggacatatatagtataaaccacgtacgtaaaaaaaaataaaaactattattagattaaaaaatggacgtgtgatatttatccatgttatcgaaagcaaaatttctacccccagcaaatttttctcatgactgaatctgtgagtagaatttttattcttagtgacatagataaatcacaaatattcatttttttatttaacggtagttttggttttcattatatatatggtttacactatatatttttcctcagaattaacgttgcagatactttaagaagtccataggtaaaaatatatattttttttgacggagggagtatcgtagtaactattgacaatgatacgttggtatttacgtgtacaaattaatatgtaggttttcgcaaaagcaaaagcattaatatgtcggccggtatacctgcagggcatgcgtgtttaattaggtaatattgacatgacacacatgtaaatatgggatgaagtgtagatccagtgcgtggacggcacgtgttgaggaggcagaggagaattaggttcgtgtggtctgacacgtgtgtcctgttaattgccatgatctaacaacaaataatcaaggagcaaattaagcaagctagctagagtatccaggaagaaggaaggaactactatacctgctcgattgatggaatggatatgatagctagatcccttgtttcacacgcacacatgcatgacacgatcaaaatacaattaagcagttggtaaacctctcacttaatttggtacatatatatatatatatatatatatatttgcatcaataacaagaagctatagctatggtcgttaggggttggggcccacccaactagctacagatgtggaattcatgtgcatatatagcttttgttcttgccattgctctaaactggtctttccttgtaaagcaatgatgacataattaacgaaacttaattgcattattatatgtgtactagctacctactactggatttttcacattttggtccttttaaaaaacatatttcgcaagtagacccctagaaaaacttatcccaaaaatggtcctttttggggcgccagagtggctggcgccgttgttcaacaggacggcgccagcctctttggcgccgtccccctgccgacgtggctgggcgatgttgaggtggctaggggga

SEQ ID NO: 58516 - DNA, 12674 bp, Oryza sativa
aattcctgcagccctcttgagtggacaatggcgaaaacaagcttctcacattttgcacatacagttaaatattcattggtttctccaggcctgaagaaagcgaatcacgacggcaagagttaaggctgcttgtgctccattttcgcctcaaattactgccccaagacgcgagatacggaactcttgatgttgttcagaaacttttccctgcagaaaaacaactgggctagtaaagaaagtgcaacaaaagaaactcttcaactatggtgctcagaacgataatacagatgtcccgagctgcattataaagtgtcagtacggtgccagttcaatatatatccagtattctcaatgatgcaggtatgcaggcatagtgcagcaaaccaaaaagaaattgacgttatgttgtgtgtaaatgtgaaagttccataaaacttcatcgtaaagtatatcaaactatcagtatcttctcatcaatgattcaaaaaaagtaagatctctaagggcttgttaatgatacaaagcaagttagatctttcaagcttggaagcatctgctatgtaaatatacagaaatggagccatttctcaaacagatccatgtaaacttttgcaagtgtgatatatggcgattacaaagttacctgtctggcttgaatagtaggttttgatatatgaacaactgcaaagagttcaacagtgaagattcataagattagaaaatataattcataaaggagaatagtcgctgcctaaaacttacccatgcaaccaatatgccaattaattcaaagagtagagggagaacaggaagcttgtcgatgacctgaagttgatttattgtattatcatgaaaacgctcttattccaacaatcgaaaaactgcacatttgaagctagatcatctggaagttacctctacaagatttatagaagcccataatgcggcaatccctgcaaatcctataccagctagagcaaagaggtcttcaggactgctgaactgtttcagttttttttcaggaaacaaaagtatgatgagaacctccatacataatcaggtgcctcaaacacaattcagaacaatttatggtatcaagttgtcttcagtgcataattactccaggtaaagtagcagactgtgaaagctgatcagaagcgtaagtgcgtacaacgaagctttctgaacttgcgtcagaaaaaaaaattgccaatgtcatcagggttcctgaacttactatctacctcaaagctcaaattgattagtagagataaaaaaaactcaccgaactctggacatacttcacaacgctcccggatgacggttctgaactgtcctgcgcagcctttgcagcgacgacattgcgactcctcatcctccctgcatacgagcacattagagcacatgatactcaatggctcgtttgcaaagaaacaacaatataaaaagaagtgcaagagaaggttgagattgattgggacccttggaggaaattaaaaagaaaaacacctgaaacaaatctggtgcttggcactgcaggcagcatggggagattcccggtgatgctctcgctgccgccgcgcggaacgagagccgcaggccgagcaacggcgagagcagaggccatcgcggttagcttcccccgagaatacggtggaattgcggaggtcgcgagcggtggatattgggaagaactactgcttggccttcgtctgctgcagcggatgcgagtggaaggctcctcgtccacgaaagcaccatcggttggcagatttgcagattgccccttgccttctgcagatattctgattaatttccattctacgagtattactgtaccgcctgcctgtccgggagaccggggaagttcacgctgggatacagcttcagatttcgctaggtttatagtgactgactagtgacacacagatgtttcagtttgtatcttttttggagtatattaaaaaactaaaccgtcacaacttttttagtaaaaacattcaaatgtgttgactttctttttaattgctcgaaccgaaggtcctgagctttgttttttgcttcacacttataaagtttactcctcctctattcaatgaaattggcagcttaccgattcgttaaaaaaatataactacaatataattaaagtataactacattgcaattgtattgtaaatacgatataacttataaaactcgtattcaacttatgatttgattagctaacgttgagattttacgcgtgatatgtgtgaacatttctttctattaaatccatttttttttcctttatttatactacgagcgctacgtaactggaatctgtacgataatgacaaaccagcactgctgcaagctcccctgtaactctgcataatactgtagaaactaaacgagcagtaaacaaacatcggattccttaacttacatcggggtcgtacaatcgacggcgagctttaaccaaaattctcgcggaagagagaatctgtctgtccgagaccacctgcgactgaggctgtgatccctgtggcaccggcaggacggcagtacacgcccccccgtgaccccgcccgcgcacaggcgcagcgtggcgccgtccaagcgttcgagtctcactcacctccaccacctctcgcgcccccacgttcctcggactagccgcggtgtcgcctctgtccagctcggttgcttcgctacgcgtcgctcgctgctgccaccgcgccccgcttgatagattcgagcacgcacgccgggttggcgctcggcgccgcgccgcgccacggagggtgtcacgagaccgcctggcgcgcacaggcgcagccccccgtgtcgtcttcctccctggttccttcttgtcaccgggacgggcgaacctctttcccgcgcgtctgcacatgccattttcagcttccatcatcaccatcactactattcactacttggcctagtagcgaccgagcagtgcccactccgttgctgcctgcctgcctgtccgtcctagctagcatcctacgctcgcgtgtagagagggtgaactggcgaagggctgagcagagagatggaggtagcagaggccggcgtcgacggcgtggcggggaggcggcagcaggaggaggcgtccggcgcggcgccgttcggcaggtcctcgtcgctcatcggcgccgcgggattcgacggcgcgctgagagttgagcacttgtttggcttcttgccttcttccccgatcgtgtctcccgtgtgcgttgtgtctctgaccttgaacatttgggctggtcttgtgatccgcaggagctcaaggaccttcgctcccagctgcaccagacggcggactgctgcgagaaggcgttcctcgacaccgagaagaagaagctgtcagtgcaaagcttcagctatcacatttaattatacacttctcccgccactgttttgtttctctcgtgcctaacatgtcctctcacttgccactgttttgcttgaagaattctggagagcacgaaaggttacatctgcgacgcgattgtagcggtgattgatcatttggggaccgtctcatccaagctcgagcaacagctgcaggagaagattgagatcacacaaacagagaaaaagctcaacttcttgaagcaggtcaggacatccgtcgactgaacctattttccgtgaatttcgcatgacaataagagtcagtgtagttacagaaaatagcactagtagctcgcaacatgactagtagcttgaaccatttcaatgatgaagaagtagttgaaagaaacagagtactcactgcttaaatgcttagtactttagtatgattaggtaacttagctcattatctaaaaaaggcaagtgaagatcctgtactccttcaactttttccgttctttgattcagggataacttttccgttccaatttcaagaagttagtgtaatagattttgaaagtgaacggttcatggttactgctgatgaacatcgatcaaacgacactttagtactgccacttattttaatttttagtctcttcatgttcatggtaccagaggctcctgacatgtgaacagtatgcaattactctcaaactattgaccgtacgtggggacaatgatgccattcagtatcatcgccgttacctctcgcaatgtaaattctctaactcatttgattttgtgttgtcgccattacttcttataaaaaaaagggttgctgatatgtggtcatttggacagcttcaactctgttatcattgactaactatattattcactacagctactggaggaaccaaagaggaaaatggtgctaactccaggtttatgccaactaaaattttcctttgatcattttactattatagcatgtgacctgcatcatatcgatttataacattagtagttctgcacacaggaaagatgatgtaaaatttgtggagtacaacagcccaaccatacctggagcaattcttactttcaagccatatgatattcagtcaaccattggtaaattcggtatcttgctcatgttatgaagatatgtatgcttattattgttttcagtgtatgatatacatttctcattgattagtactccttactatcttcaatttaagaactaggaagtagtaactatgtaaatctgtttttttttacaagtaactatgtaaatcttagaagaaatgttatatgaaattctgatatgtttctgatgagatcataattgtctagtttccttgtgttatgaacttgaagaaaattgtgaagatccctaatcaacatgtattacgtaatgacacaaactaactgatagaggaatctgtacatttttttctcctaagtgtgtatgttttatgcatggaatagatttgtcatcaaccttctatagactatagtttaccacagttatagttttgttttccgtataataatagcatttgcatgttatcccgagttatgtgttaagctttctctcttgatatttgtggtagattgactgtttgtttattttcatgatgttgtttgtctttagggagagaacgttcggtggcaactacagactctgaaagcccaacaacggatgcaaagagttcattctctttcagagcagaggtattctctttaagagcaaagagctccttttttttttcaaattaaaaaatatgtttttaaacattatttactttaccaaatcaaaacgctggcgaatagtttcatactagccagttagcgtgctaccctttttgtgacaatttagcataacaagatgcccgtttgcaggacgttcccattgttctagctgaacacaggaagaaggcaaatcatggcagcaatatcttgtcatttatcaggaaaggtagacggcatgcgtaagagccaaaagcgccaccggaatagctcgagactggatatatgcacgcatactttaatgaattcagtattgattggcaacaatgtacaacctaatatcactgaatccccaatttctgtcaaaccagtgtccattgaccatcatgtatgtttagctttgcatttgtgccagcagtaaattcggcccgatcatcctgaacatgtaacaaacttgaaggatcgagcagtaatatctgcttggaaagctagtttttcttcccctctacaaactctcaatatcatgtaacaaactttaatctgtctccttattatcaatgacaaagattcaggtgaggaatctctcccctccgatgacttcgtaaaaaggaaacctgaacacgaattcagcaaattctgcatcatcaaggaaaaatacatgtacgttcagtacttcagggcatcttttcctttgtgcttgagaaatcaactcccgaatcccgatatatcatatatatacatgcagtaattctcataacggtgtgaatcaactctcgtactgtactgtggcgtgctactactagtagtagtataaaggaatttcgctttttacgcgacattcttgagggtagctggcccatcataggactaattaaaagcactcgcataactactaattaagtagtaagctcctgccacaagctatgccaattcgatgagcccgctcaacatcatatcgatcgaccggctcacgcatttcattcaagaagcaccgtccggttgcatgaacgccccgcgccgcgcgtacgtagataactaccattcaaatccctaactgcctgtctgccatttctctccatctcggtctgtaaaatgccatgtatctagtaccagtagaacagttgtactacctcctgatggtctcacgtaacttctttgttccctttctcttcaattacgccattgccgtcttgcccggtcgatcaaccctagctttctaagccctacaaaagacagcatccatctgctagtgttagcttagccttcagagttcagagagagatggggaccaaccggccgcggccacgaaccaaggacttcttcgcagctccggcgctctccctcacactggttcgtcacatcgttctatcgacggcccgatctttatgtagatcattttgtctgaaattttcacctaatcacctgtgtgcttgtttgtgtttatgtacgtgcgtaggcaggcgtgttcggccggaaaaatggacctgcggcgtcgggtggagacggggtggaggaaggcgacgaggaggtgcaggctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgtgagaatttcctccatttctgttgcgtgaatatcagcgtcaggtgtttcctgtcccctgggccgcgggtgaaaggggtgcttcaccaggcccatggatcagatagggccaggcccagaaaggatgaacttgcatgagagggagatttttttagtttaagcaagcgttccagtagttcctcaatgatctgacatgaaaatatttttcaaaatggaattttgttctgaatcggttgaatgagcaggctattcaaagagtccccacatccggatgagaggcagcggcagcaggtcagtaagcagctcggcctctctgcacgccaggtcaagttctggtttcagaaccgacgaactcagatcaaggttaattactagcgctcagtcttaactataccagtgtgctcgtcccaccgatcaacagcaaacagcaaatgaatcatgaatgcatggggattttgatctgtgcaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcccgtcctttccggtgcgctacactgcaagacactgactccggcgaactggcgatgttgaacttgtttcagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggtatgtgcatggcgatatgccgatattgtgaacacacggacactagctcatacatgcatacaccttgcatgatttttttttttgtgcaggacaagtggaaggacctattccctaccatgatctcaaaggcagcgacgctggaaatgatcagcaaccgcgaagacgatggccgagacggcgtcctgcaactggtgacccgtcttgtgtctctctgcttctgaccgacgaaattcatagtgctaaacgtgtcataccttgctcgatatggtttccagatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaaggtatatacgtagaacacagtatggttcaagctggcgtacggccgtttcaactttcaaccaaatctctgcaccgtggtttgactagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggtaaaaccattactgacacgtcgcatgcagcgccgcgtgatccatcatcatccatggccgtctcacggatctctcccgtacacaggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagaggtgagccgccgctgcgcgcatttcaacttaccctgcatgcacattatgcacactctgactcactaatcaaattgttgtagtgggacgtgatgctacccggaaaatctgttcagagccgcgtgaatcttgcaaaggggaaggaccgtaccaactgcgtcaccgcctacgtaagctaaccttccctggcagctacatgtgcatctcgtcgacacgtacattattgctttccttcggatggatgaactgcaggccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctagtccacgggacgcggaaatattctactcctacttcggattcgttattcgtatgatactccacgactccacgtgaccatgtttgcaaagtaaatttgcatcgtgacttaccatgaacataagtgtacagctaaagggatactcgtactatagaactacacggtactgtaaagtcaacaattaagcgttaaaaatcccccgtcttgcagacttctttatggtcaccgcaactagcagagagccgtgccatgggcggtttcttggaactcgatcatatccgttgcaatggaacgcaacaaaacgtaaagaccagcccaagacgtaatgatatcacgtctccacaccgatgacgttgggccgctgcgtcggtgagcccgtatcatcttctacaaatccgaccaccgcgtcgctcctgctcggcacgtcgtcgccgccgcttcccaaatcccttctccctctcaacaattttgcgtgcagcgctggtagcaacagtgcacaactaggctggtcaaaggtgtgcacggtggtgaagacaggatttagtgatagggggtgctggctacgagatgtaagaactcaccagctcctcggtaaacctctcggtagacaatggtgtggatcttgatggctcagttcatgctgagtagcagattggcctcacctcacctcttgttcgctctaatatgcgtagtcgccaaaagaatcattttttaaaattaggcaactaaatagcaccaattttacaaaatacatgaatgacaagacatcatttctattcatcctttttagttttggagacttgcaaccacatcgcttagttacgttaactcaggtaatcacgtaaagctaaaatctattggtcagttatgtataggctcaacttgcaactaactaatgagttaattgtatggattagatgcctaatcacccggggggtttgcagtgcatggggatgggggtgtcaggcccaccccggcacccccggtggcttcgccactgggtgtgcacacgaaaataaaaactcaaacacaataaaaattcgtctaaaagcaggataaaaagagataaaaaaagagagagaaaagcaacggactgcagaactatagccagctgcagcatgaactccaatacgtaatgtgcgtatgacaggtgggaccaggtatctatctattatataattaaaggaatagaaaaaggagcatccacgttcgctttcatggtctagaaattctcttattaatcggagaaaaagaaaaggcagagtccatatagaaatacaatttgaaaatagttgaaatttggaattaaaaataaggaatattagaagatgagactagagtctatatagaaatacaatttagaaatagttgaaattcggaattgaaaaataaggaatattagaagaggagactagagtccatatagaaatacaattaggaaataactgaaattcggaattaaaaataaggaatattaaaagtagagtatagattccatatagaaatacgattaggaaataactgaaatttgaaattaaaaataaggaacattagaagaagtagagtatagagtctatatagaaatataactagtaaataatagaaattcggaattaaaaataaggaatattagaagtagagtatagagtccgtatagaagtacaattaggaaataacagaaatttggaattaaaaataatgaatattagaagtagagtatagagtccatataggaatacaattaagaaaataatagaaattcggaattaaaaaaataaggaatattagaagtagagtatagagtccatataggaatttaaaactaactaaaattcggaaaaaaaagaggcctccacgttcgctctcctggcctagaaattctcatattaatcggagaaaaaaaagcagagtccatatagaaatacaatttagaaataactgaaattcggaattaaaaaataaggaatattagaagaggagactagagtagttattacacattagtagtttcgtaaagttattgcaaaatttaaaattatgttgtcattgtaatatattttaataatataatgagaaaacatatatactattatatgagagaaaatataatgatgctagccgcgcaatctgcgctggccaccatgcttgttaatagtatagtaagcaactattgtatgaattgactattatattggctatggatgatttgtagttagtagttggctatactattaaacttgctctaaatgaagttctccaatttgtgtgtttagttcacgtcaaaattagaaatttggttgaaattggaacgatgtgacggaaaaattggaagtttatgtgtgtagaaaagttttgatgtgatggaaaagttggaagtttggctgtatttattccacaccataattgaaagtttgaataaattaaaacgatgggataaaaaaattggaagtttatgtgtgtagaaaaatttaatatgacggaaaagttaaaaatttatagaacaagattggaatctaaacagaacctttgtttaaagagtttggaaataaactcggcctttgtcgcaaaatttcgggccttacctcgtggaggcgtggagctggcccttgccgccacggtacgctttccctgacggatcgggccaagctgcctatataaaaagtcgtcgtgccacactgccacgggccacggcaccaccatcgaacaaagaatagcgcgcacgcattcgcctcgacgccgcatactcgcgtccacgagccccgcgagaaacagctatccacgtcatccgcggcggccgcccgccgttttcccttttccaggcgcgactcggcggccgcacccggttgcgcacgccgctcccccccc

SEQ ID NO: 58517 - DNA, 23953 bp, Oryza sativa
ggaacaacaggtgaagcagtgtgtttgtagaatttatgtcctatttcacgctatatttgtcttttaacttccaccttctaactgttttaggggcatgtccactgtccatgcaatgtttatcacattaatgtcagtttacctagtattcttctccaacctattctctgatgagctggatggcccagtaacagttcggagttcaaacctctccaattttacactgggggtaacatatgtcactgtttatccgcattgaataataggttatgctgatatatacattttctccttttgccacatgttagctgaattaaatctgtttaggtttctctggggtacttcatcgctgaccttgctatgttatcctgggcttatccttcccttggcggaatggagtatgtaagtgagcatagttgatcattaccatttattttatttcaccatttgtttactttctaggttactgctattcagtgtttattcaattactgtgtgctctgctgttcatattattcatcacttgggttgaccattgtcaggttcttcaccacttgctgtcaattatttctttagtctatgctatttattctgaagaaggacagttgtacacatacatggttctcatctctgaaacaaccacacctggaatcaacctccgatggtatgcttcatgaaaaagatcatgcaccttttctttatacttattttacttcaatctatctgacctgttatgtaccttcttcatcaaaggtttcttgatactgttggaatgaaaagatcgaaagcctatcttgtcaatggtgttacaatgtttgttgcatggctggtaagtgaaagttgctacactgtaattggaggttagaagttaaaaatcatgcattgactgcaggtgatcggatagttatgtactattattagatgtactacatgcatgcacgaattataattgaatctgtatatagcgagattcaaccttgttatttgttgtgtgtacgtaagtatgagagggagggagatttggaatcgtgcttaatcaataatagttgcctaatcagttagacgctgtctctggtgctgtttaggaagttcttatatatctcaaatgtggaccaccatttgcttactacaggtggcaaggataattttgttcatctacttgttttaccacatatactttcacattgatcaggtgctatatccttctgatttgatatatgggtacatgtctacatgacaaaaatcactgaaattaaactgttcttgtttattgacaggttaagcagatgcgcacctttagctgcattctgatattcgctgtgcccacaatactattagtgatgaacacagtgtggtttgtcaaaatcttgagaggtctcaagaagacgctagccaagaggcagtgaagagtggtgaattgctcataggcgcatctacaaccatcctttcgtacagtcacatacaactacatatattttctacgttaagctttatagtgcaactcatagcgcaagcaaaagatcccttgtacacatgttggaaaaatctcctcaacattgccgaaaatttttgtccctgtacggttctacattgtacatatatatatatgcacgtctagttatggctgaggatgcttttatctgtgcactaatgattcatagtttcaattttcaacaactggagatactgccatagtggccatctcatagacatatagagaactccatgattctagatacaacttgaatgtgcaattcgtattgctctcactatgaacgtttttgtagctcgattctaactccagatttgtagttcattcccgtcatttcaagggagctggtaacactcatcatttccgttcttcaaatatcgtatttctgtctagtccagcgtcgccttaattggccttctaagtggtagatgccgtcgtcattgttgtagtagatggtgcggtcgatgccatcgtatctgtcctagatggtacattgttgtcgtagatggtgcggtcgatgccatcgtatctgtcctagatggtatggtcgatgccattgtatctgtagcgtgctgattattcccttttacagttacagaaacctctaaagcaggaacaatagtggagtagtatatatttatacataactattatctgaactagatattttattttaagttgattatatgtgatttagagctagtagcttgctgtaccattaaactactctaaatacgagaagcacagaagaagagtcgttgccacactttgggtaattacgaaggaaagatcgtgagttgcgactgtcacgagcacgcggttcgaacgcgcgcgggtgctgacttggcgttgacctgtgaaattctctcgcttcactcgagtctcttggcccttgctcgaggcagactcatcgagcagcccaaagccccaaacgactgcgcgcgagcgatacactggcgctgcgcctcgctgccgtaccagagagcgccgccgtcgacctgagcgccgtcgctaataccctgccgtgcatatcctaccgggactcgatccggagcgtcgccgccgtcactccggcggccgaggcctctcttccagtcggaagattccgcctccacctggtcgtcttcctcctacgcgtccgactgctccggccactcctccggcgtctccgccgccgcggccgctggcttcagggcactcacggcgcacgagctcagggaggtcgcgcgtcgcatggtcgccgacggctacgcccagcgcatggtccaagcgttcgacgacgcggcgacggtcgaggtcctcgagggggaggtggttcttcgagctcgacgtcgactgggtcctccgaatccgcgaggggcaggggttacggcagctggagaagtcggccgcctcctccccgtcgtcgtcgccgctgcaagatctggtggagagtgacagattatgtcttgtttttactatatatttttaacatctatttttgagataatagttggctgccttaggatgtaaggcactagtaattttttgagataatagttggctgccttaggatgtaaggcactagtagttttccttaggatataagccactcctaatttttaggatgtaagccactaatctataccttatggtgtaagccactggcctatatatatatatccaaccagccatagttgattgagtggagaatagaaattaaactagcctcaaaacctgtgttccttttgctaacaattggtatcagagcaaggtttatctgacttccatcgactccccatccaaaaatgtctctccactccattcgttccccctctctctcgtcccatgcctcaagcacttccagcggacgaggcagcaggcggtcggcggccgacgctgagggcgacggcgatgcgactgctgttgcgcaggaggcgcgagcggctgcgcgggaagcgcgcacgacgcatgaggaagtggaggcacggctgcaggcagccacgagggcggcacgtctcgcggcggcagaagctgaagcagcacgcaccgcggaggcggccaggcaggctgcagctgtgttgatagaaaacacgaggcctgggagatctacttaactccggtgcaggtccaaagctcgccttcgaatgtatgagcgtgccagttgatttgatcctgtaatcaacaagaaatagagacaaagaattcgtggttaaatctataaatgatagccgatcggctaggtgccgatgtcatatatgaatcgatcggcggttataaatagaaagtaaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctagcatgtatcggctaatactccgatactactttatataaagatatcaaaacaaatataatttaccaaacaaaagcttaatatacttaaatacaataagatcttgatataaagggcggatttaacatgtcattgaagcatatagatcgaatatggttaaatcagataagatcggctgaaactccgatactaccctaatcggcaaccataggacatgctagagattgatattctaagcacgacttaatagatcaaactcaactgatgcagcattaagtatgaaaagaagaacaatatctagacaatcaagccgctgggtgtttcataaagtggtagatatcttatataatctaggacaacgtcgctatttaacctaatcggctgccttctattaacagatgttagccgattgtaggttagatgacgatattgccaaagattatgtaagatatatgataacttgacgaattatatagacaaaattagagtgtcataatgatggaagcactaatctcgagaacacaagtcgtcataacaagttttacctcttgttgaagatcgaaaccgatgtagctcaacccgaaagtaagaactcgtcgaaacaaaactaaagcaaaaaggtggcgatgcgccaaaattgtattgaacatgtgtgttaaaaattacatagggctcggggtctatttatacccgagaattacaagatatgtccatactggacacgaccgctatctctaacaaactctaagataccataagtctttgcagcagacttttgcccaaacatatatctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatttggaattcagccgattattgctctgttctcggatcaatctccgccttcgactccaccttgatctaatctccttttccgactgttgttgcgcgggttgcgcaggaggcgcgagcggctgtgcgggaagcgcgcgcggcgcgtgaggaagcagaggcgcggctgcaggtagccacgagggcggcacgtctcgtggcagcagaagctgaagcagcacgcaccgcggaggccgccaggcaggctgcagctgctgctgctactttgcgagctgaggaggaggaggagcgacgtgacctggagctgacagacgcggcccgcgtgcgacgcgacgcggaccgggatcgacacataggccgacgtgatcgcgacttcagcccccatcgcagaggatcagatctccaccgcggtgaggaggagcggcgcgatccatggcgcgatcctcgaatcaaccgcgctctggagacccagcgactccgggagcaggcagcggcgattgaggcacaactggacttcgaccgggagcagggtggacgagacgttggcgcacggagccctcgcaggcagcgcgcctccccttccccggaccggcgccgtggtcgccgtggacgctccggctctcctcccgttgtgcagatcgtcgtcaaggatgttggcggcgcatggcccatgctcaccaagactaactacgccgagtgggcgatggtgatgaaggtgaagttgcaggcgcgccacatgtgggacgcggttcgatacggcgacgtcgactacggggaagatcggcgggcgttggaggtgctccttgctgctgttccgacggagatccagtcctccatcgcgagcaagcggaccgccaaggacgcctaggacgccatcgcttcggtacgcattggcagcgaccgcgcccgcaggtccacgcttcagaagctgcgtcaggattgggagaacctggccttcaagccgggttaggacatcgactactttgttctccgcctcaactccttgcaacagcggttggcgcagctcggcgacaccaccatcgatgaggagagagccgtggagaagctcctttgcgtcgtccccgagaagtacacgcagctggctctgtcgatcgagacgctgctggacttcaccgagctcacgaacgaagaggtgacaggtcgcctcaaggccgtcgacaaccgcaagcagctacctccctcagagccgatcaccattggtggcaagcttttcttcaccaaggagaagtggctcgcccgccaacaagagcggaagaagggggaggccacaagctcttcggcttcgggatcgtcgagcagccgcaagcgtcgaccacgcaagtgggagaaggcgcgtagtggcgctcttggcggcgccgatggcgagcgcaagggcagccgcaacgacacctgccacaactgcgggaagaccggccactgggccaaggactgccggcaggcgaagcacggcggtcaagcacacgtcgctcaagcgcaggagggtgatgaggtggctctgtttttcgtacacggaagcatcgagccacacttcactcccacaccggacgctaccgcgcccctccacctcgacgagctgtgggcccacgtcttcctcagcaacggatcctgcgacgacaagatcgacgggtggtgcctcgacactggtgccactcaccacatgaccgggcgacgggaattcttctccaagcttgactccagtgttcaaggctccgtcaagtttgaggacgcctcagccgtggagatcaagggcgtcggctccatcctcttcaccaccaagaccggcgagcaccggctgctcaccggtgtctactacatccccgcgctgaggaactccatcatcagtttgggacaactggatgagaacggcttgctcgtggagatagaggacggggtcttgcgggtttgggatcgccatcgtcgccttctcgtcaaggtgaacaggggtgccaaccgcctctatgttctccatgtacaggtggcgcagcccgtgtgccttgcagcccgccgcgacgatgatgcatggcggtggcacgagcgctttgggcacctcaacttcgaggccttgaagcagctcagcaacaaggagatggtgcagggcatgccacgagtcgagcacgtggagcagttttgcgacacctgcgtcctcaccaagcagcggcgactcccctttccccgccaagcaagtttctgcgccaaggagaagttggagctcgtgcacggcgacctctgcggtcccgtgactccggccacacctggaggccggcgcttcttcctgctgctcgtcgacgacgtgtcctgctacatgtgggtggtcctgctcgactccaaggcagtggctgcagacgccatcaagcaccatcaagttgctgcggagaaggagtgcggccgcaagcttcgggtgctacacaccgacaacggtggcgagttcacgacggctgagttcgcagcgtactgcgccgacgagaggatccagcgccacttctccgcgccatacaccccgcagcagaacggcgttgtggagcgccgcaaccagacagtggtggccactgcccgcgccctcctcaagcaaagagggatgccggcaatctactggggggaggcggtgatgactgccgtccatctcctcaaccgctcgcccaccaaggcccttgatggcaagacgtcgtacgaggcctggcacgggcgcaagccggtggtgagccacctccgcgtctttggctgtctcgccttcgccaaggagctcaaccacgtcggcaagctcaacgaccggagctcgccgggagtcttcatcggctatgcggagggtgtcaaggcctaccgcatcctcgacccttcgacgcagcacgtccgcatttctcgggacgtcgtgttcgacgaagggcgaggttgggcttcgtacaaggcggtggacgacggctcgacttcgactctcagagacttcgtcgtcgactacgtccactttagggcagccgggggagctagcagctcatcttcaccgagctcgtccacctcggcacccggctcgccatcagctccggcgagtcctctaccacctacaccaccagcaactcctccatcaccagctacgccccgctctcctacaccggcgcccacaccaccggtggagttcgccactccgttgtccaacgacgaggatcgtgttgatgcgtaccacgacgacgagcctctgcgctaccgcaccatggacaacatcttcggtgatcagcccgtccctggactggagacgcgcgacttcgaggccgagttgcacctggcgcatgaggacggcgagccctgctccttcgcagaggcgaatggagatgtggcatggcgcactgcgatgcagcacgagatggacgcggtcgagcggaactggacgtgggtgttggcagatcttcctgccagccaccgcgccatcacccttaagtgggtctacaagctcaagaaggatgaggccggggcggtgatcaagcacaaggcacgtctagtggcgcgcggcttcgttcagcaggagggagtcgactttgacgacgccttcgcgcccgttgcgcgaatggagtctgttcgtctgctcctcgcgctggcagcccaggaaggatggcgtgtgcaccacatggatgtcaagtccgccttcctcaacggagacctgaaggaggaggtctacgtccaccagccgccgggattcgtcatccccggcaaggagaacaaggttctccgcctgcgcaaggccctctacggcttgcggcaggccctctacgccaagctggactccactctcaagcaaatggggttccagcagaactctcacgaagctgctgtctaccagcggggcaaggacggcaatgccctgttggtaggcgtctacgtcgacgacttggtgatcaccggcaccaaggaggctgaggtggaggcgtttaaggaggagatgaaggcgactttccagatgagcgatttgggccttctctctttctacctggggatcgaggtccaccaggacagctctggcatctcccttcgccaaaccgcctacgccaagtgcatcgtcgagttgggcgggctcaccggctgcaacccagcctacactcccatggaggaaaggttgaagctgagccgcgacagcacggctgaggaggtcgacgccacgcagtaccggcatattgtgggcagccttcgctacctcgtccacacgcggccagacttggcatttgctgttggctatgtcagccggttcatgcagcgaccgacgacagagcaccagcaggctgtcacgtcgagggcaccaccgactacggctttcactacccgaggtgtcccggtgcgcagcacttcatcgggtacagcgacagcgacctcgccggcgacagcgacacgagcaagagcaccagtggcacgctgttcttcctcggcaagtgcctgatcagctggcagtcggtcaagcaacaagtggtggccctgtctagttgcgaggcagagtacatcgctaccacaaccgcctcaactcaagctctctggttggctcggctgctgggtgatctcttgggcagaaacactgaagcagtggagctcaggatggacagcaagtccgctttggccttggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtcccttgggcgggtcaagttccaggagtttcgcgccaggattggaatggttcaaattccccaaaaggcgccacacatgacttagggggagaatgacagattaagtcttgtttttactatatgcttttaacatctatttttggaataatagttggctgccttaggatgtaaaccactagtagttttccttaggatgtaagccactcctagtttcttaggatataagccactagcctatatatatatatatatatatatatatatatatatatatatatatatatatatatctgtgtgtgtgtgtatgtatccaaccagccatagttgattgagtggagaatagaaattaaactagccccaaaatctgtgttccttttgctaacaacgagccgacgccgtcgctcgcgcggttcggggaagcttgcgtcgccaagatggtcggtttcgtcgacgccgtcctcgccgctctcaagcttgtccacgctccgccgccggagaagctacacgccctggtcagcatgtacgggcacgccatggacgcctcgtctctcctctggtcacagtgccgccgcgtgctgatcacccaccaaaccacccaggccatcacgttcgacgccatggagaacgccctgttcaggaaggcgaccgagctgcacggcgccatatcgagcaccatggaggagaccaaggcgctcgtcgaggccgccgccgacgacgacccgacggagatcgcgcgaggtagcggagacgacgtgcacacgagcgctcgcgtcatggtggactgcgtcgcgtacgctgggaacgtacaggggatacctgtacgccatgatcgacgtacgacgccatcggctacctgaggcgtctcatcaggaggaaatccaagctgtgccagggcacgggcctgaggtacattttcctgctcaacaactcgcatttcgtggcgcagcagctcgagccgttctccaacctacggtggattcgttgccagtggcggctacatcgacggctatttcagcgcttcttgggcgcccgtgctgtcctgcctatcgtcgaagtctggcctctctccctggagcaacaagtcctcgccattgaggaaattcgagttggcgttccatgagacgtacacggctcagaagctgtggaaggtcccaagccctgagcttagaggaaggctgcgaaaaactatcaccgagagagttgtttcaggttatcgcgagtacttgttggagcatcctgagctgaagagactggttagccgcggaaacagcaacactcctgctgacctggaggagatgctggcagagctgttcgaagggtgacaagttatggtctacagtagtttgcagcttcagaattgtaaatactgctgtgttggtttcatttttgtttctattccattttatcttgtgtttcactgtcaaatctgggtgcccttgtgcaagattccgtagatatatagataattagttgatatgcacagctgcaattacacaagatttttcttttttgcatatccattacctgtgtctcacagccaaaaaaaacacttgttctccgatacatagcgttggcgataagcaacgccgtctttttcttacaaaacttgcagcttctacgatctcaataatggcagtatgcttacgagacaattagctatatatctattgaaaagattttatcattatagccatcctgaacaaaacagaatgctacaaacatattcacgagagacactgctttggagcctctaatcagctggttttcttttgccagtttcaccgcatgggtcccataaaccagctgagtgcagcccagaacagcactttctaatattcgaagaagcttcgatatctaattgttataccactgtaagactatacaggtctattgatcgatatctcttgtcccagtaacatcacgagcggaaatttgttacaaaacttctgtcatttctttgcaaccttgggaggtggcgaagatgacgatgaagatgacaagatagaaaacatgctattatcagctctgtctttgctgaatgccttgcgcacatcctcctttaactcacagaaccgcatccttttaacattttgctcatcagaagtgccattttggaggtcgagtgcatcaggactatcgggcaaatcatcctccagaaatttgtcgagcacctgcgagcagttagggaagtagcgacgtcccagctcaactgaaaacagaagaaaaaaaatatcataagaatgatcatcaagttctgaggaaagggtgctgagagtaaaacaaattaccaatcaacatttgagtaaataaaaaccccaactatttgtgctcattaggttcaaagtatgcaaaatgtggaaatcacgccagttttacaagagacaggaatgtttttaacatgaactacaacatcctcacataacatttgacaactaaataattattttccgtgttccattagcagttaaaattttagccgggaactagcaacgtgcgtgctggggtgatttttttagtgagagatggtggaagaaatggggattttgaactaccacggtatcaacaccaccaactcaaacatttaaagtacgaagatgaaggtattagcaacatgtgagaatttctgatggtaatcagtgacatctactcataagctataatagtttgcatataaagaatgtgtcatcagttccgacctgttttcatgagtgcatccacccttgaacggagccttttgttttgtgttactggtgtctcgttcagatcgacttccttcaattttccagaagtgctagctgcaggaacaatgccaaattctggtgtggtgtctgcttgtgcaatttgcattgcaacctttgcttctgcaggaaaaaataatcttgcaaatgcaactgcaagagaaaatgcaatgtgtcagcatggattctccaggtgaatgtagtatggttgaaagcaaacgtggtaaatgctaggatcacttgtttatgtagcataaatgtataatttttctccatcctgtttctgttcgagaaaggtctgaaacaagctgcaccacgaagtgctattctaccgagcatgaaaagagacttcacctctgttttcaaggtagagaagcttcatgtgaagatcgtcagccaacaaaggcgaggtgacagaatcttccactgccataggtttccttatcatctccctatctaatatatcaatacataatctgtctttgtttgactcttggccttgctccatctttgtattgtagtctttcatccttgttaacctccggcagatactcattgcactctggccatcagcagtcaattgtgatacagctgctcctttgtttaggagacacatgataatagctggctctctcctcatagcagccagatggagtgccgtgtatccacgcgaattcttcaaattcaagttggcaagtctcaagtctaacaactccgaaacaactttcgaatcacagtaagcagcagcatagtgcaatgcattggcatcatccaaggtgatctcagattcgttaagaagcaacttcacaagctcaacatcatcagaatccagtgccctgtggattcttctgacccttttctcatgtacagggtctgaaatgacggtgtcaccctcatttggctgagatttttggcgaatctcttttatctgaacagcaacttctggaggaagttccttatccaacgatacattatcaagatttgatcttgcaattctccgaatacatttttcaagcactggagtcagctctgaatgaaaagcaacttgcagaattggaagaacatcttctactagagtcttatcgacgaagttaagaagccgtcgctgtggtagaagaagaccgtattaacccagattaaacaacaggtcataaaaatataagctaaaagactttgggttattggacatgtagtggattcataaaccgttgaactatataagctgagacaaccaagctaattagtccactaaccaatctggagcacactgatacacatcaccaggaccaggactgcatcctagctcctctaatcgaacccaatatagatttagcaagtttctttcaacttaaaaaaggtataacacaatctagttagaagatctgaagtggggacttgagagcaatgtttacaagctatcaagcttatgtaacacagcctatgtgcttgaacgacttccagaatccagactcaagacatcgtgcagcttgaagttattcgcatgcaaaaattggttgaaaatatgtttacaccatcaaatacagattgcataaaaatataatcggtgacagaacagtttctagttctgcagctaccgtttttggtatcctaacaagcacaagaagagcatccttttgtatctcacctggaacagcgagatgagctcggtgatcttgaacgcccacgccgcgtacatttgctcgacgttgaacctgatcgccggcgggcacgagtcgtgcgggcacatggggtcggcgcaggacaccacgtcatccggcgccggccggagcttgcccgtgtacaggtaacccagcagcgacaggaaggcatcgcgccccacgcggcctcccggcacgagctcctccatcttgtaccgcggcctccccccagtcctctcccctcccccaccaccgccgccgccgccgccgccggcagccccatcgccgccgcggccgcgcgccgcgaagaggttgtagaagaaggtgctgcgggcggcgaggatgcagcggtggactggcacgggcgggccaccgtcggccacgtcgacgtcggcgtcgctgcagtcgaggtcggaatcgaggaggagccgctcgaggttagcgctaagccgattcaggctcaccacctccacgctactactccctcctcctcctcctcctcctccgccgccgccgccctccccggcggcaaccggcgccgcctgcgccgccaccgcccctgcccccggcggcgcaagagagaccgagcacgggctagacccgttcgagaggtacgaggacgacgacgcgatggtgatggacgacgagggctccatggctattaccaccaccgcgctacgcgccggcatctcactgctactaataccaccaccaccactactactcgtgccggatcaccatggcgggttcggggaatccaaaggctcccccactttccggcgcctcccgggccaaaccacccaattccggcgctcccccctctgctcgtctccacgcagatccgcgtcggcaaacaagctccccaaaccaaagtaccaaacactttcgaccccccgcctgtttgggaaacggatctcggagagagggggagagagagagagagagaaaaagaaatccttttctttcctcgcgagcggccggagtggagggaattatttggaaattggaagcgactgcgacctggtggtggtaggggagaagaacagtgggggtcaaacggaatcgcggggaggcagttgcgaggaaaccaggggctttggctcgcggcgagggatgagaggaggaggaggaggaaaaaaaaatgggaggaagacgacgaggacgaaggggggaaatcggagggaggaggagaccgatggatttgttctgtctgtcctctcctcggtgctattcatttctttttccttttcttctgttgggatcgagttggaaaagaattcttcatctgggaccttttaaaaatggttttttagtttctttttcatactggtggtatataatttagtgagttgtctaggaggattttgatgggtagggtcaggtgtggggaggcgaggatctttttgttgttgccgtcctctctcgtgcctttgggaaatagtatgagtaaaatacatgtgaaatataaattagagtgtgtttgaggctacgaagatgatgtcagcacacacgtaaaatacaaaaactattaacatatgagtttatattattataaacttgaaagtatttttattttatattttaaagcaatttttatacataaaatgtttttaagaaacacatcgttaagctgttttaaaaacatgttaaaaaaacataggtaaaatatgtatcttaataaaaaatatatactgtaagtaaaaaacttaaaaactagtaatttttaaaggaaaaggtatactttattttaaactcacactattcataaaagaatattattgatattgtttaagataatcaaagatgaggaagagaagggagtacaactgggtttgaaggttaaaacgaaaaaaaatactattaaagatctaatggacatctacttagaaaatagtctctgtgaaacaaatcttttaggtgcggagagagtacatacatcgctacacaaacggcaagtctatttctatttagtgtttgtgattttagtcaatctagatccaatagtagggttatttgtcaaccagtattagactcttttctatgagtatgtggtacaatagagagtctacaaaaattccattcatgtgctgtacactcacagcatcaagtaatttaaacgtgctgtaaaaagccctcaaaatgtgcaagttcagatattcctatgcacctagtattagatattttattgagcgaaaatagcttaaatttttccagtagcactactgttcagatcagtcagcatccaacacatctccttcatttctttttgccatacacatcacctcaccccccggtcaccccaccgggagtctgtacccttccttgccgtgcactgcggccgtccacatctctctctctctctctctatctctctctcgtctcgccgctatgccgtggcatcgcctctcttcacacgcctttcctgtggcgttccaccatacctctgggagctaatgatgttgggctgatccattgatcgaacaccacaaaactgactagagatctaaggcattcaccgctactagcctgcaccaccttgtctcggcattaccggtcattttcgtcgaattaaacacgatcttgttgttgaaagatcacgaacatgaggtgaccctaacaaattactagtaacacatccgttataataaaaaaaaagtacagtgtacggacggttcttgtaaggtgtgtcatccagattcttaagctctcaagatatatattcaagttccagaaattgtcctagtgtgtcatctagatctcaaatcgccacaccctcttcaagatcctacgtgacgttgatgtggcatgccacacaaatatgacgtggtgttattttgactgacaaatgggacacatttattttttttttctttttctttttttcttctctttttcccctttattctcctttctctgtgacccgagcagaagaaagtaaaaaaagaagaatgagaagaaaacggaaaagaaaaagaaaaataaaagaaggaaaaaaaataaaaggacacgtcacgtccatgtggcacaccacatcagcgccatgtaggatctaaaggggatgtgtcaatttgggacttagatgatacattttgacaagttctgagaccattttcagagtttagggacctatatgacacaaccctataagattaagaaccgctaatacactttactctaaaataaaaggtatagtaacttttggtcatacttttagaccagtaaaatcattttcttcgtgataagtatgatagcataagggcagtcccaactcatagtgtccataagcagtgtctatggtgccatgtcaataagacatcacaatagaaactacacttcacaacccatgatttgttaaagtgggccattaataaatacaccatctctcttctctaccaatcatatttattcttcatctattatgaagacaatattctctcccaatgcaaaacttgatagtgtctagtgcataggttctcgtgttgaagctgtgttttgcatgagacccagtttcttcatctcttcactctctctcttaattaatatggtaccacataagttaaaagtcctacatggcaatgtagttaatgctataagtactatcctaaatagagagttgggacttccctaattcctattagaccaaacaagtgagaaatttattggtctagatttgagtctatcctgccagaagagcggtaacaaggttgcgtttaaatgaggggttagcttatacttatccgtaagataaatcattattgaacgactacttatctattaactattacaaatttaaataataatgttatcattttaaaataattttttgtataaatagtttttttgaaaaaataaccgttcaacaatttggtagcgtgtttaggttgaataagaaagtagttcaatccaaacgttaatgttgtcatgttgatcttgtgctcgaagaaaataacagtactccatctattctaaaatataataatttgtaaccatcaatttgaacaaaagtaaaaattttaaaatatagcagcttaaaaaataaaataattatgctccttcatatttgtagttaaaattactatatattttagaatcggtgtaatagcatggattgtcaggattagttttactgttccttgtggttatcctcatagaaagcggccggacagatggttatcgcgacgtgacatgtacggtgagaggctcacgccatcacgtcgtgccctggccaagagaggcaaacccccagcgttatcctctcctactactccttccgtctcgtaatagatgacatttttgattttttatttataacgtttgaccattcattttatttaaaaaattagtgcaaatataaaaaaagataagtcatatgtaaaatacttttgataataaagcaaatgataaacaaaataaataataattctaaaattttttaaataagacgaatgatcaaacattgacaaataaaaacttaaaaagacgagtaatatgggacggaggtctccaaagcacaggtggcggggcagcgcagggcagaggccgcaggcgcgtgtgtgtactgtggataggccgtcgaaatcaccacctcctcctctcctcctcccaggctccagctcgctcggtcggcttccccgtctttgcgcatgccgagccgatatgtcccgtaggtacacgatacagaagttgccgtaacacacacaccgcgtgcaacgcaaacggcgcaggcaaaaaggaaaatccgtggtcgcgggacgcggagacgcaaccgcgatgcgccgcgatctccccaaggtttttttcttttgctcggcaactcggtgcatcttgttgcctggccggccgcagcagctgctgctgcgctgcgcgcgactgtttttttagcggaaagatggcatcggcccggtttttttagtacgtaggagtactgtattgactccctccatcccataatataataatataagggattttgagttgttgtttgtattgtttgaccactcgtcttattcaaaaaaaatttgtgtaaatataaaaaacaaaaaattgtgcttaaagtgctttggataataaagtaagtcaaaaaaataaataataattttaaatttttttaataagatgagtggttaaacagtgtaaataaaaatttaaaatctcttatattataagacggaagaagtagtaactacgggtgatggttagatcttgtgaaaattgcaggaatacgtagtttagtcgtggggtgttaataaactaatgcggtcatggcaaagttgaccaggactccccgacctttaaagtcgttaagacttggggactaatataaaacactcctgagatgggatcgacagctctcccccaccggagcatttttagcaaaatatgcttacgcttgcgaatggcgaaagcatcaacctttctttgcgtcctcaaaagagagagaacttctttgcgattaaaaaaagcagcagctattttagaacgtagtaacggaaacacgatgtactgtactgtactattttatttgattgattgattgttgactcggctatacgtggtgtgaatataactttgctaacgccatgatcccagctcagcatgctcataaatttatcacggccgatgtcagcaatgagctatatcgaaacctgaatcacaatgtaaggaagtaatctattggtctatgacgttttcacttgagcacccgggcttgttcccttcattgtccctaataaacctaagggctccttggttgctcctaattaacgtaaggactactaatttattgcaatagcctattagtaccacgatgtttatcgcaatggttgccataaaatttaattttgttgcattagttctatattacaacgaatttaagagtcctaagatattatacacaattgtactactctgttaaaatcagtactactcttattgtagattacttgtcattctaatattcatattttgtatcgaaatgcttcactctcacatttcgatacaaaatgcttcactctcacatttcaaatgagttttagaggtggcattccatctctactctgtttgtcaatgcaggcaactactgctactttaggaaacatttgggatatagttaatgagggtaaccttgttattagagacatctacatgtttaatgtgaaatttgctaaaatgattgataacattaaacgaaaggtagcaatagtcctttatttttcacttcttatctacaaaattctccctccgtctaaaaaaaagataaactctgggtttccgtgtccaacgtttgactgtccgtcttatatgaaattttttttataattagtattttcattgttgttagatgataaaacatgattaatactttatgcgtgacttgtctttttaattttttttcataatttttttaaataagacggacggttaaatgttggacacggaagcctagagtttgtcttttttttgagacggagggagtataattgctaaagggtctatgcgttttgctattgtagcaatagtcctttatttcacttcggatgactctatttggatccggatcaaatgcagtagtagtatggactgtaacttaagcagctgtagctgctacgttggatctaaatccaacggtaaggattaggccggttgctgtagcaaaagtaccacgacataaaatattgttcagggtactatagcacgagtacggtagcagttgatctgtactgttgatcacaaaaataaatagctgaaaatggatgcagtcctaaggtgcagtcgcaattacgactgcaccgatctcaatccactctatatcgtattctggctttgtactatgtcattggagaggcaggagatgtgaagttgtgaaccattccaattatattctacaaatatatcctccataaaacaataatctgctgacaataggaggcaattattggtctaatcagtagtagtactggtcagatgctgtatactgcgatgatcatatcacaaaatagtttcgcatgacagtatggcacgagtcgtcgagaacgaggtagtacggcgaaaacatgatggcgccactgcccactggtcgatgcccgtacaagagcaaagccttttttcacgtacgagtattaaacctgccattgggccattaaaacacgtcgacatccgccagctatgtaacgtgatgggcgtggcaaatccgtgttccaaacgggcggatgttggcacctgctagacattcaatctcaggtcaggtggtcctgagagacacgtgcattacggagtactacaaggttgctacagtgttattattttttgggtgctagtagtgccccattggtacaagagcaattatatttcactcaatttctcttcttcacgaagagaagagaggccggtcctggaggagcttctagctgcagtttctctcggaattgctgcagttcctcttataatcagaagctccctaaatagtctagctttcaatgattctgagaagctatatttgtaaaatcctgaaaataacctaaaaaccagaagttgtgaaacccaacttttccagattatcaggagctcagctgcttatccagcttcccaacaggcccgcagcgtctctgggtgcgactgctatctcaaaccagaacgggaaaatttaggcgcacggcataacatcactgtggttacacatggcatggagaatttaggcgcatgtactactagtactactgtactactccagtactataaaagaaccataggtcgaagaagggaaacacaccacttcttcacgtacatcatcagagcaaaacaaaagtttcagactaccaacctactactcctgtatggctgtatgagggacatcagaattcagactcccgttgagcctgtatgggtcactcttccaacgagtacaatttggtggttagacaccagtggactgtggcatggcatggcgtcgccttgccatcagattacaaggcacgctcaagttgggaagcagagctgaacagaatagcaacgtgcaccgaacaaaggaaggctgcaagtcaccagcaaaacagcgtttctggattatgatttcagctcaaggcatcacgttgccatcgtatggcccttcaacaaaggaaggctgcaagtcctatttaactcccggccaagacagcaatcctttatttctgccacaaaagcctttcatccaatattccagcatagccgaaggatctgcaaaacgcggccgctagtccagagtcactgtgcaccgttgcgctgtcttttgaaagtccgtgctgctgaactcccaggtccagaattattacgttgaggatggcgagactgatcaaatctaccgacggaggtcctcgatgaccgaatatgccctgaagctccatctggatgattaaaggacttctgaaaatgaggcgcattaagaggtttatccgataacaaagacatgaggaaaccgccaggtggaatataaccgactctacgaccctgagagaatctgcttgattcagctgaactttggtttgaaccctgacttgtagcaacatcatcagatgtaatcatagcaggcaagccatcgtatgataggatgcacgcaatagcatacatagttgctccaagatcaggtgggaggacatcctgtggatgtttgacctgagaaaaataattccattttttttcagaaataattggactataaaggtactaagaatgatgcagaaagcagtatgatgatctattgatccagatccattatctgattgagacaactcagaatgaacaacggaaggcaatgcagtctatctacatgccttatagatttttcatgtatgcttattatccagatttctgcactggagaaaaatcaacacaatatatttaaaggaaaactcgggggtcagagtgggacagtgggagtgtgcagactgaaatgtaaaacaaaagtttgctaatatgctggcaaccatgcatggcatcttagaaaacattggatgaaagagagaatacaaaaggaacaagttgtattgcattaatcaagcttaaattagatgatgcaagatataaaaatcttactttgaaaagaatagctgatgctaggcgctccctaaggcagtatatttgagcaacatcaagagctgtagcatcaaaccgaagccatcgatcaataacaactgaaacagagttatcaggagaagacattatctctttatgttgtcccaaagtgactttctcagtttcatcctcactagaatccccatcctcttcatcactatcatcgtcctcaggtggagcaacaaccatttccgtagcaagaataattaaaggataggacccaacaaccgaagagttttttatgtacattccaccatcgcctcgagtgatctcatcatatatcactaatgggttcccagaagtcttacggaaagacaagttaaagttgcaagaatgtggatgcagtcgaactttggcaccacttgctgtttcaatgactgctcttctagtatttttgcgagggggaagcaatctccctaccattggataagcaccggccataaggacagcacgaatgatacctacagaatttagaagtcagttaagtacaatagaacaattaaaactttgatgcaataaagcataatttgttaggaactaaggaagattgatgaagttcgggtgacaactgattttactacataattttactaagaataaaaatagaatccagcaaatactctaaaaataattttactacaaagaaaaggcaaggacgatttgctcgtgaattagaagtaagaagaaaattaaaaagattgaacggggaaaggatggaaaactctacaatacagtgaatgatatatgtaacttagtagctactaactttagagtgatatatgt

SEQ ID NO: 58518 - DNA, 58900 bp, Oryza sativa
cgcctacccatcccgcgcacatggatccaatgcatggttctagtggcggcgatgggagacggggatggcggcggcgatgacaacaaggatgaatctcgggctcaggagctgctagggttctagattttttttttgccgttttttctttttgcagcctgacgatttatgtacccacatgtgaaaatacaattttcggaagcggttgttctacccgcatgcaaaaatcgcagacacctggatgtaggcgggctaccccacccgcctacgaaaatcgattatgaccatatgaaaaaatcatttatgtagtagtgttatgttttttgaacgaatcgataagcgccaatttcattgaatagagtttaactttacaagaaagggagaattgctcttatgcccttacttttaaacccaattgtgattttactctcgctttttaggatttttaaatttacccctaatattttgaaatgaaatcaccatttacccctacaatgacagttaggtgggttccactatattgagttagagaattggaagtcatcaaaagagaaaattagtttaggaaatattagattaccgttctatccttaagcaatatcatactgattcattcatacctattcggtcagatttgttccccactgttcctatccgcaaacccttggggttggggaggagatagaggaggaggaggcggcgattcttccacacagcggccggtcctcggcacgagcaccaggaggcggcgccgcgggtggagaagctccggtcaatggtggcgctagcgacgcgagcagcagcgtggcaacaacgtaactcgtcggcgcggcggccctcgcgtcatcggcacgagcaccaggcgacggcggggcgggtggagaagctccgtccaatgatggcgcccggcgatgccagcaggcggcacgcggcggcgctggtggagaagtttctgtcgatggcactggcagcaccgacgacgtctcctcagcgagagcaccagctggttgctggtgaggcttttcttggacgaaaagctcacgcagaccgccgtcatggctgatgctatcgcgatctctagcctggagtaagacgcgccagaggtggtggactgactgacttcttcctaagtattttgcttctgtatcgtgtatagcatcagtactctgtagcatgtgtgggtttgatgcttgctgctaattaaccagcagattatgaatggatttaactgatgtgatatgcaggcatactttggttgatctcccgtttgccatttaagtcaaaaaaaatgttaaatttgtcatatttatcataatttgtcagaaatcagaatagatttgaaatattttgcatgaaatctcagttcataacaaatgcaaatgtcacgtacaaaataggagtaaaaaagagtagttcaaagtaggggcaaatatgcaatagcaagcaatgatataaaggtcttttcgcgcttgacataacaccgttaaactgaccatccaaaccagggacaaaacactacttcgttttaaaaaaaaaactgggacaaagacaaaaaccctaaaaagtatgagcaaaacaacaattaaattgtaaagtaaaggtaagaatgcaatagcccctaaaaaaagagggagcagagaagactgtaccgaaaaaaaaaacctaaaagcccactagcggcaaggtagacatgttgctaacttcctggtcccacaagggaccatgttgtggtctcctccttgattttactgactagcccgattgttgacagcttcgtgtgttggaagattcgttgttttttttctttcagatctcccaattgatcagtagtgttagggtgcgtattgcttgcttcaacacctctctcgtctttgcaatcgcctcccaccactcctgcactatagtggcttgcctccactttgtgcggtttagattgtgacatgaaacccaatccacaatttccccccaaattctcctagtgtatatgcactctgctagaggtgcagtcctctcttgcgtctgccatccctttgttgcgagtctgtcggatgtccagaccctgttttcgatcactagccaagtaaagatcttgcactttcatggcgctcagggtttccagatgagtacgtcaaagtccgattttgttgaggcaagaattgtgcattgtagatcgacgtcgtcttgtactcactgtggtttgtaagcttccaggtaattctgtcctcttcactctctatgagttgtacaatttgggtgatcatcttagttgtccagccaacaccggtcagtaggtcggggtcaaggaggcattgaccgttcctgatggcctgctgtagtgatctattctttttcttgatgctgcacacactagcagggccatgtctttcagtctttttccctgcagttaggcggagtcccagaactttgccctagcttcgttgcctattgttattgttgttgtcactgcgaaaagtagtttgacgttttctttgcatggggtttcagatccgatccacgccttttctggtgatttccattcatgcagggattataacactactacatgctagagcacgagacgatggccgtcctcgaccttcacactggtcggtgatgatgggctgctgtaacgtctatccttcgtgaggcgttaaaaactaatctaatgaaactccatccgtaaaaaaacactctttggtttttatgtcgtataagttgtgccatagatgccaatccagatcctttcctcttgatgccaaaaatcaactagtactcctcaatattcctattccagaataatgctagagtttgaattaattcccgtatattcgaatttcttccctaaaaacttatccgcaaaattcctcatattcaaatctgatatccgttccacacttgtcccccttaaacacttctgtaaattcaattctcaggtttgaactccccaaatttacactccctgtggaatgcttcccaaaatacagtctcaagcctgtaaaattaattcattcccaaaatatccaaatgtccactttggttctcatccttgactcctctttcttttccccgagcccaaatatcaattgaattcatcgaatccaaatgccgtattaattaggtattcaaaccaaccattcaaacaaatccctgaaaatagtaaagtatcactattcatctggaccgtttcccctcctcctttctcctaaataagcccaacccctccttcctgtttgctcctttacattccactatggaataagttcatttgaggtcccttaactttacaacgaatccgattttcgtccttggaccccaaaatcagatatactcggtccataaactttcaaaaccggtgcaaacgaggtccatcggcggttttggctgacgtgcgcctacgtggctggtttaattaggtctttgtcccacatggtattgacgtggcgcttacatggcaattctatcctggaaatataataaaaaccttaggtccatatgtcagctacacacaaaaaataataaaaatggtggggcccacatggaccccacatatcattccctttccctcttctttctcaacctcactcctctcctttcttccagccatggaaccagctcgccttcctccccttcctcgcacactcgcggcaggcggcccgacagcacgaaggttgtggccgtcttcgggtgcttctcctcgcgccgcagcaccgcctcacagccatcgccgcctcatcttcctcctagtcccagttgccgctgccgacaacgacgcgtggtcgtctgggatgacgcagtcacgcaggccaacacgaagtcgacgagggggacaaggtctctatctcctccctttcgacccacggcgacgagaggagaggggagaggggagaaggaggcaccgccatctgtgggctggccaccggttgctcagcgtcgtccgtagcgccgtcgtcgttgtcgttgtcctcagccaccttgcccctcgcctgtaccacgaccgccgccagctccgcccgccacccaccccagccttcgcctactccggtcctattcttgcaggagagatagagagagaggggatagggagagagcgccgcagcgtgggcctgggcactggaggtgcacgcactgtggaaggacttgacgcggcaggtggcgccggacgtcgcggcgcgccccacctcctccctccctaccctaccccgctcaacgtcctccttgccttatccttctctacgcccgctccggccaccgctcgggccgctccgccggccggccgatctgccccgcctgtagcccacggcgacgagagaagagggaagagagaggggagagggaagaagggagaattgaggtttacatgtgggcccacgatttttattatttttttgagatcgaattgccacgtaagcacaatatcaatgtcacgtgggacgaagacctagtcaaaaaagccatgtatgcgccaggtcagccaaaaatggcttccaaacaaccaacggacctcgtttgctccggttttgacagttcagggaccagttgtatcaaatttttgggttcaaggacaaaaatcggattcggtgtaaagttaagggacctcaaatgaacttattccttcctctactaggccacgactccttatccttccattggtctcagcccaatccagtatagatggacaaatgggccacttggcctagcacgatccgacaccagtggagccgacatggctctctcaatggccgaaccgggccatgcccgcccacgggctccacttatagcccagacacgacccaataagagttgtgttgtgccggaccggcctatcgtgtccctcctcattgagttgtgccttatatatggcttgaataagtctattgtgcctcccttctctatgggtcgtgtcttatatatagcagaaataagtctatattgagtccctcctcgttgggtgcttgaagtaagtctattttgcctccctcatgtctcgtgccgtgccgggccagcccactgtgccaaggcagcggcccaggcatggcccaactgtcaggccgtgccatgcttgggctgggccatatatggccaactatacaacccagtcaatccgtggcccctcatttcttctccttcttcttcttcttccatcatcttgcgccaccaactttgtctcatcacactatgaatttcctctaacttccccttccacctagctcagtgaaaatttccatagccgcactgcagtactaggtacgatacatatgcagcgttagaaatactttccgaccgacggacataataaaaatgcatggaattatattattaattcatgaagatataggtagagagtagcacactctataagcacacgtactcacgcaattacagtagtagagacattagttattacaacaaaagaaagaaagaattaaagaaagagtaggaaaaacaatcactttgatgcatgcatatatatgcatccaaattaagcaaataattaagaaagcaagcaaatacacataatatatatatagctagggccttgggatggacatggaccccaataatattgatcgaatttgtgctgctttaatttgggggattactacgggtggtgttcaaccacgatttcgtggcgatctcgggtaatgccggtgtgtgtcgtgagagcccaaagcacggtgatgaactcgcctccttggcatagcacattcctgtgcgccatgatacgctccacctcgttggacgcagccacgtacacgacgatctccgtccacacctccgccagaagcttccacatgtccttttgtaattgtagcaataatgtggccaactctgcgcccttgcgcacgcttccctgtttcttgctgttgttgttgtcgtcgtcgttgttgttagccggcgatggattgacgatggcgttggcccgcttacggcctcgagagaaatagtagtggtaacagccgagcatatccttgagctccgtcttcatgtcctggaacaggtcctccgcattctcactgtagtcggggaggagatccggttggaacaccaccaggtaagcgcagtacctggacagcgtcagatcacttgattcaatctcatgtgattcaaggtttgaggatccaacacttaataacttaaacatgttatagggtatttctgtctaggattcaatcttccttgcacatatatgtgtagcgatgatacttgtcgaggaggttaaattatgaccttctggttcttctcaacattgaagtggtcaaatttcttctcatatcttcggaataaagctgatgaatgatctttgtatgttactattggattcaacatcttcctagacaatattttcttccaatcttttgtaatttctttcttaacttagatttcagaatctttgtctttactatctcataatttcctaattactttgtagtaactgatctcctgtattcccctactacattctttaactagatattgtattccttatggtaactaaaatttctcccttgtttgaataacatccgatattgaacttcatattctttatctgtatctgattattttctttaatggaaattcgtgtcttggctgcttatttggagttacatataaagaggtctatgctagcaatcctggtatataattcactacctatacttaagaaacatcgtgagatatttcaaaatccatgtagtttaaatggtagtgaatttatttccatggttgcatagaattatttccattcagtcgcacttttagttgctattttattcttcctgtacatcgaaattcttgccttcaaaatgattggcctgtagtatagctctttgagttgaaagtgtttaacaagacacttttctttcatggttttcttggtatctagaaaattgataacttgtgagtaagaaaatttttcataaatgatttgtgtccttctaatccaaatatattgttggtatccattcaaacttcttgtacatatctagagtgcaaacctctagctctagtcatgaatcttcaagttgtgtatagtcatcaatacctaggagagatcttgttcaagaaatattctcaatcaataattttgtgttgtctaattattttatccttgttgattcatgagcttctatgttgtttctcctcgtgtcaaagaaattgggaattcaatctttaattgaagatgaagaaatttctcgtagataatccatatccttttatcccaattttattgtcaatatccgttcagactcttggtacttgttgaaattgcaaattttcttcctttaatcatacgtttccgagtagcgacataatcaactatgtctagaaaggattttgtacttctccaactaatatttttgtatccttaaatttcttcagatctattctcctgttctgatatacccatttatatttttggtataaatgagtataattggtttcttcagcattacaatcttgactcttagcgggttcagatccatctttccagttcagggtcttgaataaaatatctctattattgttcaggcattgataattggttatctctggccttctttgtcttaaccttaacttataatctctaaattatgaataatcatgcttatgtgttgtaattaccatggcacataagtcactaatctactttcttgtataagccttcattctattctttctacaccttatcgtaataagactcaggttcatccattcagactccttttgtaggtcttgatattttccgttcagtcacgcttttagcttggcagagaaagctatctttaataatgtagatgtatgtatactctatggaaatgtctccataaagtgcagcgataaatattccatgaatattttgttcatagaatatcttggggtgctgcctagtcctaagcttgtttccataatgattattgtcttgtatttaatttggtaaatgctaggtagataaaatctcttgcttaactccttagcataaagtgttggttgcaagagtacatgtgctgacaatctttttcaaaatccaatatttactgtacctttcgaggcttcacttattcttctccacgacgaattgttcatcttcaagttatttgtcatacagagtatgcaactcctatacctgaccttaaagtccgaaattaccttaaccaataggagttctcagcttcttggatttgtcgctccatatactgctcaatcataatgtggtatctataggtatatccacctcttgttgtacttctatagctttaaattagtgcatcttctgaaaattggctctacctatggtttatgatggcatagagatctttgtatggatggaagaggtcattctcttctaggttacatatatttctaagtagggtagatgatggtttgggtacaaaatcttgtttgtacaggttattcaatggggtttggccttgactatagaatttgtacaggttattcagaaggtttggaagtggaggtggcttataactggttccggtggctttcatgaatcttctcggttggctgagtgtattcagagtgttctccatgaattggaatggttgccatcatcccatatctgttgatctccatatatttcttaaatttccacagtcataggttcttcaaccggatttctattatctcggtagttcttcatttgaaattgctccatcggttgaacgtaccttcatagccctcaagtatttgaattgtcacttggcttcataccgtaagtcttcttgatgatatagacgttgacgatagatcttgttagggtttaagagattaaaactatcctttaccttgcatgaaatcaaagcataaaatgggacatcttttcttttgatctcgcaaattctttagtccaacatatttctcataaatatctttgtcatggcttaggcatgtagaatgtcttgtggactagtaattcctcaaatcttgtacatcttgttgcttggattgcaataattttgactcatgctaacataaccaaaggcttttatttactgcccttctggaaataccaaggactagagtcttcggagggggttatattattatagtaaaatagttattcttttgaaaggaggtatgatgcacaaataaaagcaaaaaataaaaccaataatgaaggggagttcattctaataaaggccttagcaaacttattaggcaaaattttagtttttaacctaattatcctatataaatgggaagttattcataaaggggttagacaacctatgggtttaagactataggaaaacatatactctgataccagttctgtcgggtcccaaaactaatgattctgaaaccgacatatttagactgtatcaagccctggattagtagattgatacaagttcaacaatctggatcgtctttgcatacatttaaacatagctttgaaggagattttaatacataaagtaatagggcgtttacaagcttgtggctaaccattacagcagaagctatagaatgacctaactctgctgttttgctatagacttaaaccatctaaataatctagacttgaggactaagttaaaagggaactaacttatgtgattgaactcccggcttcgataagaactccaaaaatgactctgaaaaaggggggttgaagcaagggtgagtacaacgtactcagtaagctattatattaatcaataatgaatgcatgaaatggtaatatctgtgtagagctaggtttacttgtggaaagcagaggatatagaggaagaaagcctgtaatgttttaaatgcaacagtatttaataaagtttggaattaagtttctaaccaaataccatatgagtcccgatgctcaaatccgtgagcacagctattcgaatagtttcatgaatattcatactgcagtagatgtacgctttacccacagcccatgacttgttgataatcatcaatttcgtcatggcctagtattagattactaacaattgtggcacctgtttcattaactctagtccccatgcgctctgaacgtacgttatcagcaacgtgagaagttctggcgtttccgaggtatttaagggggactgatcgtatgataccatgtcatctcgatcagggtttataaacactacaacgggatcgcttatctctaacgggcataatacctcatcactttcgggtaggccccccatcactgagcaaaggtcagtgatgtgagaacatatctcaatcgggcatccgaccatcacggatgacacacatctcaatcgggccaacactatagcccgtcacggatgactctcatctctaacgggccaacactatagcccgtcacagatgactctcatctctaacgggcctaaattatagcccccgtcacggatgactttcatctcaatcgggcctaaattatagcctgtcacggatgagtataatccacaaaaaaaataaattttgttttttggctagcctcggacctttgctagccatgctcccaagccgggctcactcgtgtgcacccgggctgcacacttgaaaaaattttccggtcggtcacccatcccaaaattgctccaggccaagcacgcttaacctcagagttctttggagatctgcttccggaaaagaagttatacattcattcacatacacaaccatcaatatatttaacacaaccacgttcacataacatccattttgatcacatatttcacatccattcacatgtttcaccagcaaaaccgacttaattggagcaaatatatatatttagcaagtattaacacgatgaggaggaaaatcagacttctaggcaaaaatgaatttcgaaatgaattttatgataataaatgaactcatatgaaaaagttgtcaaaaacattgtttacaaaattcacatatctctcatctggtcttataaactagagaaaattccttgtatacccctaaaaatttagctaatctcttctatacccttgaattttacttacttccttgtatacaaccaaaatttgattttgatcccttccatacccctcccgtcagttgaccgttagttgaccatctaatttctataaaaatgaccattttaccttcagatgaacatataaatttatgaattacattattaaaaaaaataaaagcttctcgcatgagactatcatagttatgagtttgttgtgcgatgcattatttatcccaaaattatttttatataatgaaataaaaatatgtatttattttttaaaaaaaatcataaaaaatgaggagcattcatacaagataggaccaatgttcacaataatggttttatgaatcctcccgataaaaaaaatccattgtcctattaaaatttcaaataaaaactttaatttattacttttgttttattttcaaaatttatgtcaaaattttctgcattaattatttagtctcattagtttcataaaatgcacatactgcgcactcaaacaaaattttcaattgtttctgaaggttatattcaaacctaaagcatcaagggcaaaaaggtcatttgcaaccaaacgtcatagtgaaatgatggaaaatgtaacggtaggggcatggaaggaatcaagttgaaatttcaggggtatagaagggatcgggtaaatttcaggggtacggaagggattgggtgagttttcaggggtacacatggaatttactctataaactataacacagatatgtaaattttgtgaataatgttactaacactttatcggatgaagaaatgacaaaaataaaagttatagatcttgatgagttatacaactttgttgttgatgactttttcagttgaaatcatttagtatttgaaaatattgtttgaagttgtcatattttcaaattcaaattcaaactgttcaaaaaaaagttatatagaaaaatgaccaaaataaaagttatagatcttgatgagttatacaactttgttgttgatgactttttttagttgaaatcatttagtatttaaaaatgttgttttgaagttgtcatattttcaaattcaaattcaaactgttcaaaaaaaagttatatagaaaaatgactaaaataaaagttgtaaacattgataagttatacaactttgttgttgacaatttttccatttgaaatcatttactatccgaaaaattattttgactaataaaatgaattattatactacagttaattattttgttacaggtcaactcacaaatataaatatttcatatgaaaaataaaaaaacactaagtcatctcaatcgggcattttagtatagagcctgtcacggatgagtcatctgtgacggacctagttgttatcgattgagatatggtcgcacccgtgacgggcaccaacttggggcccgattgagatatggaatgttatctcaatcgggcctaaactacggcccgtcactgataagtgtcatccgtgacgggcatgagttttatgcccatctaacatgtttgtgcgaccatatctcaatcgggcgttttttcagcccgattgagatgacttccttgtgacggcccgctaattctagtcatgttaaaggccgtcacggatgaaaggatactagtgaaataaaatcacatacacagtgtgcacgatatttacccttgctcgataaatataataagagagaatccactcagtgccactgagtttttcccacttctacaatctaccactgactttgtcaagttgaacaatatgccatcgtgttttcccaaacatctactaagtgccatcgccatccacaagccgttaggatgcatccgtttagtgtattgattttttttcttaatgactaaaatacccttaccttagcactttgactgaagaccctagccgtgcaatccccatttgatctgcccagtgtgtggcagcgccgactcccatcgatggaaggccagccgcccgagactccgaatggtggcgtgatttttcgggttggaatggattcaatccatgggttaaggtctggatcgatccataaatcacgaccaacccactcgctcaggtcatgtgctactagctgtgctctcctcttgcaggtcatgtgcttgctttctgcctcccccattatccatggcggcatggcatctctgctgctggcagctgccacgccggcggcagcggctatgcctactccacggaaacgagacgaggtgcccggtgccccaagggaagcccggactgctgcgtcgtcggcaagcgctacccgcggttcatgtggctcacagccggtatcggacatgcgccggcgatcccgacgctgcatatgtgcttccgccggaacatggagctggtcgtcgagctgtactccgggtctgggtggctgtgcctcgacgacggcggtggtggcgcacgctgccgccgctgcaacgggaggatccgcgtcgtcgtcaccgccgccgccgtgaatggacggtctgtcgttgtcagggtggtggacgagtgtgactacgtgaacgggtgctgcaacgaggacggcttcgcgcccccgtgccaggacaacgttggcggcgagtcgctgactgtgtggaagaagcttggctcaacgagaacaggggcaaataggtctttttacagctctaacagatgtctaactaacggcttatggacggcgatggcacttagtagacgttcgggaaaacacgatggcatattattcaacttgacaaagtcagtggtaaattgtagaagtggggaaaactcagtgccactgagtggattctctcatataataattgccctgctcggcatatagttgcctcctactcgatgacttaaaaaaagaaccactgtacagaggtactaccttgttattaacataatactaaatctatccccatacttagaactatggtcgtacccgttcgttcttcacaagtacttggccagtcttatgtcggttggaacagtactagccacccggaaatcaaccaattctaccgtaccgttccaatctaagttcattatatttttatgcagtctaactaggcagggctaagcaaaagctagcatatctggtttgctatgttcaggttatgcatttgaaatcatgaatgactaatgcatagaatagaggtatagaatatagggcatttatgctcaaaaaggaggaataataacttgccttactccaacgcaaataaatccgagataggcaacctgattatccgatcctcgaaataccacaggttgccatccagaataaaatagactctactgaagaagaggaagagccaaattcaataaaaatctatgaaatatcaaaagaacgataaacgacttaggaaggctagggtttagggtataatctattcctttggtagggtatggggattattgggctaatatatcatgtataggttcctaagggttggaggttagggtagagaggattaagtaactattgtcgcttgtattttatgtgcaggttttggttggtggaaggataggaagtagttggataattggactggttaagtgggtatatggctagtatttgctggtggtaggtttaggtagtataataggtagggtttagttatatgggagttgattgtggagtaggacagcatatcggctaggctctatatgtataggttttggtaggtggagagtaggtggctgagagtatggtggataggtgggtatggaatttgggtgatgacgggaattaactaggaaggtattggttagggtttggttgctagtcgttgctagagttggacagcataatgactaaatttgatatcttctctagccagtgtcatcatacagcataacgactagaggaataggaagtttgtgtaggaagtgttactccgacaaccgtgagtagcaacggagcggttaggatcacacagagcttaagagctaactatgcggtgtgtagtggaggtcgagggaatagtgaagctccgaccattgtacgcattaaggcgtaaggtgccaggagcagcatttcgaccttaagtttggttttgccggacttaacaaccaacggttcgacgtcggagtcaatagaccgcgaacgtccccatggaaggggtaaagttctaaccagtggcttttagtggctaaagggtatttttaaaataaaaggaaatatttgaaagttaaatataagtttcaattataagtttaaatcaaatatttattcaaatggtatttgaataaattaaggaaattcaaataaaatcttaaaatagcaaatttggcatcaaaatgtagattttgaatttagatgaatttaggtccaagttttactggaatcggatctacggtttaggagatatgggcttctaaagaataggatttgaattaaatctagaaaatataaagtggtactgtacgggggcccacctgtcagcctttctttttccatttcttcttcttcttcctcctttcgttttcctctctgtctcacagtgagccgagagaagagagaggagaggccgagtggggcggcggtgctccggtggctgggaggctgcgacgttggcggtgggttgtgttcccgagcgacgcgcacccggggagggtggtgtatcgaagagaggaagagggatgtggccggaacggcgagtagaagagtttatcttcggtggtaaagagagggggggtggtggcttgatacaaaggggaaaggaaggagagatgggcaaaatggattcgctggagtggagccagcatagtggcgcaagggaagaggaaggggagctacgaaggaggagatcggccgacggcggcgacggccggacatggatggagggagacagaaaagagcttcaagctcgatgtggggaaatgatggggtattgccggctatttataggcggcgaagggcggtggtcaatggcggtttgcagaggggaagagggagttggccttggtggcggcgacgtgagaaggaagacgacggcgccggctgtggcctgtgattggtcggcgacggcggcgcatacacgcggcggtcgcgggagggttgggtggcggcggcagtggagtgcacggcacggagatggctttgccgtggttggcaaggcagcggcggcggcaagcgtacgcgcgccacgcgcgcccatggcgccggcggcagcgcccacagaaaaggaggcgacggtggtgcggctgggagttggatgggccggtttgggccgagaagggagatgggccgaagggagagagaaggggatttcagcccaatgacaaaaaggaagaagtctaatttgaataattgatttggatggctaggttttgcaaagaatttgaataggaagttttggaaggaaatttggcaaaggagggattttccaatttatttgagtgcaatgtttttggatatagaatataatggactaaatatcaaagcactcaaatgagaggggaattaacaatataattcctcaatatatatatttggaggaaaatggttggaggtaaacataaaaaggatttgaatcctaaatttgatagcaggaatatttgaagaattatttgtggctaatagggaatcaatttggaagaggaggataaaataaaaatctattcttctcagcacaagagcaatcattcacaatatttgtaatattgctattcttctgccaaataggaaatccaaccatagagattaacgatggctagatcaaagggaggaatttggatatttaaaatttggaaagggaactaagtataggtttggaatcaaagcataggtttaagatcaaaggatgggttaacaattaattccaatggaatcggaattacggttgtttaggttcaagggcaatatggaaaggatttttggaccataattcataacaaaaaaaaagggttttcgaactaaatttaaagaaattatggtcggaggaaagtattgaatcaaatcaagaaataacccaagatggttttaaatagaaaccgcaaaaggaaattaaataaaaggagaggttttgagttagttttaggaagtctctctaattataatattctaggtttaagaagttattaaaaacataagaatcggcgtggtgcataattagaaaattgttaattttcaggatgttacagtactggattgacgtcaagtatcgcagacgacggcgagaatcgacgcacggctcacaacttgcaggccgtccacggacagcaattcctctcgcagagcgcgacagattatttaacggtgtaaaccttttagagtagtggtttctttttaaatttggacctctccgctctccggcccaacgaaagcgacgacgaataaagtcattattatatattagcagtgcgtataatttctgttaggaccatgaggtagagtaatgaacaatactctgatcctaagctgagaaatcaatgtatgtgagcagaatatgttcttgcatgcagctgcagctgcagaaacagctcgtgattagcagattgcatttagtgggtgggctgtcaaatcgatcacagtcacagaaaccacatgtgagcagaacaagttcttaacataggagagatgacatagcaatggaaatggcgaattcgtgatgcacatatataaagctagcaacaggtataggcgatgtgtgtgcttgacagtgtacagtgcagaccatgggtggcgacggcaagcacaccaagttaccatggctgggcgtggcgaggtacgcggtgaccgcggtgctcgcggcgacggtggcggcgacggtggtgctggccatcaggatggtgctccggccggtggagctggacctgtcggtggccaacggcgcggtgtccgtggagcggccggagtcgccgtcggcggcgtcgctggtcaagtacaaggtgacgctccgcgcctacaacccgagcggccgcgccgtggtccacttcggcggcgacaacctcgtccgcctcatctacggcgccgcggcgcagacggagctcgccgcgttcacgctccccgcgttcgtcgtgccgcagcaggagtcgcacttcgtcaccaagtccgcgttcctgaacgcctccgcgctgccggcgtcgctcgccgcgaggctctacgacggcgagaccgaccaggtggtggtgcaggccgtggcgtcgctcagcttcaccatcggcggcgcgcgcggcgtgagcgccggcaggcgcggccacaacttcaccttccactgctggccggtgtccatctccagctactacgaggtgtccggcggcgaggcgtcgtgcagccaggacaccaccgaggcggcggtcgccggcctcacccacgaccgctgcatcggcggcccttgcccggagccgtacaagaactccggtaactgctccgggaataatagcaccggcatcaaggggtgatcgatcagctaatttcatttcgcggggtgtaatttgatttccagatgctactgtaattaactaatttattacaaattgaagaaataattgtattgaagttgtgtactgaaacttaaattgtgcttgaacaatgaaaaagtggaaactaaaggcattttgatttgttgccacgttcaacccgataacatgtattgtacacacaagtttagagtgcacgctcaattaccatacacatcagctaacaagtaataaaaattctaaacatacttacaagtacgtgtgcacgtactacaactatacataaagtttcaacttcaagtttaactaaacataaattgatcattatcaaaatatgctaaacttgtaattttgggataattttgtttttaaatatgtggatttgtgatgcttggctctaaatttatagttttatgataactttagtgctaaatatgtgtttaatgatacaacgtctcaaatttatagtttttatgatagtttgatcaaagttatatacatagttttgtcaaatttactctgaactaaaaaatatatatcatcgagccctaaatcaaacaatgggcctaaatcaacgagaacctgtgctccaaaacccaaactggaaacgtgaagggcccgtgaaataagagatgagctcaatgggccttggcctgccaagaggcccatcagatcacacggcccaataggaggccttcgagaaggttctccgctggcctcgcacgctctggacttcttaagccgcaagcacgcgacgcgacggcgaggccacacgacctcacctcgccaccatgcggctccccggcgacgctcgcctcgccctcctcctcgctcgccgccgcgccctcccctcctcctcgcccgccgcgtcggcgtcccccttccacggctcgcgcgcccacggaggtgagccgccgccgccgccctcatccccgcactgtggctctcccgatttcctgggatttccttccagtgtgactgatctttctttctggttggttgctttggtgtgcagcgaggtggggcgacgcgtttcgcgccgcggctcccgcgtggaggtcgccgttctcctcgccgactagtgccaggctcttccacggtgaggacaacaatggggaaaaaggggaagaagggagatgctgctgtttctggtttggtgagcttggctgagtcgattggtgatgttggattcgtgtggctctgcagggacgaggccggtggcagcgagggactactacgatgtgctcggcgtgagcaggaacgcgagccagggggagatcaagaaagcgtattacgcggtatggttggctctggaatcaagactatgtcatgcttagggtgtaaattgagcacaccaacgcggcacatcttagttctatatcgcaagtcttgaattataaagtgaagactaaacttttagttgctaattttagtgatagactttggaagttcccatcattacacttcaggacttgtgcatagaaagatcatcacccatttggattttggaacagtaatgttaaccgcaagttgatgggtatctaccagtttttttgtctaccagaatgtttctgaaaagtggttgatggactcttgagtaaagggcagttgaggttgtttgatttaccatttctcatcctcaattttagttatgtattagccttgtgttaatatagaaaacattggcatttcctttccttatgcaccatcgaaagaaaaaaaaaatcatcgcgtattgtttacctcacaatccctttttttttctttgttgtcctaaaagcttgcgaaaaagctccatccggatacaaataaaggtgattctgatgcagagaggaagtttcaagaggttcagcgagcttatgaggtacagttttcagcatggaatacataggtaaaggttattattagtttctgataatatactgagacatacttatttttccttctttgcagactttgaaggatgatcagaagagatcattatatgatcaggtaacaatttcaacctatttaattgaacaaatgccaacattttagctgtcaatgcctaaggtctattatttaaattaccatgggtctggaacctcaatttagtgtttaccaaggccctaggctgcctgcctaggtaggctagacaggaaggtgctgccaagccgcaagctttcaattaccttgtagagcactgcccagattcattagttatcctattctcataattagtggtagtaataattcaacttgactattatgtgattattgcttttcgttgctataccctagggtcagaagctatgtcttagaagtttacaatacaagcttttgaacacaaacttgtccttgacatgatctattacaggttggccctgatcagtatgagaaagcttccgctggaggaggacctggtggtgcatatgaagggggttttggcaatccgtttgaggatatttttggtggaggtggcggcggcggtggaatgaatgatgtatgctatcttttgtttaattatttgtcatctggttttattctggtggttctgctcccatttagtttgtattgttttctatcactcatgttgctgagtatatacagaaaaaagatactgttgtctggaaattcattttatctttgtagttttatagttattgaattgtttgagttttagcagaaacttgtgtcctacatactgcgacattgcctctttgatactttttccataagtggttttctgtttctttcattgcattatttaattattttacagcttgataaacaaatggcatctcatcatccttcattttatagatgctgatcacataaccacatgctcgtatactttaatcatatgagtataacggcactaatatgacttttgttgtctgtgtgtataatgaagttctttagaaacatattcagagagagagaatttagcgggcatgatgccaaggttagctctatactcatttttttttcacctatcatgtttttgctctgtgaatcgcagtttcatgttccattctacaggttgcacttgaaatatcatttatggaagcagttcaggggtgcacaaagacgatcaattttcagactgctgttacatgtgacacctgcagtatgtagatgcgcttctatttactgcacatatcaaactatcgatgtcctttgaattgttcctaatcatctaatgagagttctttgttttcccagagggagctggcgtaccccctggaaccaaacctgaaacttgcctagcctgcaggggttcaggatttgttagttcttcctctagcacaattatttctatttaatgtggtatctcatttaaatgttagtactgtgcttatttgtctttgtttttcatgtgctgttggaagatcttcatgcaaactggtcccttcaggatgcaatcaacatgcacacagtgtggtggtagtgggaagactgtgaaggtatgatgtccctttgtgttgataacctgcagtcaggataaatcagttatctagccttcaataaatcatctaggaggttaactgtttagagttgttgtccttaggacataaaattccgtacctacctgaccagaattgctttgtgatgtagggttcggtatttctaaatttgaccatcttacaatccttattcattacgtgtatcaacccctctgatttttttcaatttgtggtcatttaacttgtgatgcaggtggttgttgactgcacctaagtccagttgtctgatattagatatatgaattgaaatcagccacaacaataacttctgaaccatgctgttctttatgaaataaatatgcacttgacctctgatgttatatttgctcctatataccttttgtacagtgtctagattctgattagtcacgatgagctggtgattgcaatgttcttgtgttgttaggaattctgcaagtcatgcaaaggaaggaaagttgtgccaggaacaaaaaacatccgactcaacatagtgcctggtagttttcaaattgtcagcattcatgttatttgtacgcatatactcttattttgtgttactaaatgtccttgagcattattctgttcattcaggtacggatgatggtgacgttataaagttggttagatcaggtggagcagatccagatggtggtagtcctggtgatctttatgtaactctgaaggttagtcctctgcacattagcagttataccattggccaatgaatggtaataggcagttgaaaccttactttgggatcagacaggaccaagcactcggtgcaactagctgtaggttgatcccagtgcaagagtagtgtctggtcatttgttccaattcttttccccttgatgcaatgatgcacggctctcctgcatatttgagaaaaagatgataagcagatgacctttgtaatgctgttttttccaggttcgtgaggatccggtatttcgaagagagaaaggtgatattcatgtagatgctgtattgaacgtgactcaggtaagttgagcctgattattttttctgcatcctatgcttatatttgccactgcacagctcagtaatggacatccctagcgggaaaacagaaaaactcagttaccggccatacttcgttgtcactacattctgttttggctgagctggtaatctgagtgggagtgtggtagtggtctgtaagcaggattgtgcatagccttctagggctgggtgataacaagttagtgttagcagattatgtctgttccctttaatcttagaacaaactgttgttattagactgttccttatttgccacagagcaggcaaacaacaattgtttttcacagtagtttgaatgttaaaactagctaaagtatgttatctctagcgagtaacgatgctgtggtgattgtctgataatctctagtgatactaaacaaaacttgtaatgttgtcgagtaggcatctcctccacagttctcatatttcatcagtattcagattaagattaactgcaaacatctttgtaggcaattttgggcgggacagttcaggttccaactctctctggagatgtagttctaaaggtacctccaaaatcagtttaccctcattttcaatcttctcctttgtttattatgtcggaattctccatctgccttgcatattacaggtcaagcctggtactcagcctggccaaaaggtggttctgagaggaaaaggtaaactgcactacatagtgtttaccttttcgtggggcaaaattttttttttagttagcataaattgcatatggctgcatgtttaatacttcatgctcagttacacatccaagtaaaaatggagtctgcaagggccttgttttattaaaacccagtgccgtcatggctcataaatttgtagcggttgatacatttcattttgcctatagtgataagcatcactttatcctgcaggaatcaagacgagaaattcatcgtactatggagatcagtatgtccacttcaatgtcaacatccctgcgtaagctctcctcggaacttactgaactgccctatgctgttactagtacttctgttcaaatattcatgtattacttatacacaggaatttgacaccgagacagcgcgtgctgatcgaggaatttgcgaaggaagagcaagctgaagaggagaaagacgcaaaggcagcaggagcatcgggatagctgattttaggagcgacccgtacatttgattagtgctttagtctcatcatatatcgcgagatagaataggctgctgcctgaaatttgcaggggcaagaagatatagtttggttggatgcatggaattttacatgccgacatatagcagtttcaaattttgtagctgggaataatatacaccacgccgcctgatgtttgcaatctcctaatgtcactagcatcagtgagacaggcggcaggatcctgtattgtataattttgtgtgttaagaaagtatggaactcacggtaccaacctctggactcgtgccactcgttgagttgatattggctctattcatttttcaggttctcaattttgttcccagcaattcttgctggaaaggacactggaacagaacagagttcataaatctttttatgcattgtatgctggcaccgaattagtatttcagatgatgtgctgaattggaatttgttaacttgcttaaaaaacaatccaaatatttgtctcgcatttctgtctgcatataattcgtcgtcgtgactaatgtgactgaggatggatcggacgaattctgcagttcttgcatgccatttttttttggagtaaatttcactttggactagttttatttacccaagttgcaaattggactaggcaataacacatcttttcaacttggaccagactttgttaccataatttgcactttagtctagtgggcccatgcgttagtgactaatgtgttcttcttcctcacttagcttgatgtggtgttgctcgacgagctgctctcttcccacatggggggagctcgaggttctcagtgccagcaaggagagctggtcaagcacaagcacaaccactaccccacgtacgtaccccgtagtgctggcgagctcgttgattggtctagccttgctcctcttcggtggagacgaagcaaatgcacatcttggtgactgcagccccaccgacgagtggatatagtactgcaaaggctttggtgaagatcaaggaagtagagcacatactgcagtgggagctgagcttgaccttgatctatgctacactactaaacatggccttccttgctcagatcggcatgcctgggcaattggagaagaaagagaggaggaatcgagagaactggaggacaggttcaaactgaaataatttgtaaacatagctagcccaaggtgaaaatatggatttgcccctagcctaaactgcaacattggtgaaaataggtggaccaatgtgcaattcactcttttttttgagattcctatgaaattttacacgatttttcaaatgaattagttcgctttttgtagaaaaagagaactccaaaattcgtcgaatccaaaggctgcatgcgttgctgaattctgtccacacgctctccttcacacagcaaatgctggtctcgtgttcatctccacatcgccggagaagaggaggatgatgacgtcgacgatggcgaggcccacgatgctggcgtgctgcaagctctacatctccgagagccgcaacgccgccgccctgcgcgccatcgagcaggcggcgtgcggcggcggcgccgtcgtcgtcaaccgcttcaccgacgacgcctacaaccgggtgggctacacgctcgtcgcgccgctcaccccctcgccggcgccgccgcctccgccgcagtgccgacgtttctgttcggcgcggtgcaccgggaggggaggacgctggcctccatcaggaggcagctcggctacttcaagcccaactcctccggcgaccaatggcggggagcgccggagacggacgccctgcccgtcgcaccggacgccgggccggagaggtcgccgagatccaagggcgtggtggtcgtcggcgccaccggctgggtcgacaactacaacgtgcccgtccgcaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgattattcgcaggataaaatcgtcgagttatacttcaaatcagcagctaacactgagggttaactgcagtgcgaccactgatcactgagagtccagcggctgacactgagagttaaacttcaaaattgaaattgagttgatttggttggggtcacaagttctcgaccagtgatcactgatgagttctaactcaagaaatgcaatcacactttcacgcgtaacattttaccaaaaaacataacaaaacaaattcagagtagacgacatgtagctcgctgtgaaaatcatctaactgatttacaagtgtgcacatggccgaagagttcagcagcagcaatgcattccaagccaggtactttcaagttttccagtaattacagaatgcgatacatccaaagatgtgagaatcaccagcatgaaaaatagcaataccagcgacaaaactattaaagcaatttttagattgttccattcagcatatgctagtaaggcctcaagccacccaggcggctttgttatttggcttctgataatcagatcaccgttggttctccctcctccgggcgtatcgggtcctgtcattgtacctaggcctatctgatgctctttgtgggacaggttctacccgcctctgcctctccggggacctctgaacaatctctccattgacgaagagctcagctgtaaaacaaaatagaaatagattatatggcatgagtataatatctttccaagaaatcagagtgcagcagagcaactcatcctaccaacctcaagccaatagattcacacaatggtcagattttgttcagcatgtaatatctactctaaacaaactagattaaccaaaaatacaatgatgcatttaatgtaacctctgatgtctcaaatacaaacagttaaagccagtgaccacgaataagttctaaatgtttcatctcaactgatccacacagcttcactgtactgaagagcagaagagaaaaagaagagttctctttaagtccattagcattcaaaacaaggcattgcctaaatagctatcttgctttgccaagatggactgcataacatggcacaaatccatggggaagtgcataaattcattcacattcagtaagaaaccataaatgatatgataaaaaaagccaccctaaattatttatatagctaaatgtgccaccttcaaatcaggtaaaattagaaagcggattctaacttgtcatagggaaaattttcaacctccctatgtttagtggcatgaccatgttggcatgtttcatccccactgacctgtacctcatttcatttgaggtgcagaaccgttgaagagacattttttattagtccattagcattcaaagcaagacattgccatataggcttcaccactttgccaagatggactgtgaagtctagaacagcagtttggtactgttgagtcagcaacataccaaatcgttatgaaacaagcaagcgagagaaacacaaaattgttttaatagctaaatttgccacattctagtcaaggaacattgggaagtggattctaactcatcatagcataaatttcaatttccctatgtttaatggcatgatcatattgcatgtttcatccccactgacctgtaccccattcatttgaggtgcagaaccgttggagagacacttgttattagtccattagcattcaaagcaagacattgccaagtaggcttcaccgctttgccaagatggactagtatgtctagaacagcaatttagtattgagtcaacaacatactaaatccttaaaaaacagtaaaacatcaagactcaagggggatgtggcagtaaatacactgttagtgtctctatctacactgatctgaaccccaatttggtaaggtgcagaaccgtgagatacatttgctattagtccattagcattcaaagcaagacattgccgattaggcttcaccgctttgccaagatggactacaggtttggtaaacagaccaaagccttgaattaatcaaaaactgaagaggtggtaaagtgttcttaatgtctcatctccactgatcagaaccccattttaccaaggtaccgaaccgttagagagacatttttttcagtccattagcattcaaagcagggcattgcctatatggcttcacagctttgccaagatggactactagcaaaacatcagtatgtggtcggaataggctcacatgccatgaaaacagtctacatacggtatccagacaatgttccatttcattttgatgcagttctattaaaatatactttaacttcgatcgcattatcctgtaaaaatggaagcaacaaatgcctataggggggccaattaggatatagtatctacaacatcagtcaatcagtgatcatatgaaatgacaaagccattgatctcctaagaaaacctgcagaagttgtgaggttgtgcaagaaagctacctccatagtccttgtactcagggtcgacataggaatcagggaggacaaacagaacaccaggaagccctgtcatacaacacatacatagtgcatcagatacatgaacacacacagtgcgctaaaagtattctcattccaggtatttataaaaccaaaacataggcaaggaacaaaccttccagcttgttggacgtctcctcatcgatctcgcacccgaaaccaaagtatctctcgcaggagacgttgtagatcttcttcttcgcctcctcctcactgcagcaaacacaaccacataagaaatcgacctccgaaccaactaactggaagtgaggagcaaatacatggcaaggttagcacaaactgagagacaaatcggcggagagagaggcttcaccttccgaggaccttggcgagggtctggatgtagcagtcaatcatctgctgcttggtggcgccctccccgcctggcttgtccatcacgatgagccagtgctcgtagtcgcacccggggaacagcggggccatctccgtcggcgcgcggtctccgcctcctcctccgccgccaccggaccgcatcggggagtacccatcgccgcccggccgccgcgcgaacccgcgaaggaagccgacgcgcgagaccgcggcgacggtggggcgcagcagcgactccggcgcaccggggccgccgcggcggaggagagcggaggccgagaaggaggtggcgcggcgggagaggagcctccgcgcggcggcggcggcggcggcggccatcgcggggtaaaaccctagcggagtgaagggagaagggacaacgcaacgaaggctggggtttggaatcgcgaatttaaagctgcgtggcgttgaagtgaggttcgtgtttagatgggcttttagtaggccgtatttgaggacgaatgaagcccagtgaatgaaacatcacactggtggctgatagtactgagcaatgcgagcaatggcgtgtttatgaagtttcaggatgtcttttacgacattattcaaatccgagtaatttacaggtcgaaaaattcaaactcaaacgtgtaggttacagatctgtaaaaaggctatatactccatccggtttttaatatatcatgccattaacttttagacatttatttgatcatttggcttgttcaaatcttttttacaaacatacaaaatataagtaatacttaaagaacttttaatgataaataaagacgcaactaaatatatgataattgtataaactttttgaataatatgaatggtcaaacatatcacaaaaattaatgatatcatacattagaaatcggaggaagtacactctattgaatataaaactaagaagtatataggaatctcaaaggccaagcaagtgataacgagttcaatttacatccaggagaggaagagagcatctaattgaggtgtcagatcgacaacaattggctacaaagagaaaaaaaaaaagcaaggtaccacgttgagttgtacatgaattggttttttctgtatgtataatgccgtataatcacatactatatgttatctatacctactagcatggtgtcagaaaaatctgaaaactgtaaagacagattggaggatatggtcgcgcttccagtcctgaaatgacacttttgccgtctcaaactgcaaactgctgcagctaatcaacagaaaatggagttccgagcaaagaattaaagaatctgcttcaattgatttcattcccttgaagagctatttatcaagtacaggaactattgctgagctgggttcgatattggatagccgtgcagcacctagaagttgctccgggagctcgtcgtatgtgtttgcctgcaagtgtaaaggtagagaaatgtgaaccagttgagatatactactgtttattagctatagaaacataagtcttcaaagttcaaactggatcttgcagtttaatcatttggcctacagctgataaaccgtaaaacggcttattaggaatcaaaaataatttgagtaaaacttttatatatcattaccgacttaaaagcaaatgctgaaaaataaactatgttaagaaaaacctcaagatcaattctaaaattaagtttcaaaattttagttttggctgcggctgagccaaaagggtgctcttggagagtaaagactgaagaaaatgagggagccactgagcatacatacctgtataagaaaagccatgtcaactattaaagtcgtaacgacgccaaacaccaagcccagaacaccattggccactgctgaggaaccaatgtctacatctacctgcataacaatatcaaaaataaatttgtttgttcaagagatgccctaaataacctaatgttctactgcttcagtcatatctcaactttgccaggtatttacatgctcgaataatgtatttctccagtaattaaaataataggagttgtgttgtgttaatatttaaggtgcctatattcagtgtctcacttctatgtactcttgaccacgcatataactgcaatcaacagcctttcccaataagcaaggggtacttccgacgctctgtcgcactatccaagatccctgaagaaatcaacatgctcaagtgagaaaggccttcattataaatcaacagggctatacactccgaaagttagaccagacctttggaacagatgggatgagcttcaatctgctatttcggaaatcatcatcgccatcagcaaaacgttgtaacagtgatcctttttccaaggttcttgtaacaaaatagaggaccaagctgtaatggcttgatccaggaatctgcaaatgcaaacagacctgatcagcgtgaccaaaataaagaagacgagccctgatggaatcacagaatgaaaactggtatttttcaagggaaaactgaaagcaataatgatttttttctctaagcgaacaaaataatccggcctaagctataaacaagccaacaaaactggtatgatcattgaaaactacacagcaggtcactgcatctgctctcattggcaatgttaatcaaacaaaaaaaaacaagagattctgagctagggttttgtcaaagtgtaaccagggagttctatttttcttctaatagcaattgtgcaaggaactagtttgtcaaagcgtaaacaatttgtcaaagtgaaaaccaggagttctcttcctgtaaggaaccccgtgagcacagcagaaagaaactagccatggaggagagaccataaaagaaatatgatcttacttgaatgtttacaacaaaggtgaacatccccttctcagcagcaacctacattggtaaaagttcaatgagaatcatcatactattagtatagtagatatacttcattaggacctcacttaagttcatgcagataaggaagattgtcttcagtaccatatatataatatgcatgtgcaaggatctcttttatcaatagtcaaactggaaaacacttaacatcacaacaaagtttcaagcaaaaaccatcaactctgttaacataattgtgagatacttgctgattgcaccatctcactgattctcatcaactttcctatcctaagtaatggcgaagtgacgcgcacttccaatttcaaactatgcaagataaagtctaaaacaaagatcaattaaaatacagtccagataattctgtcaaactgtatcaacgttcataattttacacatatgtagatcttacagcaggttatttgttcacaggatacatataagtaattaggtacatattcaaagtgctcactactagaacgcagagtaactacctgaagcaatgaagcttctacacagctaaagtttaatatgcaatgaaaaaagattgatagcacacacaaggtcgatgaaaagagtttggaaaaccgatttgtttacaagtacaattctggtagaacaaacagttctgcaaaaggtaatcgttctatattattccaattttcaagtgctactttgcatattagacactggaattttaagcatagacataatcatgtaatagtggatttcagaaagaagggcacctagatgtgggtagagcatgaagtaaccataaactatttgcttacctgagctgcacatcctttccgcctagcaacatgatccattcgctttatgtccctaagccagtcgattgctacaagctccataaggtactttgttgcgggaacctgtaaagtcaggtaggaaatgcactaagctcttaattgcctgctatacttcagaattaggaaaacctgttgtgccacttttaatgtttggacctttgatttgtcatgtggaaagctctcactacgaactttaaagagcttgctatcaggtactgtccagcagttacggcttttctcatttgcatcccgacgaataatgcccgaaaaacaagacaaatctattggatctgtatcaaccaatataatgacaaaggataaggttaaaaaatgataaatcatctaggcaaattatacacatatcagactaaaagaacaaacctgtgtacttagcatcactgtcagatctggtaggtgcctcctgtacatgaatcacataagacttcagtgttaaatgaatcagcagtaaaactttcttcaaactacaaaaatagtacaaatgtaagtgtagtatgtattttgacctcaagattagcttcaggaacttgatagtcatcatcttcttctgactcttcatctatcatatccaaatttttgttatcgacttgtccaaaatcagcttgttttgtctttaagtcagtttcttggagtttcttatcctttttcaatttggacacagtagccatagtactcatcacaggaatcctcggaactggatgaatatcatcagtttgggaaaagtactcacgcaatcctggacataaatgcaaatgttagaccaacatagacacatactatcaacacgaaagaacgttgtgattaattaacagtatttatttgtcatttttagcattcacgggaaattaggacatgtcatcaaaagttaaaagaatggtttgtactttgtaccagcaacacagttgagcatctgcaacaaagagtagtactggaacgatgaaaaatagttgacgccccatccctttagatcaatttgcataaggtgttgaacttgagtgcgtggtctcccgttgacgcatttgagaggagaaattttaaaacctccacctgaactagtaggaagttaaggttaaaaaacaaaagttgtgcaacacttgttttaatatatcaagcatcctgataagcagaaggcaaattactttcaataaacgccctcacaaatcctggttggggaccacaattctgatgctcagtagatcggaacagtacaactgcaggtttaagaacattgaatcaaacaagttgcttcagaatgatgaaagtgaccaacaaggagacatccaaagattaccataacttccatcatcattgcgccgccaatatcgtacataacaaagatcccggggccagaccaacctacatgttcagttatctattaaattagatgtagctatgttattccaaatctgaggtaatgcaataatatatcgatataaagtaaagaacccaggtcttgtggagtatgatactgccatatagaagttctcatcctacaattttaatttagcaacagttgtccaaacagcaaaaacagtaatgaatttggcagttggcattgccctattgggtgcagaggcaattccaacaagtgaattgtacaatatatgccaggcataaatattctacactcaagtccaaatgaaaaaagttcgtgctcaaatagtttatttagactttcaataagatataaaatgcaatcctcatgcaagttataacagaaccagatgatatgtgcacataaataatcagtacaagaaaaggtgttacattgaaaaccagttcagctgtagccgatgatatagtattgcagtgtgaccatcaacctcttcaactaaactcccatactggaagctacaatcccacctacagtggagcataaataatactgaggtcagcattcatagaaaagcaattaggaagtaaaacacttaaacagcacacacttactcatatcgtgttacatccatactcattattagcccaaaaatggattcacatgtggcttccaccacaccaacagctctcattgctcggctacagcttcttgcctgtaagggtgcacaaggcataaaaggttactcatagcattggcgtgtctgcctttgacagtatataggtaagagaggtacatacaaggtattcaacctccacaagttcttcaaagatgcgcaagcctgccaatcataaagccaggaaactctaattgtaacttcatttgaacaatcctaaagttgaattcaaaattttaaagtaccccttatatgcatgcctatatataatctacgtaaagggctgtgaacttaccattctgacatctaagtagccgccagttctttcttgagtaagcatggttggtgtcattctgatctgacagcccaatatcaggctccttggtccaatcatgtaccgaatcaggagggcctagaaaaagaaatggtgtatttaagttctctcgtgtagccattacaaaatattaataaaaaattaaaagtatgtttaccattcccgatagttgtcctacgaagcaaagtaggccggggctcttcttcatcttccggtctataatagagtaaaatctcctattacttttaaccagaaggacttacatacagctagataaaatatgaaatcacttgcccactgtcacgatcagagaatgataatgggcctccaaactccatgtcaaagtccagtgaagcaaaagctttgcggtttttagccgtcatagtgtcttgttgctgcagaatgaatatctccgatgttatgcctaggacagttcattggtgtgtcatagaattattgaaaaaatggatgttatagatttcttttgaatctaatatgtacaagggagaaccttcttacaccgtagctaaacaagaaactaatgaaaaaggggctgaaatatccttattacttcgaacaattgccatatgttgttacagtctgttggacttactacacctgatcaataaggagctctagcttctttttccagaccagggcatcctcgatatcatgcgcacccatctgtagaagaacaatactaggattaagatggtatttgaataatgacaagtttactgtatgagaaattttatggtccttaaaaaagtacctcgatgtacctaaattttacactaattttttttgtatctcaaggtacttaatacctggaggtaccaaattttatactagaaagtgtggtacctctcagtactttttcaaggatggtaaaattacccttactgtataggtatatgtgacagaaaaaggctataggatactaaatgaaagagtacacacaaaaggaccactagcatctctcccatatgtagtgttacactgttattgtcaattaaacttgagcaaataaaattgcatagcattagtcaattatcaagcagagaaagggaatccaaaagctacactaatgctagtgaaagtagcgtcttcttttaactatatccaaaagctacactaatgctagtgaaagtagcgtcttcttttaactataaaaccagaatgatgtagaaagggcatcgctcccttttttaggtcaacagaaatatatgacccataaacaaagtacacaaaaaaggatggcaagaaaagggttaacatccagcttatatacttgctttttccaatacactgcagtagtaaaaactatatattgcagacaaaatatcagcaagtgcgtttaaaagcaaattctcaaacatagagtgtattctggtttggcaagttagcatcgtaacgaaccgtgatatgattctccttttctttcttgttgtatatgcacagaacatagaccatctgcaaaacaagaatatcactacaaataagtaaatgacggtattaacgtcacaacagtacagcagtacccctcaaaagtaaggtgtttttcttaaactaaaagatagtgaatttattcaagaaaaaggtatcaagaaactttcccattgaaggaattaaatgatacgctttatgctttatgctttatgttatgatgctagatgaattaaatatgagaagagggaacttacttgaccatgatgtgttttaagccctctgtcttccactctgcaatttccatctatttgaagcgccttcactggcacctgcccatccacaaatcttaaatgaataatcaaaataaagcagccaccatgctcctgttgcagaatttccaatctaaactcgtgtatcagtatggcaatttattaggttaaaatcctccgaataaggcgtacaatcaagagtacttcagctgaagtactctacaataaagagtacttcagctataagaatcttattcaagaatcataatccatgactcattcagacattcttactctccaacgatatgctttacatctaccgaagcagtacatttacagcaaacgctactctaaatgacccagagctgaagagacaaaactccattacttaacaacagtatgtcattaattagcacttcctagcctcaaattaaaagcatccggagatacagatggtaaacagttccaactcagcttcacggttaaatagttggcatcagtttgcaataatcatataccattaaaataaggcaggtggttctatgtgctagtcaaaccactcaaaaatccaaaataacggcagaaaactcatgtgcatcgcatcatgatgcaggcaaattcccctacattcagatttagttatcgtaactagaacatcctccgatcctccactccacccaattggacagaataaaccacaagtcacgaaatcccgctaaaaattcatgagaaactcttgaaaaaaaaaaggtagcgcagctttctgcgagactacgacaaatgaatcgcatcgcgagttcgcgagtatgacagcaaaatcaagagcataagttgcaggatgatgatgtgtataccatgttgtccttgggctgcttcttgtagtaggcgagcagcttgttgtcgaggacgaagtagcgcgtgcggacgaacgacctcccaatcttcctccgcccgtaccgcagcatccacccctcgtgccgcaccgcggccgtcgccgccgccgagaccttggggagctccccgctccgcgccatcgccgccgcggagggcctcgggggatccacgccgccggcgcgccccagctcggagctcttcgccgccgcctccctcctcgaggtcgacgagctcatcatcatctccggcggtgatttcgaattccaactgggtcgcgtcacgtcccccgggccgccacgtcaatgagccataccccagcgggtgaggtggcaccggaggggaacgtggaggcctaggcaaggcgcaggccccgccgaatcacggcggccggagccggcgaggtggccggcgacaggcggaggaggaggggagggtttcgaggcgggggaggcggagagagaagacgagagattaattattattgtaagccactattaaatccccaactactactttgcatttttatttcaaatatttggcttttgcctttttcgaggaaatttctggtctagaccttgtgttttgtctaaattacttattgttgacttggggggtcttttgagtccattgaagttttgtaattttggagatagtactgttttaaaatatgaaagacaatagtacaagcattaaaggaatttgtggttttccaccttttctgtgacattttcatttatttgaaaatgaatatgaccacttcttggtcttcaacttttgttttgttcatattcaatggtacaaaagaatgaattgaatatagcaagttaaatgttgttttaaaaaaggtattgtaaaacatttatatatagaaagtgatactcttcccatttagaggtttggaaaacgtgcacgtcgtaatccacagtcataagagaaaacagtgatggttagataagccactctaacaaaaaaaaccgtaacccgtaagtctagaacactcttaaccaaaaaaaaaactctcaaactagttgaaatacccttcactaaaacaccatgttgaattttcgattgttaagtgtacaacatctaagttttttttaacgactcacgtaacatagtgcgaagttcatattgatacaaccctgataagtcgtaaccagaaaaacgaaaaattacaatattacagtatctatgttgacatggtaccaatatgaacatctgatatcatcttacatgtaattttttttcctttgagattcaagattttattgattatgtaaaaatgtcacatgccagacaggaatggtgctcaaaacacacaacttgtggagtttaatatttattcaaataaaaaaaggggaaatagatgttatagaataaacgaatcagtgtatgaaaaaataatttgtagagaaaaacaccattcacgtgcatcaatatacaaatggcctaaaatgaactgcactagaacaaacacaaagaattgcgattcaaagttttgttatgaccatgaagaaagtttggtttcggaacggatgcataattatttaatattttaataatcttgtaatggattattatgtcactagatgtcatataaaatgaaaatgttccaacctgcatacgtaggaccaacttctttttcctgaaaaacttatgtagtaccaacttgaagtaggcaagaaatgcaggccgtcaaaatatttcttatcaacttccaccggcaaaagcactgatacggagtagtggtatcttctatactacttaaactttactagattcgaactgaaaaggagcaaaagattaacagagccttccatctgaaattctcaatggcatcagtttaataattaagttgtgtatcatgtgctggcctcggagagctagaggggccatttgtaattatcttgatttgaaggggctatgctgtaagcttcagttcgtgagcgagtggcgggaaatcccccgcccactccacggtccgcgctggaacgctctcccgtgtttgaaagctacccattttacccctcgccgtgcgctggacgccatccgtgcgacgtggtcccgacacgtggacggctgagatgtgcttagcgtggaaagatctcgctgtctttaggacggactgattagcgattagtaattgcgtgctcaaatactaattaacccacagaacgtatacatatttttatccagggacacgttgacttccatcttattctcgcgtttccatgtgatttctggaggattatcagaggctagctaggcgttattcagccagttcttaagtgtggaaattaatatgtgcagtgcagattctttttgtataattaaccatatgtttaagaacaactccatgtcacaatctttttgtaaagcatgtgtttgagaataactccatgtcacatatagggtataattagatcaagatgtatccaaattaatgagtaattatggacagcaaagctgacggatgaatgctggtagtgctcctgtcctacgtgcttgctggtctgcagctagcgaatctccagcagcagatgcacgcatccacaacgtggctggcaatcaaaaaactgtcacagctaattaaccagcatctgcagtttgctcataactcgtgttaatggctatgaagaaagaaaaaaaccgagcaactttcctctcggagtatcggtaatctttcgttacgttttcgtgtgatgagtagttctcgcaaacggttttaattggttaatggtcacctaaaatcaattaaattacgtgtgtatgctgcaagtaattaattggctagtggatggacaggacaacccaggaagcaatcaatcaagcagcaaagaacaatttagctcgtgtttagttactttccaatttttattaagtatacgaacacacatttaaagtattaaatatagactaataataaaataaattgcagattctgcctgcaaactatagaatgaatctattaaacctaattaatccattattaacaaatgtttactgtagcatcacattattaaatcatggcgcaattaggctcaaaagattcgtctcgcaatttacatgtaaactgtgtaattgttttttcgtccacatttagtgctccatgtatatatctaaacatttgatgtgacggaatttttagaagtttgatgggaactaaacacagcataattaagcaaaaaaaaaaagcaacaattacacaatgatacgataaggagaccccacctactagtacaaagcagtcatgacattccagagaattagtctcagcaaggcatattcttctcatcctctcatcaaataatatcttgcagcagtttgctgatgcatattccatgccaacttaattgcagttccaggtgtcattagcccattattacatttaacactgttgtgaacttatgatccaaatggcccatcagccgaagtgctcagatttaggcccaaacaaggaagaagcccagccgaagaaacatgggctcggcccaagccacgtcatacgagcacggatctcgaggtgggagaacgtacggacgcgatcccctccgagcggccgtaggctggccctcccgacccagcaaaatcttcttctcccgagacgaaccacccgaagccgcagcagcagcgatggcaatggagaggcttatctcttcgccgctcctcccgcgccggcctccccgcgccgccttctcccgcccgccgccctccctcgccgccgcgccaccccaccaccgcgccggcggtgcggcctccgggtacggctccaggccgcctctcgcctcgctcctcctctccaggcaccaccaccaccaccagcctccggtcctcgcggccaatcctgctgccgatgtggccgccggcgaggctgtccctcccgccaccgccaccgccagccggcgcttcctccagaaggtgagcgcctcgttgcccgccagttttccgtgtcgcgcctcactcgttcttgcatgtctcgtgtgatgattactgatgtgaatttcttcttcttcttccaagaattgcttctgttttgtgatgttgttgtggtcggaggagtccaagagttagcggagattattgagctcacgcgtttggtttgacaggtggcgtcggctgcggctgccactctgttggcgacgattgcactgacgctgatccagccggcgtgggcgccgccggcgttggcgtcgttccactcggcggcgaaggcgggaggtggcatcttcaagtcggagctgctcagcagcgcgtggacggggttcctggccggctgcctgcacacgctctccgggccggaccacctcgccgcgctggcgccgctgtccatcgggaggtcgcgggtggagagcgccgccgtgggcgcgctctggggctgcggccacgacgccggccaggtcatcttcggcctcctgttcctcagcctcaaggaccgcctccacatcgaggtcatccgaacgtgggggacccgcgtcgtcggcctcacgctgctcgtcatcggcgccctcggcatcagggaggccaccgaggtgcccacgccgtgcgtcgcgctggagaacggcggcggcggcggcggcgcgcaccgtggcccgctcgatgctctaccagccaccaggaagaagatcaccttcgccacgttcgccaccgggatcgtgcacgggctgcagcccgacgcgctcatgatggtcctgccggcgctcgccctcccgtcgcgcgtcgccggcgcggcgttccttggcatgttcctcgtcggcaccgtggtcgccatgggcagctacaccgtcctgatcggctcttgtacggaggcgctcaaggagagggttcccaggatcacggagaagctgacatgggctgcctcgctcgtggccatctccatgggcctcggcatcctcatcagccagtctctcggctttagcttgtactgatccgccatccctcgcgacacctccttcttcttcttcgccattgttaagcttccactgcctccactgtaggaatctgccatgagaattttgcaaatgttgcttgttgagatccaggagaattcaagtttagttcacaagaaaaaaaaatgccatgagaattttgcaaatgttgcattgttgagatccaggagaattcaagtttagttcacaagaaaaaaaaatgctttgctgagaattgcttaggtgatctgcgatgagtaaacatgtgttaattgtcacccaaatgtattacacgtacttgaaaaaggactggttaagaacgattcacatcaaatgtatttcttgtacttggaaattaaaaagattggttaagagtaattcagtgtgtctaggagatctggcatgcatttctgtcattctgtttttgtgtcatttgtagttgctagctgacactttgtacttgagtgagatgtactgtatgtctgtatcgaattgtggtttccattcacaaccctgatagattttgagatgctgatatagataggcacattatgttcctctgcttgttcagaaattctatcttggcaaatttgggacaccagatcgtcagcaggtgacgcagaatgcgaatttgctacacagttcttcagtggcaaatcaaggacaagtctggaactgggatcaaataataatgtatatatcgaattcaacctgtgaagaacaaaaaactgaacataagagctggttaaaatattcaaccaaacagtcgccttgtccgcagataagatgatgtatgattgctgctgttgaatgaactcttcgtgtttgcttgctgtcttatcagccataaccagaaaagtaatttaaaaacttattttaaacttgattttgaaggtcttcttttcaacattggttgtttccctgaattagttttcaaaccattaaaaacaaagatatacaagttgtccataaactgttcatggttttatctttccacggcttatacatcaaacaatcaattacacagactgaacttgtacgtagtaaacggagacaaatcggaggttatgcttatgcttatcagctaaaatttgaattttcaatcttacatttaggggtttttttttatcaaagtttatttttagccttttcttttagatcactaaaagcatgtattatttacaaattatttttcgtttgcaaatataccgtttataagccaaacgatggggcattaactttggggctttaacctatttgccactcttacgagtagtgcttaacgatttgccactaagcccacatgttatagacacatgagagcccacatgtcattgacagggtgtggcaaatcgttaattgtcatgtcacaagagtggcaaatagttaaatttcccgttaacttcaaacaaggtgcttatcgatttttctatatatttgtcgataaattttcttccaaaaatttgacagatgtaattacagtacaatcgtagtgtaattacactgtaactatagtgtaacttatatgtaactttcaaaaatctctacataatatgttattctggtaaaatagaggttgtgggaacaaatccttacacatatgtgtgttgtggttttatttttcttcctcaccaaaacaaatcttatatgaaacttatatacaagttacgctgtagttacgtgcaagttacagtgtaattacactacgattgtactataattacatctgtcaaatttttaggagaaaatttgtcgacaaatgtataggtggtcccggtgcttatactgcgaaaaaaatacgggccgttctgtccgtgtaatgggccttccgggccagaattcggagcccaaatgggcccgtttaatgccttggtggtgaagtcccaactcccacgttgtctcgtctcgtctctcgcaccaactctctctctctctcccttctctctccccgattcctcctccgcctcgccgtcgagatctcgccgcgcccgcgcccgcctccgccggagctctcccgcgccatggcgacgcggaaccggacgcctctgtaccgcaagtaccgcgacgcgctgcgccacgtccgcgcgccggcgggggctccgtcgtcgtcatcgtccggaggaggaggaggaggaggaggcggggggccggtgatcgagatggcctcgctgctgcgctccaaccgcccctacgcccccctcagcaccgacgacccctccgccgcctccaggtaacaaccccccttccaccaccctgtgccgtctaatctgaaccccacctttagatcagtgcgctagttaatcgtgatgcgaggggggcgcgagatgcggaattgcgacatgggaatcacaattgctagacttagatcggtttccgtgcgagtgaatagcgatgtcccgtaaaatcttttacgatggtgatccaattagcctgtgattcaaacgaagcagtagaattgcagatcgctgaactcattcccttagctagcctgtttaggcgtcatctactgcgagatatttataattggttttgttagttcaagtagagaagttgaaaactgttgtgagtataaacatcgaggtgtggtagcagtccaccaattggtttgggaaccttacttggcactcacatgtggtgtatgtggtgcagtagaagtgctgtgacggtcgggctgcccccggcatgggttgatgtttccgaagagatatctgccaacatgcagcgggcaagaacgaagatggcagagctggctaaggcacatgccaaagccttgatgccatcctttggtgatggtagagatgaccagcgagcaattgagattcttacacatgaggtaacagacttactgaagaggtcggagaagagacttcagaagctatccatgaaagattcttcagaggattcaaatgtccgaaagaatgtccaggtgatgatgggctcctatctttacttattaaacagctacaggactcataagggatttttgttttgatggatgaaatgccctttgattgttatatgcagcgttcactcgctacagacctgcaaagcctttcgatggagttccgtaaaaaacagtcaacttatttaaagcagctacgccaacagaaagaggttcgtacgtcaatctgctcaaagtccagatacttttgctacttaaatcgatctaattgagatgcttgattaatgaatcatgtttacaggggcaagatggagttgatttggaaatgaacatgaatggttctaagtcgacatttgaacttggagatgatgaatttgaggatgtggtatgctattactttgtctttatctttagtccttagtcctgcagacttgattttacaatattgttatcctgaaagcttggcttatagtaactagtaacacactcaattctaattattatttttattgtttgttgtgtattgctcctccctatctgctagtaactgacttgaaaatcagaatcaagggtttgcccgacttgcttcacttcagagttcagacccacaagtatacacaaaatttgtgaagagaaaaacgcaaaatgaatagcggcacacattatgtgcaatgaaggccatgtctaggtttgggtggttacagtggcttagaataaggcaacataaatctgatagtatgtatttggcttgcttggatcaatttgcaggtgtgagttaggaatctagctcaagaatgagcacaatctagttacatagttggaattcttattctgttatacttctattctaggcattttaatttgacgggattgcattataggatgtagctgttggatgtttatagcatttcattttgctcctaccttttgaccacatgatgacattgtggatcttaatatcaagtccagaaagtcagatttttggcctgtgaatctgtaatgcttgaataaacataataagaaagtaacgcacacttgtgggatggagttttgaggcttaagctattgttatggcagtactgggtagtgaagatcttgcatttccaagcttcccagccctttcactttgtaattgctgtactgatcaagaaaggccgggttctttcaattgcgttttaaaccaagtgaatttaggtacatcatttcaactggctcccgatgcagaagttataatcataaaaaaatacaaggctttctaagtaaaagtgctatagtcccgtgctccacctgcatccacttacctaaatttttctcttctgcgttatcagatggcaggcaagaaacatacaggcgttactgccctttttttttaatcatatcatgaatttagtaacataggttatgttcatgaataaaatcaaagaagtttgagtagctttgcattgtcatgaacaccacaataatccaagcatccatacaccatggccttgcatccatgaattcttagtatagttcatgcacatacttagatggtatccaggcagctgcttttaaactggtttagtgtgaaaaagagtcttaagtgagatgctcaaagaaaacattaacaaattatatgcttcattatgtatatatccccttttagtgttctcgggagtatgatgtttgtgtatgtttttttgttggatttgaaatcaatgtatgggaatagatttgctggtatcaaagaggaggattaaagttccagcataccctttaaattaagtaattgatcgatgatgtagtttattccatgattttaatttcagggtttcacggaggttcagatgtcaaaacttaagaaaagcgaagcattcaccagagaaagagaaagagaaatcgagcaggtgagttctttgtttgttatttgcttatatgcacaatgctatatacatactctcttatttgaattaaaaaaaatcaatcatgggcacaactttattttatattatctgcattctacttgaaggttgtcgaatcagttaacgagcttgcacagatcatgaaggacctttcagttcttgtgatagatcaggtataagaaaaaccctaaataaccgagttatcaatgattggttttgttaactggttcaaactccagactcataattacttcatctcaacagggaactatcatagatcggatagactacaatatacagaatgttgcagcttccgttgaagagggttataaacaattgcaaaaggtttcatcccccaacccattttctatctttagagtatttttatgcagatttctgtagttaagatggaaaaacttctatgccatgtttcatttgccaggttaacttatatgatattttatgatttgtgtccattacggagtagcacagtggtttaagaaaacttgtactataatgttaaccctaaaaaattgcttcccacctgatctatctttttgtccattgaaagaaaatggtatgggtagattaggcattaaatgaaattttaaaaaggtatactatataacttcagcagttatctggtgataaaaattcagtgcttgattttgcatctcccagactgtggacagtcaagcatctcatagcatgtaaatggtgtccaataaatagtacagatcataaagttttttttttttgtgactactagaggtagtaatactaggtcaaatcttcaggtctccgcaagtactgctgtgtgcctttgcgtgcctgtgtgtgtttgtgcatgcatatgctactgtgtgctagatattatcataaaaagttgaggagaagtcctcagtgtttccacctgcagcacctttaccttatatatcaaagcgtttctgcagaggaagagaaataaggcgcaccttcaattcctggagttttcagtctaacatcttcatctggtctcttttatgcaggctgagaggacacagaagaaagggggcatggtcatgtgtgcgactacccttgtcattcttatcttcatcatgatagtcctcctgattttaaagaagatccttttctgacatagatatatatattctttatggttgatggatggcttccaagtgaacaacactcgctgagtgattatgcagtgcctgcgtactggaacagctgcagttcagttgcatgtttacagtttactgatctcaaaattcaaagacggttcagcccatatccataattgctgggcctgcaactctcttcagtcttccacatttttttgcagcactgcaagtgtagagatatcatattcataggaggctctttttttttaagagttgtgttgacacaatttgccctacctgtttgtattggagcagccaggtttggttttgtatgctctgtacaaagttgtactatcatccaattcttgaagaaaaagtagctccactttcggtctcgattacgatttctcacacacggtctacttatttactggctataatgtacctggctaactttgttttcctttcaatctgatagtagaaaacattttataggtatgtgaaggtctgttagccattgattcttgtatctgaatattttactgaaaatacaattgtggagttttgtttttcaggtgtcggcatgcatgcatgggggtgctgtcactttggtatttgtctgtgctgctgctaaattggaaggttttgcttggcttttgaggtgggagccaagaatcaagaggtgatggatcccctgtcggccatcattcactcactccctcaacctcttccataactcaggtctgcaggccgtggtgttttcttgctccgattgcatcattttgaccagttggtcccaaatcatgcagcatgtactgtgttttggtgatgtaggattttctgtgccctacatgtaatcaatttaatctcccctagtgtctctctgtgtccctttgcccccatttatgggggtgtttagatcaagggtgtaaaaagttttggcgggtcacatcggatattatataaggtgtagcaaggggtgtttacacactaataaaaaaactaattaaagaatccatcagtaaattgtgagacgaatttattaagcctaattaacccgtcattagtaaatgtttactgtagcaccacattgtcaaattatggagtagttaggcttaaaaaatttgctcgcaaattagtcgcaatccgtgcaattagttattttttagcctatatttaatacttcatgcaggtgttaaaacttttgatgtgagagggtgaaaaattttagggtggatctaaacagggccataggctctggttgcttcagctgtttgctgcaacttggacaggaggctatgtctctcctattgggcacctaacttaggttttttctttcttttctatagcttgtttcacctccctggtatgggtacccctactaggggcataccctacagaattcctacctcaaggtactagtaggagtaacatataggctgtgttttggcgcatcacatcggatatacggatatacatttaaagtattaaacgtagtttaataacaaaataaattacagaatcttcctgtaaaccgcgagacgaatttattaagcctaattaatctattattagtaaatgtttaatgtagcaccacattgtcaaatcatggcgcgattaggcttaaaagattcgtctcgcaatttacacgcaatctgtgtagttatttattttttttctatatttaatactctatgcatgtgtccaaacatttgatgtgacagggtataaaattttgcgggaatctaaacagggccatactgtaggagtgtataaaacatagagagagaaaagagagttgtaccagggaggaagatgatgagtttggggggcatgaaatattcaaatgttgtagggtactagtagtaatatcagtactggtcgtacatattcatcatcttgaatgctctgcctctgccgtaccgtccctttggctctctccagagctggagagtggtgataggagtagattagattagcttaggttaggagtagtatgaggtttgatttagggggctaataagatttattaggatctgtacaaaatctttccagcttgtagacgtgcagtactactagctcgaagcaaatgcctttgggtacatccgtacatgtcaggtcaaagcaagggcttgggatttgaatggtgtttctttatcttttgaacgaacgaaatggtttgaatggttttgaggcccgtccttttggtcatcatgctttggaagtttgtacttggtggatcttatccgtatacttcaactgattagtggaatggatctttgatctgatatactgtatgatcgagcattcgagccttgcttgtttcagctcaggtttataagttgcagccaattttgaattttagaacttaatttatgtgcttttatcgcaatcgtcacgcaacttgggaatagctatcatttgtcgttaaattttcttctacaaatttgatatatgtaaatataatataatcagtgtaattacattgcaacttgcatgtagctacaatataatttgtatgtatcttttttttaaaaaaaaccgtgataacacactattttcatgaagcggaggatcgagcgttcaagccttgcttgtttcagcttaggtttataagttgcagccaattttgaattttggaacttaatttacgtgcttttgttgcaatcgtcacgcaacttgggaatggttataatttgtcgttaaattttcttctataaatttgatatatgtaaatataatataatcagtgtaattacattgcaacttgcatgtagctacaatataatttgtatgtatcttttttaaaaaaatccgtgataacacactattttcatgaagcggaggccgtgagaccgaatctcctagcctgtctgcatgctatgatttttttttcttcctaacttgcatgaatcttagggcctattcgtttcaaatgaattgcaaagaaaaagcataggaataggaatgggttttaaactattattcgtttcatatgaatgcaccataggaaaactacaggaaagttttccattcctccatttttgaaggaaacatttttgaaggaaaagcataggaaaaaataatccactccaacctaatgtttacatttctttggttagcttgctcaacaacataggaaaaaaatcctatgtttttcaatccataggtttgcacatgtattcctatagtattcctacattttaaagtaaacctaacagtttaaaattatgtgaaaattaaatacaaattacattgtagtttcatgcaaattacaatgtaattacactacaattatactatatgtacatttgataaatttttaatatatatagtataattacactacaattatactatatgtacatttaatatatactatatgtcgacaaatatacagcacaatcgactctaaaaagagtggtaaggctttacgtccccatcgtttggcgatatatttacaaacgaaaaataaattgtgaataaaatttttatatacgtgttcttagcaatgtaagcaaaggctgaaaaataaacttcgatgaaaagaaaaatccaaaatcagctctaaatttaaggttgaaaatttaaattttagctgataagtataatcataagaaaaaaaaaatgaggccgatactttgttagctaaaatgtggttagggttttggttgggtggtggtctcacctttgataagcttagtaaacaaaatgtggtaaatctagacaatcttaatacatgaatcatcagaattttattgacatgactataattgactggtgtttaggcttctcgttgcacaccgttttgatggtgcaatgatgcatattagccataataattgatagtataagtttgtgcttgatacgatgaatcctagacgccgagttgggaatgtagtactcggaagcaccactgcctgaacatatgatacggagtactacgtactccctctgttaaaaaaaaaaaaaactcggcctagaaggggatatgactcctgctaggacaatgaatttggacaggagaggtcacatcccctcctagattaagttcttttttgggacggagggagtaccctgtctgtcagaaaaaaaaacgaatctggacagagtatgtaaggatgtatcgcatcctattacaaggttgacttttttctggaacggaaagagtataattgtagtgcttcattttaaatgcccatttgaattgcaggattgtaaaaagggtggaataagaaacacatgattctgatggaaatgtaagcatcaaacaaagagaaatacacggaggaccatttgattgtaccgcagaaaaaacatagaaatcggatgaaagaggtagactaacgaaaatttccaagaggttggagctcttgttaagtttcctcaaaatctatatacgatgaggcattccataggaatttcaatagatttggaaaacttcaattctttaaattaaattgtcacatagaaaaaattcatataggattctaaatcctttgattaaaggggctataaaggttcaatgcggcataaaactttatatgattttcatgagcttgttttttccaccaaaaatcgaaaatatatcatacattctaaaagagttccctagtagtactcgtctcctaccatacttcacatgagctataagcatggattaacttgtacccatcttgtttcaaaataaataaaactagacttatttatctagatttatagtatcagtgttatttttatattagatttatttattttttttaaaaaatttctctttacagtatacatttgtttattttaagatagatttttgggacgcactccctccatctagaaaaaaattccaatcctagcatcccaatgtggaattggtgaagagtgagaatgactaaaatacccttaatcactagaaaaaagtagtaagagtagtaggtatgtaaagggtattgaagagataaaacttctcattttacatgctgaaagcaggtagaatgatagaagttagttttctgtggaataaaattaaaactctaaaaattttaaaaaaattgacggagggagtaactcaacgtaggagcaagcaacaagatccactcactagtcaccgctgtcctaacagccctagataaggatgagtgcagttcatttcaggaaggggaaaactcgagattgcccctgcaagggtgggctgggcatgaggaggcaggcaaggcaactgaaccaaagggagggtacagcttacaagtaaagacaggcagccggccaatgtggggcaacccaacccagcaaccatattattatactaacagtagtattagtgaactattatttactccttctgttcaataaaaaataaatataatacgagatgtgatacggtactattaatttggaccagagatatctaaattcatagtattaggatgtatcacgtttcgagctgtatagattcgtagtactgatgccgcactatgttttttataggactgatggaataataataatttcttgttagaaccaagttaatactaaggtggtgtttagatccagggacttaactttagttcctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtttcgcaaattagtccaagattatggatgggttttattaatagtctacgtttaatatttataattaattttcaaacatccgatgtgatagggacttaaaagttttagtcccatctacacagggcctaacttaacatccatatagatgtaggttttgcttgaagagattaagactgtgtttagataaggggtgtaaagtttttgcgtgtcacatccgatacacggacacatatttgaagtattaaacgtagactaataacaaaacaaattacagaatctgcctgcaaattgcgagacggatttattaagcctagttaatccgtcattagcaaatgtttactgtagcaccacattgtcaaatcatagagcaattaggcttaaaagattcatctcgcaatttacacgcaatctgtgtaattagttattttttcgtttatatttaatactccatacatgtgtctaaacattcaatgtgacagggtgaaaaattttaccaggagatctaaacaaggccaaagatggtaagacacaacttataataataaaaagaattggtcatatcaatttctactctgtcctaaaataacataacctagatgtgtccaacgattatggacatcctaaattaaattattttgtaacggagtgagtaacttctagcttctattttagtagtttactccctctgtcccataatataagggattttggtgggatttgacatatcctaggactacgagcctgtccagatttgtagtactagaatgtgtcatatcccgttaaaatctcttatattataagacgttatattataagagggatggagtattttctaggattatgtaactacccgtttaaaaaataattaaaattataatatctaattaaaaatttagaaagctaaacaagacctaaataggtatagatactctaggaggaagaaagaagcagatccccctctcctctccctctcacactcacacgctgcagcagcagcagcagcagcagctttcccaccgactcctccccctcctccattaatggccgccaccaagaaccctccaacccccacgtgacctcctcctcccctccccctccccctccccctcccgacctcgccgccggcgacctcccttcttcttcctgcttgcctgctcgcttgcctgcctggttcgaccgatgctgagctcgtcgccctcggcggcggcgccggggataggagggtaccagccgcagcgcggggcggcggtcttcacggcggcgcagtgggcggagctggagcagcaggcgctcatttacaagtacctcgtcgccggtgtccccgtcccgggcgatctcctcctcccaatccgcccccactcctccgccgccgccacctactccttcgccaaccccgccgccgcgcccttctaccaccaccaccaccacccctctcgtaagctctctctccatcttttttccacaaatggtccatctcttgtttgcttcatgcttgggtattcaaatctgagaaaaatttatatatgtgtgcgcgtgtgctttcttgggactttttcttttttttttgtttcttctttcaggacaggatctctttgctgccctgctcattgggattgatttgctattgctctcacgatttattgatagatgaacgtacacggatctttgcttatagtatgtccgtttaagctgttcgattgattctttgctcactcttatatcctaagcaaattaagcatatagtagttattaccattaccaactttgcattgggttgatgaaatgttgaagtggtgcattttgatctagttttaatatgaacaatgatgaatgctgatatggattcaatgtgcctgtgctcatgtcactgcagtgagctattatgcctactatggcaagaagcttgaccctgagccgtggcgttgccgccgcaccgacggcaagaagtggcggtgctccaaggaggcgcaccccgactccaagtactgcgagcgccacatgcaccgtggccgcaaccgttcaagaaagcctgtggaatccaagaccgctgcccctgcgccccagtcgcagccccagctgtccaatgtcacgaccgcgactcacgacaccgatgcgcctctcccgtcactcactgtgggtgctaaaacccacggtctgtcccttggtggtgctggctcgtcgcagttccatgtcgacgcaccatcgtacggcagcaagtatcccctctaatctcattgactctgtgttgaatgcttatttgaattaagcttgcctagattgattgcatattatgctggaatagagctgatctggtagctttcttaaaagggttgagacactcaaaatagtatttgagctctaatgttgttgatgcttattgctcaagtagtgaacctaccctcattccagtaattataagtgtgtgaggctgcctaagaatttgtcgatcagagcttattcaatgagttagtcagatgagtgatactgccaatttacatgtgaccataaccccaactaaaaattttgtacctggattatgttagttaaatctgtgtattgcattccatccatccttgatgctacaaacctctgtgggcacaatgtcataagcatatgtctgttgcttgtgcctttagccctattatactgttgctttttgcagtaatattgtacgcttttccagatcacctaagccctagctgattttgacctttattgccctaactcctgattatgttttgagaaatagtgttaacagttgtcatgttctggggtgtttttggtccatgccctctaaaatcttggtaccgtcttttttatgctggaaaattttgcttgtgtcatcttttttgtgtgccataccttagtttagtatttcctcctctgctagcaatcacaaaataaaaatattgtaccttcgacaccatccttatgcttgtgctgcatgcatggcatatgttctagtttcgtgtcattttgcatttgcatcttgctagatgactgacaaagcttattttgctccttcgactatttttcgttctttttccttttttaactatagtaggttgtcttattatcgttttggtagcatttttcctatgcagctgcttttatgtcctccccttgagttgtagaaatcccttagctactgtgaacctgtaatcatcccattatattccatttgatgctgcgcaaatctacatgtactgtgtctgagtctggtgtctggtcctaattttcatgtatcaatggctatgcaggtactctcttggagctaaagctgatgtgggtgaactgagcttcttctcaggagcatcaggaaacaccaggggcttcaccattgattctccaacagatagctcatggcattcactgccttccagtgtacccccatacccgatgtcaaagccaagggactctggcctcctaccaggtgcctactcctactcccaccttgaaccttcacaggaacttggccaggtcaccatcgcctcgctgtcccaagagcaggagcgccgctcttttggtggtggagcgggggggatgctaggaaatgtgaagcacgagaaccagccgctgaggcctttcttcgatgagtggcctgggaggcgagactcgtggtcggagatggatgaggagaggtccaaccagacctccttctcgacaacccagctctcgatctccatcccgatgcccagatgtgggtcccctatcggtccgcgtctaccttgagcatcccttcaccaacatttctctcacacaattcattccattttctttgatgatgcaggtgattgagaactttgctgcttgtggcagcggggtggacctctaccccgcattttaccgctgctagtgagttggatcagtgattgcgcctcccctggttctttgttcaattgtatcgtgctatgaactagttaagagaaccctactttttttttctagtagaagagacagaaaactcttatccatcatcatgttttaagattccacgatgttttgtacctgcaacccacgacctgccggctgctggaagttactggctgtctgtaatgtttgtagtagatgatctatgatgtatcatgtatctatctacttgttccgaattgcggaaaccaaagccgataatctggcatgtgccaacgtcctccttaaagctcttgtgctatgtattttgcttttggtgggaaaaaagaagaaaagaaggttccatttttcttaataattcaagtttgtagaatcaaaaccaggcgtgacgttgtggtattcgttattccttttgctttgaaaagaagacgatgaaagaaagatatgtgcacgtgaactccaaaaggagaatgccgctcagatgttaactgcagccttttgagccgatatctgggagggatgatgcggcaactgcaatgcaaatgcaaatgccaaaaggatacaagaaggtaagggaaaacgagagagaaaaaaaagaaaaagatagctgagcctttggcaggagggagcacggcctgaacctgatgaacgtgaggtctccgtctccatctcctttggcaggca

SEQ ID NO: 58519 - DNA, 2781 bp, Oryza sativa
gtgataaggagtgagaatgcacatcgttttccgcgcgcacgcttcccaaactactaaacagtgtgttttttgcaaaaaatttctatatgaaagttgctttaaaaaatcatattaatctatttttaaaatttaaaatagttaatactcaattaattatgagttaatggcttatctcgttttatatatcttttcaattttctcaatccccttcttctcaaacacaatcttagtggagcttatacggagaagttgcaactgaagctcccataaacatttcggcatgctatttctgctgcgctgctaaccccgttcggtggtgggccccttctgtcagtcaccttccaattccccttgggcacttccccagtggcagttaccctattcattttttttcctcttcccggtcacaactccaattttgaactccaccgccgccatcgaggtcgtccgcggtccgcaccgagctccgtggattcctccgccgtcgccgagcctatctgagcgcgcgatggccacggatccgagaggtcggcggccgcggcaccacgcggcggtgaacgaagtgctctcgacgctcgccgccgccaacagcaccctcgccgacgtgcagcgccgcctcgacgccgacttccgcgccgcctacccggatcacgtcagtaagctagcccctcctccttgctggattctcccccacccccccgcgcggcgaggctgatgcgtttcgcggtctccccgcgtgctgcgtttttttttttcaggcgaatccggtgaagctggtggcgcggctgaagcggatccaggaagaggtagcggcggtcaagggactctgccgcgatctgctcacccagaagcaggttacccaaaacttcgaatcgaccaccaaatgcgcgggctccgcccttcttttttttttttccgcgactgacgcctatagtgttcgttgcgtgcacaggagttgatcgacgcaatgcggacaagcctcgcggtgcagcgcagcgccgtgcagcggctgctcgcctcctccgggctgccccccatgtccgaagaggacgccgccaccgacgccaatctcaaccaggtgaattcacccccaccgtcccctcctccagtcattcgtcaagacaaatctaacataattttaccaacctgtgtgcgcgcttgcagatcatcgatgagtggacggcgcatgttgggccagacacaggtcatcttctaccttgctctgctgttcgttgcagcgattgttactgattcgtgattggaaactgaccgcaaccgttagttgcaaatgctttgttactgattcgtgactggaatttgactgtaacgggtcccttttacaggagatgacaaggatgaggataccaaccaaatcttcttcgccgctgtcgtttagagcgagtgagagcggccacaacctagagcagaattctatgcaaagtcaggaggtctcatgctctgctgctcatgtcattgttttgtgtgttttggcgagaagagctgcccgtgctgcagcatgcggtctcaatttgcagatccatttctacaatgaaggccagcgtactggagctggccgcgatggagattctacttcacacatctgttgctgttgtggagagaattgattagaaaatcgtagactttgattggattgcggtgtggttagcaggagagtataaaactgagagcctgttagctcctctctcgcttttctttttgtgtgtgttattttacttttctcatactcaacctttgtagaatatgctgttgaatagtacaaagtgagggaaaaattttgcttcgtataagcaggttgatgcagattgtgatatgcttttttccctcttttttgaggaacagttgatgatgagtttgtcaacaaggaattgtgttgttgagtgcacacgaaaactgaggatttcttggtttgggaaagttattctgtgcttgcaatctcctttcaattctggacaagaacacttgctctgagcaagagcccagcaaaaaaaatcgctgggaacttccctgaacaaaagatacatctcagatagtcatgtactggttttgaaaaattatactacaatttctctcttgccatcatatagagcacagatagacaataacctaagctactaatctgcgcactataaacaggtacctgaacacaaacatcaatatgaaaataaatacataacccgaaacatgtaatataaattaggggcaattacttatttgaccttgttttgaactgtaattgccgatttgaccctactttttgaactttgcttatttgacgctccttttcgagtacgaagcttccgtctgaccctctttcgctgactccgttaaggttcaattttaaaaaaaaaagaaaatgtttccagagttcctaatggcaaaaatacactccaaagccaaaccctattctgactctttctctctctctctcactcgcgcgtacctctctctcacttgtgcgtgcgtgcggcggcggtgagtacgcgtgcggcgggggctagctaagggggcggcgagctgagggggcggcggcggcgtcaagcacagccccgccggcgcccgctcgttgtggtggagggcggcggtagcggcgcgtccggtccgggtcggcgccgatctgtggggggagacggcggcgagctgaggcagcggcggcgacgtgatgtacagccacgccggcgcccgctcgtggaggtggaggccagcggcggcggcggtttgatggggcgcggagcggcgccgatctgagggggtgagggcggc

SEQ ID NO: 58520 - DNA, 30356 bp, Oryza sativa
cccccccccccccccccccacgccacgctcccccgcctcgtttcccccgcgcggccgcgccagaaaggggagaaacgcttcacgcgcgcggcgcaccctagcttgggccacgatgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtaagatccccctctcgtctcccaatctcactcccgctccccatcgctgtcttcaccggtttcggccgtgatcgcgcggttttttgggttcgctcgacctgatcggtgctcccgttggtgttgtggtaggtgacggtcgcgtacaacaaggatcccagccccgtgaaggtcaatctcggcgtcggcgcctaccggaccgaggtaaggtgttttgggggaatttctattgattttttgctccttcgtattttggattggattggtggtggatttgacttcgattttgtggtctgatcggagtaggaagggaagcccctggtgctgaatgtggtcaggcgcgctgagcagatgctgatcaacaacccgtaagtctgatttgaaaaccagatgatccgcatgatttcggacctgggaattttttttaggctggctgagtgtacagattccgtgttcaacttgcctctagatctaacctgtagataatacggtatactccacctagcttgcaggttatgtactttttttgcgaacgcttgcaggttatgtactaataatatattagtatttggcaccattcttgctttgaatcgtccggctgacttattttattctacgaaaataattgttgacctttggtcttttagtgacctttcctgctctacctacctgtttttataatatttcaggtcatttttttgctttgcttttgttatatactagcgtgtaggattgattgatgttgttgcagcgctgggtatccaactgggtttgccttatcagtgccacactgccactagtttgtttggcccattattaccacttagatatatatttttagtgaggggcacagtatgttaatttacgagtactgcaggtctgcagctttgtgtgtgtacacagtatacatttttttttatgtatagacaatttcttggatgggtttacaggaagaaaaaaccattgactattttttacagcaaacttatgatgatattcccagttgtattttacctgtgattatttgctttgactaggtcacgtgttaaggagtatttgccgatcactggactggccgatttcaataagctgagtgctaagcttatttttggtgctgacaggtgcgttcctgctctcaagaatatatatggtcatatggtttcctcatctgttacctttgaccaattgtaacaaacagtaaaattatctcactaagataacttcttcagatcctttgctacttttggcttattcttgtattaggtaattcacaaaactgattatactatttattggaacagtcctgccattcaagagaatagggtggctacagttcagtgcttgtcaggaactggttctttaagggtgggaggtgaatttcttgcaaggcattatcatgaagtaaggaatctgccttggctccttcatagatactgatatggttctacattacaatgcaaagtatgatcgctaaattataaacgtgttctccagcgcactatatacatcccacagccaacctgggggaatcaccccaaagtgttcactttagctggcctgactgttaggagttaccgctactatgatcctgcaacccgtggactggatttccaaggtaccaatttcaattttccatggaggaacttgttcttatgaagaagattaattgcaagattgtttgcacctgtctgacttgatcaaggatgtgttttcgtgttacagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcaggtaaattattggcatccttaatacttatacttctagttcttaggaagcatgacattggttaatacttatacttctagttcttatacttaatacttatactaatttttctttctgtagccgtaaattccattggtttttgtccatacgacattttatttcaaaatagactttgacttcattattgtgcctgctatgctttatttgttcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtaagatatcttcactctaatatttgtcaagttcagctttgtggcttgcccatactttgttcgtagtcttgaccgaggttgctgtcatcttcatgctgttcatagtagcaactgatgtacctgtcatgcatggaaatttgtgtgtctattttatttcatctcacactggctattttactactagtaagagatataatcactatgagccatgatggctacaattcaagtattataattgtttttttgtcttgtctccaaaaaatattggagatgtttaatgaggttgagagtctttcaaggtgggaagttctaaacgaaagtaggacagtgaatttttattctttccagctccaaatatctctttcaattttgtcaatcacatgccaccgatgctttaattgttgaaattaaattttgattctaagttgatgccgacccagataataatatcctatttagttgcatagaaaaactgaacggaatgtaactttgtatttcaggtttgtggaagtgctgatgtagctgtcagggttgaaagtcaacttaagcttgtaattaggcctatgtattcaaaccctcctattcatggtgcatctatcgtggctaccatacttaaggacaggtaacattgatgtcataataattctagtcaaccatagaaagtgagctatatgttgagaaaggcatgcctagaggcagattcagggaataaaagtgtgtgctaagttctttttgattatatttttactagtgcaatgttcaatgaatggactgtggagctgaagggcatggctgataggattattagcatgaggcaacagctttttgatgctctgaaaacgagaggtaatagtttctgtcaactcctctatatcgtccttgctggaagtacataactaatgctatgtacaaagaaatttgatcattggccttttagtctttacgtttatttcaagttctgttttgacagcaattttgactaattctgtttatgtttagtctttacgtttatttgatctggaggcgttatttcccttttttctgtgaatgctacaattgaattttgactaatgtttcttactgtcaaagcagtaatgttgttttaaactagattttctttggctatgagaaaattttatattctatttttttcgagttgattaatcaagctcctgagacaagttccctgaattccaaatagtgcactaaaccaatagtatatttttaaagcatttatatgattctacttggcttgcacttataaccttaatgatagaaggacattgttttacatggaaaagctgcaatgcgtatttggctcgttgatctgggttttatgattgctcaatatttttgttttaaaaaggagtttttcttccctttttctgaatccattctctatggctaaaagtgaggtacattgtcagaaatattaatcattgttgacatgataacatcatgcagaaactcctggagactggagtcacatcattaagcagatcggaatgttcactttcactgggctcaacagtgatcaagtggctttcatgaggcaggaataccacatttacatgacatctgatgggtaattgtctaatttagctattgtgcaacactcgcaattatgtttgtatgatctaagtctgcagttatacaaactatataatttttagttctataacagtagatgatctatcttactgtttctatggtagtttcctttgctaaatgttcctttttagctcatctttacaagccaaatatttctcttgcaggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctgaggattcagacagtgatgtttgctggctgagcacatcctggaagtttccttgtaatagactcgtgtgacttgcttttgggagcagttttgtaccagtggattcagaaaaagtggtgatttcgaatcacctaataagctccatcggtgatgcttttaccatatgcagcgttatataatcttagaattctaggaagctagtgcttgttttatgcgaacaaatgcgtaccttccgttcccttccattggcggacagggtatacgacatacgctgatacagagcatcagtgccattcagatgcattttttttttcgcggagttggtcacatgtggatttggtggaacctggtctgtgatgcacaagtaactcagtattgattactcctatttaagtcgggttatgtagggcacgccatgttctgccctttaatatgaaatgaaacatgcgttttgccctatatcaatatacacagggcaaagctcttgcctttgtttaaaaaaaggggaaaaataaagaaagaatgagggggtgtttagtttcagggctgtaaagctgtaaagttttgacgtgtcacatttaggtattatataggatatcgaaaggggtgttcgggtactaataaaagaactgttttaacgtgtcacattaggtattatatagggtgtcgaatgtggtgttcgggtactaataaaagaactaattacaatatccgtcagtaaaccgtgagacgaatttattaagcctaattaatctatcattagcacatgtttacggtagcaccacattgtcaagtcatggagcgattaagcttaaaagatttatctcgcagagtagttgcaacctgttcaaacctttgatgtgacatggtgtaaaattttaaggtgagatctaaacaggccatgaatgaaacatgcgttttgctgtggccacacttccagtcttctataccataccgttcattgttgaagactctggatctttactattaagaggaaactaaagagctactcccttcgtcccataatataagatattttagagggatgtgacacatactaatgctataaatctggacagacgagtaataagctaccactttcgtttagagggcctgcaaaagtgcaaattacttcgttaaagaaaaagagagatgcacatgtccactcgcgacggcctagaaactacaatgttaataataaagaaaagttaaagaaccaaatcaccttcacttccacatccagaagttaatcgtcttgatcagatcatggtggctccatatatcatgtagattaatagatataattgtatataaaaatatttctagaaatgggttcaaatatataactaaaacaggttatataagtaaacatttttgcgaggatatatagcatgtactcaaacttcagttcaaacagccttacaattgcgtaggaaatttaactagttttagttttaaactctgatgaatctctacatatttttaaacccgagcgtcgcaacagaaattatagagtttctaacatattaaatcaattaataaccgaataagtctaagtaatactatggttttttcttattgaacaggtaggtgaatcaaaaatttggtggagccaatagtaaaataggggagtaatttttgaaatgtgggttaatattatagatttgtggagcccaaatgttagtggcaagggtggtgtgggaatggataccatagctactaaaacttttaactatatattgagcaaatgtggtagtcctaacttttaatcaatatatctattatcccctactctatggctgataaaccacaaaaaatattgaagaaaacaacaaaataaattattagtaaaactgaacaaacttgtcttaggaatcttcctagataaaattcaaaccgaagaaatacccagagtaagacaaagccaagtttcgaggaacttttaacagctggagaggtactcccagaatctctagctctaaaggttgcgttcgaatgtggtgttggttagctatatgtgaaatgaggcaaatcatcattatcgcatgagtaattaaatattataaacttgaaaaataatttgtttttataagaatatatatagaaaacttttatagaaaaaatatattgtttagcagtttgagaatgcatgctccaaaaaaagaacgatgaagtagctaagtcaagtatttgattcaaatgaagcctaagtatctacttatagaaacttagtacccacaaactgaatagactctcaccatatacccagtgccgtcaggaggatgttgaattggggtatatttgttcaactctatgctgattaattttttcttgttctgtccctattaactcataaataaatgagttcctcttgaaaatatgtccccttaaaatgagtggatactagcaaatgtttgttccaactttttatggcgtgatttgattaatagcggaaagagattccacattccagcatattttaaatttttttatcggatccctggaaaaggttcccggcccaataccaacccgtttacactcctaagtcctactaagtcctaataaccgagtggtttcagatctcgtttacatggaaagttggttcctcctccagccaccagctcgatcctttcttcctcgttctcgcgatctgacctccccatctctcctcactcgatttcccggcggctagcgacgcgggaggaggcgcccggccggccggcgagcacgtgctgatagcggccgaggaggcgttgcggctggacgaagagcgccgcgtgcagcgaagcggcagtccggcgagcaggaggtggatctggacggcgtcgtcttcgcctgagccagcctcaccacgcgtcggcctcccgaggcggggagttcatccgcgcgaacggccccggtagcggggcgaggcgttccgaatctggcggcatcctcggaggcacacggcaacatctcggtctgcttgttcttcacgctgcgccacaagctcaactgcaatggccgccgccgcggcgtcaagctcgtcgccggagttctcgtagtagccgaggtgccttgctccttccatttcctccatctccgtcctgtcgttctccactgctctagctactagctagcaggatatactccacgaatcgcagaaatggtattcaatgccttgtaatcgttcagaaaactaaaaaaatattccgcaatcgcccacttcaaccccaaatcccctgttttccaatccccttcaccttttcgcttacaatccctataccgaactccatgctattttctgctccacccatgttgattggcacggtaaagcgcacagctcatatcaactttttttttttgttttctttcttgccggcatctcagatcaacatatcaacgtcctgaactgttctatttgtctgcaagtacctgccgagatgttatggttatttttccttggacagtatgatgcgcttttcaatttctcattcagtttttcttttcctgtttctccgattttcactcttcctgattttctatttaaacggtaggaaggtagctgtccttgcctgaaatagaaatgtttagtactgctcaccttttggcagtttctgcatcatgaaggtcattgaaatctggcatttaagttgtaatgctcatgcgtcgtgttgatcagtaaaaagtgttgctattctcaaagttctagtttgagtttatgaaaatttattctagaagttcaaattatggagggaatcttttgtttcttctgcagatactgattttcacggggatgcattaagctacggtctaacttgtgggagctggatactgctgaaaaggggaccaaatggagcttcagcaggaaagctcggatgcggggactttgttctcggcgccatcaaggaacctatcatcctcttcatcagcatttgtttctgctaaccaatcccctttcttcacgccacgatgtctatctgcccgtgtctcagatcacgcacatcctgagaacaatagttccttgagtggtactgtgctgaaaatcagtgatattctttccagcgacactctgttaaagcgggagcaattaccatcagccactgtggggttattgccatcggatgcttctcctcctcctagtatttgcacttcaagcaattttgacactccagcaattgtctataacaatcctagcttcatttccaccttcagtgacccatgtcaaggcagttcatcagcaactagcactggtgtccgttcaactcagaaggagaagcataagagacagtggggattatatcggaaatcttcatcctctcaacctacgacatcagctacctctgtcaacagacttcggagctttgatgtgtacataggatttcatggccgtaaggcttcactactgaggttcactaattggcttcgtgcagagcttgagatccatggaatcagctgctttgcttctgacaggtctagatgccggagttctcacagccatgatactattgagaggattatgaatgcttccacatatggagttgtcatccttacaagaaaatcatttggcaatccttataccatcgaggagctgaggaacttctttggcaagaaaaatctgatccctatattctttgacttgggtgctgctgattgccttgccagagatattattgagaagagaggagaactgtgggagagacatggcggcgagctttggatgttatatggtggaatggaacaggaatggagggaatcagttgatgctctttctcgggtgtcagatgtgcaattagaagcaaatgatggcaattggagacattgcatacttcaaactatcattgttttggccacaaaattgggcaggagaagtgtggttgatcgggtgaataggtggagaggaagggtggagaaggaggaattccctttccctcgtaatgctgattttgttggtaggaaaaaagagctctcagagttggaactcattttatttggagatgtcagcggagatggggaaagagagtattttgagatcaagacaaagcagagaagaaagggcctcgtaattggacggtctgttaacaattatgagcaagtaaatactgatgatggtaaaggaaaggagccggttttgtggaaggaaaccaaggaaaacattgagatgcagagactggggagtccaccacgacatggaaggccatcgagaacaaagaatgatggcaggtatgggaggaaaagaagatgtaggaagatactctacggaaagggtattgcttgcatttcaggggaatctggaattggcaagacagacttggttttggagtatgcatacaggttctcccagagatataagatggtcttatgggtcagaggggaaagcaggtacattcgacaaaactacttagctttgcggacttttctggaagtagatttaagtgttgatagtcacttgcatgagaaaggaagtgaccgatgctttgaagagcaggaagaggaagccattgccaaaatacggcaagagctgatgcgggacataccgtttttagtaatcattgataatcttgagagtgagaaagactggtgggataagagagtcataacagaccttcttccacattttggtggagagacccacttcatcataacaacacgccttccacgtgtgatgaacttggagccaatgaagctttcttatttgtctggtgccgaggcaatgtctttgatgaagggaggcgtcaaggattatccactggtggaaattgatgcactaaaggccattgaagaaaagcttggaagactcactcttggccttggtattgtgggatctatactctcagagcttccaatcactccgagcaggcttcttgatacgttgagtcggacactgcccataagagattgttcttggaatgagagagatgctatcagtttgaaaaatcatgaaatccttgtccggctcctggatgtctgcctatcaatatttgaccatgccgatggtcctaggagtctggcaacccggatggttcaagtgtgtggttggtttgcaccttctgcggtcccaatacatatgttggcgttggctgcacataaagtcccaaagaagcatcggaggggtccaaggtggaggaagtggtggcgaacgctgacttgtggcttggctacatctaggatgaagagatctgaagctgaagcagctgcaatgctgatgaggtttggaattgccagatgcagcacaaagcctgaatatgtacagttccatgatctgatcaggctatatgctcgaaagcgaggaggcacacgaatggcacaagctgtggtccaatcgatctacctccgaggctcaattaaacattcttctgaacatctgtgggctgcctgcttcatgttttttggatttggttctgatcctttcctggtagaaccgaggccatcagagttgattttctttgtgaagcagatcgtcgtgccacttgcaatcaacacattcatcacatattcccgatgtaatgcagcactggagctgctgcgtctatgcactgaggcattggagcgggcagctgactcaatgctttctcatgctggcaaatggagagaaacaccattgtcctgtttcaggccaactcagtcagaagcccaatacacctacctttggcaggagctggctcttctgaaagcatctgtattggaaacacgggccaagctgatgcttcgaggtggacagtatgacactggagatgacctaataaggaaggccatattcatcctgacttccatttgtggcgagcaccatcctaacacggtttctgctcgagaaaccctcagtaaactcacaaggcttcttacaaatgttcagcttagttgattcatatagcttaggacttcaccaatatattcttttcagtgtggcttttcataaacactgtacaaaatgccccagatcatcaaataacaaaagaaaatttgtctacacaatttgcacaggtttgcttctttggttaaagcactctcttgttactttcacctttgtgatgtgatcctagtcttaacacgcacaaggtttcaggcatcttcctctggtgttgatcttagtaattaataactggcaaacatatacatttctctccttttcatttctcatcttattggtcattttattttgggatgtcttccccctggctcaactgttctttttattagtcattctattaaaagtatcagctcaggtagttctgaagtgacctagtcagatgcctgaattgtatatctcaattgtgtcaagatgaataaaaagaggaatattctatcaggcaaaagaaactagtcgtctccagcagccactgatccctacagttttagtctctagctagaggtgatttcttctatcatataattagagatgtttcacgatgttggatgggagtcttgcattatggtaactgccagatgaaagttggtgaacaattatttatttctgtcagctccaaagatcatagtacaaattaacaaccatgtgatgctgatacttcgatgttgaagtaaggtaatgttctacattgattcccattcaatttaattgtttgtagcgatttatttttgataaaaagatacgaggtaataggcatttgcattgagaaactaaaactgcaattttgtgcttattaaggtctgtggaagtgttgtatagctgttattggggttgaaactcaactcaagcttgtaactattctaattcttatatacacaaactctcctattcatggtgcctctcatgcctatcatagttaaggacaagcaacactcatattacagttctggttgaaatgcatgcttattggttattgcagattcacgaaatattaaagaaaaacagtgcttagttcttgctgttgattatgtctactagtgaggcattcaacgaatggaccgtggagctgtagtcatagcttttggagaatggaagtataagttctggtctcttcttgcagccttgcacagaaccatatttgtggacaccaagatctgaggcaacagctatacgcagaaaaccatggttgaagtttcaaccaactctatttcgttctttatggcaatttaattaaagttatatgtaaacttggtaaggcttgatcattgcccttttagtctatgcttttttctcaagatcttttattacaactttgagttgcttgccccattttctagaatttatacaactgctgtgaactaatggttcttcagcaactgggttgacagattttacatcaatttttttgaacgggaaaactcagagcagttctggcctattgatatgttattttatgattattaattctaccttttctattttttttccagtgctttttaatcctgccgccaatgttctgaacattaccttgttagcttcatgaagaaacacctggaattggagccacactattaagcaaattggaatgtttactttcactggactcagcagtgatcaaacgacctccatgaggcaggaatgcctcatctacatggcatctaatgggtaagtcgatctacttcaggaattttatgttgctatcataaaaaccattgggcgtgtcaagtttacggttgcacagtatataatataaagcgacctgagtgaaatatgtcagcggtccttaaaacttgtaagcaggtgccttttagatccacaaacttgtataaagcaaatctaggtccctgaatttgcttaagtatgctgtctcgatccaaaatcactatatacctttctagtgctgatgtggatgttgaggtgacacactatgcatgtgatgtggcacataaataagaaaaaagaataaaaatggtgagacgggagaggtgcgtaaggcgttaggtacatcagtgccacatagtctcctagtcctagaaggacacatggcaggcagctctggacttatatgctattggagtactgtaataagtgggatttggatctgtcttttacaagttcgtgaacctaaataattatctatttacaagtttaaagactactggtgtattttactctataatataacactctccgttccataatacttcctccatttctaaatatttgacaccgttgactttttagcacatgttttaccgttcgtcttatctaaaaacttttatgaaatatgtaaaactatatgtatacataaaaatatatttaacaatgaaccaaatgataggaaaataattaataattacttaattttttttgaataagacgaacggtcaaacatatttaaaaaagtcaacggcgtcaaatatttagaaacggagggagtacttggtaattttgacttggcattgttttagcttgaccactaatattttatagataaacctacaagagtattgaaaaatagaacatattattgaagtatgatcacagtaaatatgaacatataaatcccgttcatcgtagttaaacaatttgaaagatatcaatgctcaaactagagcaagtgccaatcaaaattgccaaatactccctccatttcaaaatatttgacaccgttgacttttaagcacatgtttgaccgttcgtcttattcaaaaacttttatgaaatatgtaaaattatatgcctacataaaaatatatttaacaatgaatcaaatgataggaaaagaatgaataagacgaacggttaaacatgtgctaaaaagtcaacggcgcgaaacatttcgaaacggaggtagtattatgaattggtgtttgtgttcgttctgtgttcttgccctcggattacgatttctgttgcatccaggaaatgttatatcttaagtttttcggttgttgacacatctggggattgtccttttcttgcacacctgcatgaacgtcagtagatgtctctgtcgtatacattggtcaacccctcaaccccttgaaatggtacagaagattctcagctctacaaacccagaagccgaaaacggcgggctactcaagcgagagcccagtttgatcaaaatatatatgtacactatgtgataatacatgcaaaatatcgtgccactttttaatggcgacctggtgggcttctatgcgccccgaacaggttgtccatgtacgtctgcttcaggttcgtcatgatgttgggcagcttcatcagccttccgtcctcctgtgcggccggctcaggcgccgtcggcgagggcctatcggcgtcaccgttccagtcatccatgaagtcgagcagcgtcctgccgttgggtgaccctgtcattttgcagggggcatccacctcgccagcctgctggtggtggtgctccgcggcgtcgttggccatagccggcgccggcggcgcctccttcttggccttctccctggcgtggtcgtcggcgttgaggacgtcctctatccgggacatgacgttgaaggccaagctctccagcaccctggagtagctctccaggatggcgaacccgacgtcctggcagcccaaaggcgaaaagtgcgtgtgtcatcaagctggacactaccccgacattggtcggacggctcacactggagtaaaatcgtgtgtgatcttaccctgttttcctgtatcttggcgatgtcgagggtggactgggggatgccggggtaccggtgcttgatgatgagcaggagcgtctgcgcgcgctcctcgaactgctccctcttctcctggctgacggccgatccccacgccgacttgccgtccttgttgtgcaccttcctgttccagatgatcaccgacgcctcgatccggtccttgaggtccaggatcttgtgctccgacgtaaggtccaccgtcgacaggaacacgtccgggtcgaactccacgtcggtgatgatccggtacagcgcgtcgccgaggctcgccctcccgttctgcagccacccacattcttgccattgtcaacagatgtcttcttgcacggtggatggatggatggatcgtgtgagctgccagttctcaccttggggagggattcgaggtaggattccgggatggccatctccatgaggcagttggcgttgatggccatggccgccttgagcacctggttcaccagctccttctggtgctggagccaccctctggacgccggcgagagcccgccaggcgggaccttcacgatcgggatccaccatttctcgtctgatctctgctcgtcgctatccgagcacgagtcgcgcttcacgtaccagaactcgttccgatccttgaagttgtccaggtaatcctgccacgcaacgcaatgggggaatatcacgctgttcgtctcggtagctttgcgagttctagcgatggtgagatcgatgtatgtcgcgcttttaccaggagcatcgtgtcgatcttgcgcaacgccggtatgttcgcctggagatctctccgctgctgcgtgcccatcacctgagacgagcagagagagaaagatagcaggttacttgatggagctgcacacctgtgacttgtgtgagctgtgatctatcctgagctacaagcggctgccgctgctgcatggctgacctccatctcaacgccgttgtccaagacttgtttcttcgcgacgaactcgacgatgtgatcggcgacggatagaagccagccgacctctttcttccacctccccttcctgtccggcgccatgggctccagcttccgttgctcaccaaacacagaagctgatgacaaaagaagttgctctcaccactgctacatttcttgcgtgtgcccccccaagatagagatggaatttgggcaggcagtcaccttacctgcaagattggtgatggcgttggacacggccagcgccgacggcacgcccttcccggaccccgacatgtcctccccgagcagcagcttggcgaacttctccttcatcagctccatctctgcacgcaagcgtctagcgtcgcttcaaaaccaaagccgttctgtccatgcgcggcggcgggccgtgttcgatcatggcgacgacttaccggaaggtcctccgccgccgtgttcgccggtgtccttggcgagccgcgacttgggcgccgcgctgtccttgtcgagcacggcgccaatcttgagcgtgccgccgccgccgagatcctcatcggccggcgtgccccggccctcctcgctcaccatactctgcgaccgtcgcaccgagcttcgtctctctagcagcgacccaccgccgctcgctgccatcaaccgatcaactccaccgtggccagcttctcggcaaccaaccaaacagcaacaacaacaacggcaacaaagaaatggatccggtgacacgacacgtcgaaaagactggaaatcccaccatgatactacccaaagtgtatatacctgtaaaggacgcagctttctgcggcctcgagcgacgtgtgcagaagcaaacgatgatgatccaggattggcgctgcagaacacccacgcagagagagccacgagaaggaacaaaaaggggagggttgaaatgattaatcccgaggtgatgatgattgttgtttgtcccggtaatccaagaaccgggtggttcgatcgatcgtccgcattgtcgcggtaagaagaagccccggggaagagggggagcataattagggagcggcacatgctttattattagaaagtgccttgcctgccatagcgccattcttagccaccctgctttcctgggagctacctagctggaggaagaagacgaacacaacacatggagaattcgtcggggtcaatttactgaacaaagtttgttgtcctacttaaatagttaaatacttcaagcatgttcggtagacttatgttccacctcttatagaactgaagtcaactaaacagttttagcttcatccttttattacgtgaaatttgtcacgacacatgaagacctgagagatctgaataaatccagtgcaggtcctatcaatcgggttcaggacgtgtcaattcgtttaatcatgcaactaacaagataaatagacagatcgtatcggatcaaggagctgatcagccaatgggctgatgtgaagtcgagtgaccagccaatatcgataaggtttagatcaacggttatgggttcgatatagattcaaatatcagataaacaatgggattcttgctatcatcggctagaactaaacttcacataattatcaataaaccattctttgtcaaatacaatcttgatagatcggatcgaaccgagacaatataagattgaagttaataaagagagatttaactagtgagtatacgagtttgagtataagccaatacatcacttagaaatagtagcaagataactcatcacctagaactccgatgaaacgttgcataaaaacctatcggtttactagaatcagacttactagcaataatctaatagatcggagctgaccgaaacagtataagattgaagataataagaaaaccctatttagccgatagatctacaaaaccgtgatggatatattgaatcaatctaaaacaacaatgtgattggagaaatattaacttaattagaatatcggacctaactgagaaagatctaactaagccaatacgactctaaacaacggtacagttaaaaataggatcgatatatcagataggcaactgtcgaggggtgaccctctctagcgggaggctgtgaggcccccctttgagagttcggccgggggcagcgggtgagattcgaggatttggtgagcgaaactgtgtgtgatcttgatctcggaggctcctccaagacgatgagacaaaagaggtttatacaggttcgggccgctatgaagcataataccctactcctgtgtgtatgattcttctgtgcttagaaagtccatgaatccctggtatgtaagctagggttagacaagctttggctcagggatcctcagtccgatcccccttccttgctaggcattgtcctccttttatactctaaggggataccacatgtgctgcgagtgctacctagggagaagggaaaatattctctaaattaattacatgtcttgtgccttagcccagaatctatctgcacgtcggttgctgcgcggggcccatcaaatcatgcagggcgcccttgtcattcgccatttaatggatgaggacttccgggttctcgttcacaccagaaaacgggaacccgggtcagttcagagtggttggaccagctctgatcggggtaagaggctgtgaagcccctcatcattatgatgggacgggacggagcacgccgctcatcgcctgacacactggcagggcaggggtacacagtcgccgtcacatcggtcattcaaccggtcacagaccggtcagatgcgcagcacgttgcattacatgtggcatggcacggttgcatagaccgctttaaatgcagttaggtgggcgttaggcgcgcccacctaaccctgtacacgtgggctgatatgtggagggggtcggggcagctcgaccccaagcgagggcggcctcctccctctagcttggaggtggcagccgccacgccaccccgggctcgacccccctcgggggaagccacgtgggtttggaggtggcccaaccccaagctgggagggggcagccgccgcaacaccccgggctcgacccccctcggggagagccacgtgagtttgagggcggcctcctccctctagctgggagggggtagccgccgcgccaccccgggctcgacccccctcggggggagccacgtgggtttgggggcggcccgacccaaagctgggagggggcagccgccgcaacaccccgggctcgacccccctcggggagagccacgtgggtttgagggcggcctcctccctctagctgggagggggtagccaccgctccacctcgggcttgatcccctctcgcggggagccacgtgggttgggggagttgcccgaccccaagctgggagggggcagccgctgcaacaccccaggctcgacccccctcggggagagccacgtgggtttgagggcggcctcctccctctagctgggagggggtaaccaccgctccaccccgggcttgatcccctctcgcggggagccacgtgggttggggggttgcccgaccccaagctaggagggggcagccgccgcaacaccccgggctcgacccccctcggggagagccacgtgggtttgagggcggcctcctccctctagctgggagggggttgccaccgctccaccccgggtttgatcccccctcgtggggagccacgtgggtttgagggtggcctcctccctctagacgtgatacccctgggcccatatcaccgacagcaacgcttgcttcaacttgaatataatattgaacttaactgggaagttctagccacaacgatacaaagcttgacaaaacttacttttcgctggagatcaaacttaaccgattcagccctgctcgaaagtaagaactcgccggaataaaaggcggcgatgcgctgaaggtaattgtattgatatgtgaagatgtcttacaaagatctcaggtgtacatatttataccctcggattgatacaagttctaattgaatacgatactaagacttcctaataaatgaaactgtcttgtcatggtcttcacaatttctctttaaattcagcttgatctggataaactttcttctaccaattggcttattttctttaaccgagtccactggtgaatcataccaaaatttaacgttaacgtctttatagtggagctggatagaatgatctgaagatgaggtggaattgttgagacgcttcacaactctactccgctccagacttggttactggatttagacctctgggttgatatcgctctcattatgtatcatgaaatctgttgcgaggtttggggttgctagtgtgtatagaacgtacaaaaaattatttagacgaacatgtgcagaaaccgaccttagctcagttggtagagcggaggactgtagtatgtgcagattaatccttaggtcgctggttcgaatccggcaggtcggaattatttttttttctttttttttctttttagtccttccaagtgaaacctaagttcccctcttctctgttgtcttcaatttgagatgtgttattattattatttttcctgagacctttatttttcctattctttttggaggaggagaacaatgacttcgatgagagttacgatttgaactcgtcctagcgcatgttgctaaaaaaagctttaaagacgcgaatttgattccagcaactccagcaattcgtataccgattctgaataaactcgagccctgttgctctcgatccaattatgtactacaagggaaaccaagtcattctagaaaaacattacacaacaccaagtggaatcgcatgtttgaccagcaattccaatcttttgcacaccctacttccaattttctactgtgctatcgtgcgagtacaattcacgctccatgtatcgtgccagccgacgccgcctcgtcgtcgtcatcaaaaaccgggagagtaaacttgtagcgcccgctggttattctgattgattattccgaatcagatgcatgttagcttctcgactcgtggatgtcgctttcagctcatctgctacgatgctgcgcctttgaagacgaggaacctgagcgcccccagcttgaagtagatgaagcttcccttgctgtgcgtgaagtagcagccgaagctggcgcccaccacgcactgccatcccggcccgtggatcatgtcaaactcctgcgcatatgcagcaaagccattcaatccaagtgttgccaggggtgaaattcaggttgattgatctacggtctcagatttcagtcttttcagatgaatgcagaaaactgaaaacaagaactttgctcttggattgaccaattaaagtagctaaggattggtgcgaatggtagtgattaccgaccttcttgatgtgagcggcgatgctccggcagtcgaggacgtcgaagcggtcgagggccttgtacgccgccgacatcgcctgcagctgcatcttcaccggcatgtcggtgtcctccaccatcgccttcccttccaacatggtggtcgtctcttgtgactccttcctgcccagccttctctgttgcaatgctcgaaatgaatgcacaaagatgagagcaaaatgctgcgtctctcgtccctttttataggacggatggatgcgtgaatgcgtccatgtcgacgtgacgtgcgaacgacccagcctggacgagttcccggaatccggatggatcgggcactagaggcacagattcaattgctgggtgctcccgtccggttgtgaaactggaaacagtgggtgtttccgtgttggatatttttccgctaccagttttttttttccatctcgtttttctcattctttttatcgtagtggggctctttgtttttttggatgagctggtcgtgtggatttcggtgtctgggtttaatatggagaacatggtatgtgattggaacttcaaatggggaactcagcagataggagaagttcgataagttaattgcttgctttttggttcctatcgtcctatccgtgttgagttctccacgtaagcgtgactgcgtgagcgtggagaagtcttccggctgatctgatctgggaagtagtattaaatagatatatgtgcttggcttaatcgtaacatgtgataattatgcgtggtaggatcctgatccatggggtacagatatgtgcaggattatttttattcatttatagttgatcttgcagttcgaattgatccatttaatcctacctggcaggagttaagtttgagcaaagattgtagtgctggtctaactgccttatcagggcatctatagtcaacctgcaatgcgtgaattgttatcttatacggataagggcaccacgctgtctttttttacttttactagctgaatacccacacattgcaacagaagtttaaaaaagaaaatcttatcatacacattttagatactctaaacaaattatctctataattttctctaatcatctaagctgcttttgccatcacttttatatgagaatttggaaggcacgtacaccctgacaacaagaacgaccccccttgtcagggagttgatggtggtggtcggtggtagattcaccgctcatcaccaccattagagcttttttaaaattgtatatattatttatattataaaatatgtagcttttttatactttaatttacacctatagttttgtgctaaatttgatatttaatttatagttttacgacataccaccttaaatagttttttgtcaaaaacttaaaaagtaagatcaaactatccctaattttacgaaaattactttttttttcttacctccgattttcctgagatccgacaggcaggccgccgtgatctcacaggactcacagcgcgtcccaaggctacaacggctgagacgatccgccaaccaacgattaatttccggcagcccaggagcggaggagccctgcccagccgctagcctgacgacacgccgaaaaccgatggctgccccggcgggacctcatgtccaggaggcagaaaccgcccgatgccaccactctcctgtccaactgggcccaacgcgtcgcgcccgcagatctatgggccgcccccacccacaccgtatcgaagaggtgcagcgccagcctgccgccgctggcgcaacaccacacgggcacgcgccgcacagcgaaagccggattctccaccacgacgtcccccacaaccgcgcaccagccttccggtgcgcttctcgtggtcaggactagtcaggcaccgcgctctctctgtgccgggcgctcgctacagggagagtgtagcggaggcgtgcgcgttccactgttcaaggacggacggcttcgttccctctccctttcacaaggtcggctctcttttgatcgaggaagcagatcatttctgcaacgggacagagtgcgcggctactttcacctcaccagcataagcacaacaaaatcaacgaatgaaataatggccaactagaagaacatctacattgcctctgctcagcattctgagttctttctgacacagacacaaacgattcgatcgcgcatcagcgacgaaatccccgtttccctcaaacttctccccgtgctggttttaagacggagggaagaagcggttgaggttgaagggcaggctgtagaactcctcgctcctggcgtcccccttgaacgaccggaacggtacccaccatggcatcccccggtccttggccgcgtttttcacctccagcgtgttgtccaggaagacggccacgatcagtccgaccgtcggaggcgatgagaagatagtgttgatgtagtcgttgaactgcattatacagcacacaaaagttagtacctgtaattcctaactacgcttcagaagaatctccactgcaactagtattattgtaagtagaaataatcttaaccgttggatttatgagttttactaccagtgaaaaaaaacattttagtagaaataatcttaaccgttgatgtccccattgaattaaaaaagataaacgatctaaatatattttactgacagttgtaaaacatctcatttatctaatatcaagttgtcaacatgttactgttgaatttagaaacgcagaacaatttgctacataggtgagccatgaggaaggtgataaagagggacaaacccatccagcttttgtgtgcgcagggccacgctgagcggccatgctgtaccggaaaaagtattcgggcacagataggccaagaaagatggagacaccgacgataaagaggttgcgcatggagttcatgttagtaaactgcaagaaggagagccccactgccgctgaaagtcaaacaaagcaaatgtgtgagacaagaacaaaaacagtggcgtatttactcgcatcagatggcgcagggtaaccaaccaactagtccaaacaagacgcagtacacggccgcaaagatggtaaatgggatggaagcaaacaatgctccaaattttcctgcgccagatggaaaaaggagaattcaggaaaactgagctaacattgggcatgatctgcacacagttaaattactgtcctatcaacaaattactcacctagcatggagaagaagatcatgaagccggcagagatctgtataactcgtcggctcccgatcctcgttgatcctaacaacccgacattctccctgcattgatcttaacgttatcaagctggaagtaactctttgataaaaaaaaattctgaagttcactcacactgacacggtggagccagtacccgttccaaatagcccatcaagaaggataccaattccctgttgtttatggagtatcaacttaattacagctctgaacaacattcaggagtaaaaaacaagaaacaataggatgacttaaatatccacctgccacccaatgcctctactgaggatatgtgctggaggtggagtagcacttgcaagccgagccgcagctttgtaagaagccgtggactgtccaagacaggctttgagttaagttcaaggctgccacgcaaagaaatggctcctgaagacgagttatgaggggcattacctctactagcgataccagaacagcagataccataccaaaggattgaccggcactgaaagttggtgcgccccattgtagtggaaaagggatcttaatcctggagcaagtccctattgttagcacacacacactaactgaagaataaaattatccaaaaggatcaactgaagaactatctttcagtaggacaactaaacttttctgtgggacccatttgtcactgtttgcgagtcctgtgacccatccaatgcaaaatgtacaaggctgttgaggccccaaaggttgagcttaggcctttagtcttttcttttttatctattgatcataactttaaagtcacgatcaagtctcacttctaggtgactgaacacctatacaatcaactaaatctggttaaactaagaaactttgacatagagcatgtagtgcaaagaagagcttagcaaccaaagtcccatactaaggatagcataaagcacattaacaccgtaaccattttagtttacttggcacattaaagatatcacaaattcgatgggaaaataagcagagacaaaccatggcgcggaagagatgagattggcacggtcagtgcggcagttgatctgagtgacctcagggctatgcttatacgcgccacctgcagtgaggatttgagcataggcccaaaccaacgcgatgcagatgaacagggagaacctctccagtattggaatatctcttatctgtacattcttcagatactgaaaaacataattgacaatgcacgagttagactcaacttcaaatatggtcactagcaaaagaattcgatcattggagttgcttgccaaacctgagaaagcacgacaaacagaattaacattggaagtccaacctcaacgcatctcccaacctgacagtaaaatcaaacaacaatgcaatgcaatgaacaatctttcctgtctgaaaaaaaatatactgcattgtatgttctgcttgcgtgtcgaaaatgtgaggcgtcaaatgaacagctcgtaccacagggaatcctctttcgaaaaggccaaacccgagcaatgcaaccactggcgccatccccaacgggctgaagaatctgaaaggcaaaagcagcaacaccgcatgagaccatgacccatcagtatgggagcgtaggcactgtcgaaactgaatctgacatgcacacgcacgtaaccagcagcatccatccatgtgttgttctaacgtagtactaggaggagttgaagggcaaacctggagaaaatgccccacagctggctgtagccgaggatgatctgaatgctggaggacacgatgagtgccccctgtatcgccctcatggtctgaaggaacctctgctcagagagagagagagagagagagatgaacagcagatgattgtgatcagacacgcctaatctaaaacagtagaggcgattggacggatggatggacagaaagaagagcgtccgcctgctctgcttacctcgtggtcgtcgggtatggcggcgagcgatgagtcctgtatgatggccattatcgggaccacgaacgcgtaggatccgccgatcaccgtgggcaggcgcgtcccgaacagcgactgcagcagcgtgttgatgccggtgacgaacagcagcgtctgcaccaccctcaccctgtccccctgcgacagcagaaagcagaaaagtgagttctcaaaccatgggtggtggcgaatggattgggggaaatcaacaagagtgcggccgcggcggcgctcacgtcgctcccgcccatcatgggcaccagcaccgccgggatcatcaccgccgtgcccagcgccaggatgtagtgctggaatcccagtatgatcgcctcccctgaaacagcaaaaatccaagacgtggattcagaatgcgaaatcccgagcaggaaaaaatgcaatgcagccgccgccgcttcggctctcacgcaccccagggagggttggagtcgatgcagtactcgaacccctgcagctgctccatgggcgggtagctgatctcttccggcttcacctcagccatcgtcgccgcaccaccaccctcttctttgcccgtcaggatcccgccgccgagcaatgaaaacacacgggaacaggaaaacacacgggttcctcgcttatgtaggcgccgctgcgtgctctctccttggcctctctctcgagaaggcttctggagccagccaggtgggggcttattcagcgtacgcgctccggcacggcacacggcagcgtcccccttccgcagggggggagatcaggacgaaatctgttggagaaaaagccgcgagagaggatggctcgtctgcgtgagagagggaggcagcgcaaagagcaaattcgcactctcgccggcgcggctactgttcactctcacactcgttcgtcagccttggtcctcacactcgctcactggggccgtttgtcgtcgtggtgctttcttcttctctcccttttgcttctccattttttcccccttttatccgtgtttcgagtgcttcttccctccttccgggaaactgaactggccgttggcttttttggtgtgaccgaattgcccctccgccactcaccagtttccccttcgtgcattaactactccctacgactagccgttcttttttttttttcctaatcctgcgagtaaaacacgctgctgtttcttcgttttgttttagtttaccgaagatgctacactttcttactctaataatcctaggacaaattgcaaatctggaacatctttctttcacctgattttttagtagaagtccaaaaatatgttcatctccacccacttgacctgtttagttaaaaaaaactttcccacaaacatcatattaaatttttgaatacatgtatgaagtattaaatatagataaaaataaaaactaattgcacaatttgcatttaaatcgcgagacgaatcttttgagcctaatgagtccctgattagccataagtgctacagtaacctgcatgtgctaatgacgtattaattagactcagaagattcgtctcgcggtttccagacgagttatgaaattagttttttctttcgtaacctaaaaccccttccaacatccggtcaaatgtttaatgtgacactttccgtttcaccaacttaaacgggcccttacttggacgctgattacacactacagtgaacgttttctaccgtaccgtaaacccgatgtgacatgacagagtccttcggaccaagggcaacatcctttcgtgatcattgaggcggcaaaggcaaatggcaaagactcaccagaaccaccagaagaccattgcgggttttgcattgcgagtagtgcaggtagcggtcggaacatgttgctggtttccgatttaacggacgggacgaatgcccaattagatacccacaccaccacctgacagtctggtccaagtacaggggatgtttgtagttttccgcttctgaaaaatggttgcctcgtcagcctgcctgccctgcctcgtgccccgcttgactcgcagtcgccataggcaacagattattgaggagagcgcaagagttgagaacttgagaagtggggggtggggggcaaggaaagttaccgttgggtgccgttctgttctgcctgcgtctgcgtgcgaggcgatgattgcatcggacggtgagagagagagagagggaagggggggggggggggggcgaggaccggcggctccggctgggccccgcgagccagtccgtaggaaagcgatcagagatgatgcccctgcgcgacccctgcacggactccgacgcggtgcatcgcgacgctgctgctgctgctcctactagctgcttgtgctacccaccggtggtactggtacgtgctactacttgcctgcagtggcaatgcggcatgggcgcacggccaccggagcgaagccgagagagggctactgctcccaatcagcgggtaatttactccattttattgcagtaactctcgcctctgctggggccgggccaacgggctccgccatcgctgcgacgatgcgtcgtcactctcctcctgccagatctctacggatggcgtgctgtggactctggtgaattcatggtcatggacatgcatgtcaggttggttagcagtggtaattaatggtagggcgacggttgccgttcccttccggccggttggtgtgttcgccccttgtctgcggtgttactactgccagttcgtagcgtggtggggccgtggggatggtgctgctgcggttattgcggtgttgatcaccgatagaccgtttgggtcgcaaagaggattactactagcgttaaactgttaaaaacggccgtaatgcgccgtgaaaactgatctcttggttggttggttgggctattcagtaaactgtactggtatattggtgtactgtaccatactgtttggagtagatccacagcactgttgatagcagggccgcccatccgtgccgtccagagtccagaccgcacggcttcggtcctgaaaggacaagcatggaagttggaaggctggctagcctagtagcactggtatattatgatgagagcaattttaacaggtacggagtacttcgcagaaaccagatactagtagtagtgtagtaggagtatttaatacagcaccttgaataccgacgggaaagcggaaatttattgagtttaaatccgcccaaaatcaagaaaatgtcctaaacatggcaagatgaggttagtatgtcacccttgagaaatgccaatacgcccaaaaagcagcttatagtaaaaatagcaacacatagggaacacattgtgtaagcatgttttttggccaattcttgaaggttttttttttcacattataaggctatgtaattgaaaacctccaaatagtacatccttaactcaaaagaaaaggagagaagcactacgatcttctgtctgacttatgatcgcttgttttcttttcttcagcttctttcctcttttgttgcctgaaagtaaaatgatcaatgttacgaacaacagagaggggtgctggaatttatcaagataaaagctgctcaaacaactaacataaaacctatgtataacaaatcttcatatagttatcctgttgttttaatggttaaaagtaagatgtttaagttacacagagtaactgacgcatcaaccatacattttatgcactgtaattgatattaccactgcatcataacagtatgaaaaacatatggatgtagttctctgagacaaaatattcatagggaaaacaatggcacagctatgaacagttca

SEQ ID NO: 58521 - DNA, 19721 bp, Oryza sativa
ggcgtcatctattaaaaaacggaggtagtattatggaacatctaaaaaagtggttgtgccttatattatggaatggatggagtatcttagtataaagttggtatccattaactcctaaagctcaacacgtaaccatgtcacatcatcacctactaacaataggatttgtgcctaaataaactatttttatacattattcgtaatctatatccatattaatataaaaaaatatttatttattttatgcatataaatctcaacataggttatgtcaacatttatgtataaaagtaggtttattttacgatgaatgtactacttagctagccagctcgattcacctgcaaaccaaataaaattaaaaaggaagagaacagaaaattaatttttatgttgatttatgtagttatatttagttagcaaatatcaaatagatcccctacattgaataaaaaaaattcttatgctctgcttttacattaaaatatttattaaactgaccttccatttatattcatatcgtactatcccaaaatgttggcctttatatttttttttctcatgctaatactcaaaattttaaaaatattaattaaaatcaccgtatattttatatgtttttcacacgatattattcttcaatattgttaatatagagttatagttgtgcgaatgctcgaatataggaaatgctgttatgcttgtaactacaagacatttttctttcttgtttggcaacgagcatttcgttgtggattctctgatgtaaacgaacaaactatctgtttcacattaacctggacatggaaaaaaatgtgttgcaagccacatttttaccacaacctaacgaacataatctgccatttttgtaggcgcatgcaggagcaaaagcatcagggccgcttatggcggagatgattatagatcttttggaaggaaatctgagtaatctacaacactttacaggcacgacacctctgttctgagttctgagtgagccttttaatttcggaattgtaattttgtcaacttgggtcccagagataccttttactttgatagttattgcacgttcccccccccccttttttcttattcgtaccgagggataggtatctaaccaaattacgctggaattttatgatcaaagcacattcgatcaagtgaggaacatgtcattaaaagaattttgtttggtattcgctcacatgagttccgggcgtaataatattttgttgattgctgcaatctcgtgcggcgtaacaaggtgaactctacaactcgggaatttttagttttatctggaattgtgaatactcctatgtagttatggacttgtgagtaagcaaagtgttggcaaaaagaatttttttaaaaaatcctcacccctcgccaagcctcacaatgtggataaatttgatgttggaaactcggagtatttatggtggatagagtatttatcgtggaaagaagcatcgtgtggtagaggccatagagcctcgctcccggctagcactgccagaacgaatacaagtggacgctcgcccgaccaaccagaagcagagcccgtgcagattgtggcggcgatgcggcctcgtgcttttgctcccccttgcctgccgggcagtggcccgctgcctggcctggcggtccccgggcgcggcgacctcttcccggctgccggcagcgtcgtcggcaggagggccgctcccgctcccgccggccggggcgccgtcgctcgcgcagtggacgggccgtccgccgctgcggccgttgccgccgcggcggcgtccgccgcggcggacgtcccgcccccgcagatcacgtggcagatcgtcgtcggcgctgtaggtgcgtccatgttgtcgtacgcttcggttcggcttcgcttcctcatcacttcccacaaattgtgatgtgcttgatcatggtatggtattgaccgggttttgtgcagctggagtgactcccttcgtcgtcgccggggtcgagttcggcaagagaattgtgagtgttggtttactgtttccttgctcgctagtcgctagctgcatgaaatctgctgagtagaattgcaccctccagactccagtcctctttgctgcccctctaaactgaacgcaaaaatactactccctccgttccaaaatatagcaacttttagttagatgggacatagaggcatgtccagattcgttagtactaagatttatcccatccaaccaaaagttgctatattttgggacggagggagtacttatcatgaaagtgagggttatgcaatagtgacaaatatttgggaacggatggagcagctagttgttagtactaatgttcattaaacagttcttattgacagtttgacactgaaatacgagtgtgaagaggatagtgcttatcgatcagacattcagagtttcagaccattccttaccaagttttactgtccttcacttgattattgtcttctcctgtatttcagattgcacagaagaaatgtgaaatctgtggaggctctgggcttgtgatgaagaaggattactacgttcgctgccaagggtgtggtacgtactgaatcctctgtttcagtatgtttgcagcagcaatttttcaggacttgaactgtgtggtgtgctgacagtatgataactgacaatgtgtgtcgccgtgtttcattgacaggcggttttcttccgtggcagtcatggagaagattcttcaccggctgaaaatcgttaatttgaatcgtgttgattaacactagcactgcagtttgagttggacaaggaggatatggcatgaccagaccaggtcaatattgtgtttatagttgttgttgttggaaatatagtcattattcggtatattttaatccaagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcacggcacctcctcctggcgcaccagctccggatccagctcctgtcggcgtcggcggcggcgcagctcctgtcggcggcggcgcaccaccgccgccattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgcgccgggccgtgggcgtggccgaggcgtggcgtggctggcggcgggcgggtgtcacgtcgctatccttttgcagccactaacccacgttcccacgattccctccgcaacaacgcgtccacgttctttctcctgatagataaggaggccgcgagtccgatccgagttcctcgcttatttcccggtgttagtttctccttctccgcgcctgagtgctctcgcttccccgcttctgatctcttgcgcgcacgagagattggaagaagcagtgcctcacaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatctatgccatgatcatagtttcaattccttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcactgacaacatagtggacgtgtacatgcacatgccttctgggaaggacatgtgggatgcacttgaggccaagttcggagtttctgacgccggtagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggtgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacatgaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttactttgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacaacctcgcaagcctcacaaggcatctgaggcgaggaatttggcacctctggaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacaactttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggtaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccagtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagactcttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccacaaaaactctgatatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgcgcgccgggccgtgggcgtgggcgaggcgtggctggctggcggcgggcgtgcgtgcgtgcgtcacgtcgctatccttttgcagccactaacccacgttcccacgattccctccgcaacaacgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcattgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtatgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaattccttggattaaaatataccgaataatgactatatttccaacagttgtctataacatatctccactacaaatggccaaataggttcatcgagatgtatcacaatagtacactgtaatcatggtcatggttcttctgtctataccatgcatatgacgcagcatatgaccatcctctgagagtctatcagcccaaaatctcatgggacgtgcgttcacgacaactacttgtggtcttctggagctgtaaacaagaattatctagccatcaagctaaactataaccttccaaaagcggcatacacgtttcgttcgtcatgtatgcaagatctacttcgtgatgcctcagtttattcgttcgtcaatgcaaagcgttttgatcaccgaacaaacccatgtctgcgatatgagcaaactgagtctggcctcgaatctaaatactcctacataggtttcatactttcatcgcaaggactataataactggagtagttaggtttatgtttagttcaacttgtctttcagcccagaagatcacatatcgtctccacgtgtgcgtctggtttgactcgaggaccacgatacaagatgttaattgttaaatgggtcacttcctcatctctctaggctaatgtaaaatggtatgaggctgacaccaaaatccaactaaatcatcggatgatctcacagagtcccgtaatgagccttttctgattaaaaattgtaagttggtgttaccaacacaacaacacttatcaatttatcattttgagtgtgagattgtaataattggttgtaactctttaaaaaaaaaggccgggacgccccatttcattatcagaaaaagaaccatggtgtgttctgcggcttctgccatctactcatggcaagatctacttcctgatgcccaaactgctggtcgcgcccctgacatcaatcgtcgcaccatccattcgatcggtttagatccggcgcgcgccggacgcgcggttctcttcggttccaggcagccggcgcgcccatcccgacttggcgtgattgccgcggatgcagtttagttggttccgtcgcgtaacctcccttatctcctcgcttcccattcctgggctctgactcggacgcccttttgtccccacccgccgatccgccgccgcgagcccgcgaccgcgagacgagacgaaaccaactcgtccccctcttgatcccccgtctcgcttcgctcggcggccgcgccacctccaaatctccaagctccccgactcggcgactcccacacgccatgcccatcgcgcccgcggcttgcagccatcaaacccccccgcgctctttcgcctcctgagcccgtccgctcgcccgtggccatggacgcgatcagcagcgaggcgccggtgggggtgttcgcgatcggcccgtccacggcgctgggccgcgcgttggcgctgcgggtgctgctctgcggctccctggggcggctgcgccaccgcctcgccgcggcgctgcgggccgcgctccccgtggcggcgggctggctgcacccgcgggacaacacccgcgggatcctgctcgccgtctgcgccgtcgcgctcctgctgcgggtgcgggggcggggcggcgggcgcgccggggtccgggcgcgggtgcagtccgcgtaccggcgcaagttctggcggaacatgatgcgcgccgcgctcacctacgaggagtgggcgcacgccgcgcggatgctggaccgcgagaccccgcgccgcgccaccgacgccgacctctacgacgaggagctcgtgcgcaacaagctccgcgagctcaggcaccgccgccaggagggctcgctcagggacatcgtcttctgcatgcgcgccgacctgctcaggaatctcggcaacatgtgcaactccgagctccacaaggggaggctgcaggtaactgctctaatcttaacctgtattacgcccgcaaatttgatgcaattagatggttgttaggagttaggatagctaattctcagaacttcagcaatgcttctactttccctttgttacaactgaagtaaagtaattccattacactaaatctgcgaagtggatccacttccattacacacaccaagatagtcttggaaatttttttcactttgttcggatgatttgtttgtgttatgtcagtacggcaacaaattatacgaagtactcatattcatagtgatagcctgataggatccccttttgatgtccccattggagcatctactcaaatgtctattcttatatatcactatgtcatattgccaggtgccgaaactcataaaggagtacattgaggaagtatctactcagctgaaaatggtatgtaattctgattcagacgacttgcctctcgaagagaaacttgcatttatgcatgagacaagacatgccttcggtagaacagccttgctgctaagcgggggtgcttctctaggttgtttccatgtgggtgttgtgaaaacattggtagaacataagcttctgccaaggataatttcaggatctagcgttggttctataatgtgctccatagtagcaacaaggtcatggccagagctggagagctttttcgaggagtggcattccttgaagttctttgaccagatgggcgggatctttcccgtagttaaaaggattttgactcatggagctgttcatgacattagacatttgcagacgcttttgagaaatcttaccagcaatttgacattccaagaggcctatgacatgacgggccggattcttgttgtcactgtgtgttctccaaggaagcatgagccacctcgatgcctgaactatttgacatcacctcatgttctcatctggagtgcagtaactgcttcctgtgcttttcctggtctttttgaggcccaagagttgatggcaaaagacagatttggagaaacagttccttttcatgctcctttcctgttgggcttggaagaaagagttggtgctacaactcggcgttggagagatgggagcttggaaagtgatttgccaatgaagcaattgaaggaattattcaatgtgaatcatttcatagtaagccaagccaatcctcacatagctccactgttgagactcaaggaaattatcagggcttatggaggcagttttgctgccaaggtgcgtgtcaaaaacattccatattgcattctttatttttgattgtttatttacttgagctgtctgtgatataacttgatatcgatttcatggtgggaaggatttttattttcacttggattgctacatgatataactttcagtatttcaggcatgtttgtggcttagtagcctagtgtagaactatgctcagcaaggtttagttcactgcagatattagttgaattttatgtctgatgaataattcaatatactaaaactgctatgggcaagcaggggaggagacaagcctagggaaattagggtttgaactctaggcttgtctccttaatctcttcgaaatccatttaaaaagtgaaaaaactatgtaaaagtttgaaatttaacaaatcagattagttgagccctaggcttatgaatttccttgctttgcctctatgggcaagcatgtatttaagtgctttgttgtatgatctcatagattcttcaatactatctgtatgtagttggctgaacttgctgagatggaagttaagcataggtgcaaccaaattctcgaacttggatttcctttaggaggaatagccaagttgtttgctcaagattgggaaggtgatgtcacagttgttatgccagccacgcttgctcaggtctttaatatttcccattcctttctttcacaaatatccttggcattaactggtaaacttacaaatgaattctttcttgttatcatcagtattccaagatcatacagaatccatcttacgctgagcttcagaaggctgcaaatcagggtaggcgatgcacctgggagaagttatcagccattagggcaaattgtgctattgagctggtactagatgaatgtgttgccctgttgaaccatatgcgtaggctaaagagaagcgcggaaagagcagcagcttcacaaggacatggtcctacaatcagactctgcccatctagaaggattccatcatggaatctcatagcaagagaaaattcatctggttcccttgaagaagaattccttatatctcctcgtacaaaccatcatgcagatggaggaattgctggaccatctaacaaaaaccatcatgtccaacaaaatgtacatgatggcagtgacagtgaatctgagagtatagacttaaactcatggacaagaagtggtggccctcttatgaggacagcctcagccaacaaattcgtcagttttgttcagaatcttgagattgacacagagttcagaacaatttcatcgagggaagacagaactgatgttgtaacaccaaatgctaatttcttggtttctcaggcaattggtagagaatctgttgacaacagtgcaatgcctattactcctgataggagcttgggcaattcaggttatgatcctcatgatagtaatgtccctagatctccatttggttgttcaacaagtatcatggtttctgaaggcgacttactgcaacccgaaaagattgaaaatggtattctgtttaatgttgtgaaaagggatactcttctaacacctacaggtggagttgagcttcagggaacatcgcaggaaccagacgtggaaacaattcagacagagtgccttgatgatgcttcggatgacgacgatgtgggattaaatgctggtgatgaagcagcaattgaccctagagcaaacatgagcagccaaaatacacaacaccaggggtcttcactagaaaatataaatctgtcctcttcagtagattgtgaagctgaaacaattactagtaaatcaaagggttcatctctttttgatattggtatggagattcgtccaacaatcttgagcacggaaagtagtatgtacgagaggtcttctgcaaaaataggactgaggacagtgcatgcagaatttatcagcaatccaggtgctgggaagggagaagttgactcaggggctgctaataaagaattttcctatttttctcaaacagcagatactgttatattttcagaaagctgtgaaactgggcaacatcatgaagtgaatgtagaagctttaacctcataccctgtttcagttctggaagatgataggtctggtggcttcaatttgagtgaaataatggctacaactttcattgccgaagctgatgctccaatatctagaagagatgaagttgagcagcataacggatctccagtggaaacattcctggacacagaaacggtacaagctgggccttgcagttctactttggagggcaacaacaccaacaattccgaggaaatgcaagttgtttgcacctcaggaaccaattagaagtcaagacaagaagggaagttttggatttatcatatgaaaaaacaacttcagtgctcgttgtaaatcatatgcagatgtgcgccatgttctgttgtcgatttaaattcgcacattacggaatatcttgttatgtattgtaggttagtgaactagggaaagaggtcgctgaacttgatgaaattcctcgtaaataggaaaagaatgtcaatggttttgttgaagctgctgcttgacaaaagcaaaacaaattccacttctgcgcagtactcgctcaccttatcactagggtgatgatcagttcgtacaattgtggaagattaagcatcatcagggtgatgattagttggtacattgtactagagggagtaggagtactaggtttagagatacaaaaactaattagttgacccgggacttcaggtgttgccgaatgtcaccgttgcgtggtcgtttcttggagacgtcgtagacggacacgatgatgctggcggtggcgggcggatgagcaaccctgggcacgacgaacgcgtagcagtcggccggcaacgacccaccgtcgagggccgtgctcctcaccgggaactccgacgacgaccgccaccccgtggcgcggcagtggaacgcgacgtggcactcgaacttgggcttcgccttcgcgccggcatggggatccaggaggagcacggcgccggcgaggccggcgggtccggccggcgcgacgtcgaccaggaacaggtggccgccgtccacgtcgcggaggacccgcttgccctcctggacctgcaggtcgaacgccctggcgcgcctgaactcggtggcgggcggccagccgtggccgccggtgaagtgcgcgggcagcgacgaggtcgcgccggcgaagccgcacccgggctccgggcagaagcacggcgcgtgcgggcacccgtcctcgtggctgtcgctgtcgtggtaggccgtcttggcgtcgcacccgtagccggcgttgcggcaaggcaccaggatggacctcaggatttgctccacggcgaagcagcggttgtacgcggtgtccatggcgcagacgtggcacctgttcttgtccgggagcttgccatggcaggacgaacaaatgacatgcccaactccacactaccaaaaaaaaaaaaaagaggacccgaaaaacaggttaatcaagatcaatacatggtgaatgttgctcatacatccatggtagaaagacagaaaaggaaccaattttacaatattagagacaaggatgattgagtacctgcaagactggaggcttgaggggatgacagcagacggtgcagtcgagtacctccagatcgacggtggcattggtggcgacggagctcctctgcccggcgctctgctccatcgctattcgctccctctcttcttcttgattgcaaatttgctgcgcaacggctaaaaactcaaaactttctttgcaaccttttcatttcgtcaggctaggtgcagtaggagtgtggtagtactaaaactggtaagcctgacggatttgacgtttgacagaagccaacggcttttgctcggagggagctgcattttgatttttgaaaacgcctttcatttacctttttttaaagtacattggaacacatgtactaggttaaatcaatattttcacttaacactatactccctccgtaaaaaaaaaaccaacctaagaagctaaacggagcctaagaagtatgggatgagatataatctagtacaacaaatctggaaagaagtctgaccaaattttgttgtgacggagggaatacatctttacataagtctccagtttggactccgggtgatcaaaataagcgaatatgtgagagaacttcatatgatttacacacgtataattataaaaggcaaaacattttatgttttcttccttcttttcggtgtgagcggtaattaactagttttaccttttcttaagtaaattttacattgggccatatgttttgatcaagattttgttataaactagggttaaatcaatattttcacttaacaatatacatctttacataagttttcagtttggactagggtctaagggtaatcgaaacaagggaatatgtgagagaacttcatatgatttgcatacggataattataaaaggcaaaacattttatgctttcttcttcttttcagtgtgagtggtaattaactagttttattttatatttttatttaaattcaaaaataactagttttattttctattttatttttgttcatttgcccctacgtatagatcattttgtgccacttttaaacatgttcacatcattattttagtgtgatttgctaaaaaaaagttgttttgtgatttgcaaatatttttttaaagatatttatcttaatactatggcactatggatgatgatttaaactagcttttctctgacaacttcctttgatgtgctcatcccaagtccaaagtgccaactagtgcaaagatatgtaatgttaagtgaaaaggttgatttggccatttcccattgtgaaactttgttaaaaatgtatggtgcaatgtgaaatttacttcttggtttaggactttttccttcccagtgtcttattgccactttgtccaccaaaggttggaagtgaatcatgtgaagcaatttatcctactagtgttcacccgagaagagaacagaaggtgcgtcccttgttgccttggcacgtaatttagcctctgctaaccaatgacctagagcaaaggtataaaacaaaaggcgatacaatggcattgccttacttactactaggtgcaactaatttgaattcaaatatgcgtagcggtttctacctgttcgagattattgactggattattgttgcgggctatctactttattctgggataaattaaatatttttaatctaaacttataaatggcttagaataagtggtctaagcaatgcattagaagaaagtttttttttaaaaaaaacatattctcaaaggtgtggaacaaataatccacatcaaaaatccagtgaagtagaaatgaacatgttttataccacttatttctctgtcgtccaaacacccaaagataataatacccttgctataggaaatcaatgtgtattttgtctagaagtccaattcttctaagctaaatggatgattgattatctaaatttatgatgatattccaagatataaagtatgaattaactattaccaagttgaaaagttgtttctaaaaaaagtattataagaaacttatagatagaaaacttttgcaaaaaatgcaccgttggggagcttgggaagcgtgctcatgataatcaataatccaaggaataagatcgatcgtgtgtttattggcttatcagctgcaaccaaaatttgaatgtttgaaacttagttttagattttagagttaattttcggatttattcatcatagtttattttgtagtattgacttttaaactggtaataacccataaattgttttggattacttcattcttttttggagtaaaatatgggtactacaatacatgatgtaaactacgcatagtgagtcaacttatgtgattggtttgtgcatgctcaaatccaaaattttggatacgtgttgttgcttttgacatgctgaactcttgtgccacaagcagtcaaagccacagtttttgtggtgctcaaaagactcgccaaacttttaatggaagtccaactagtgatttgagtgcctagccaacttttaatgtatataatagataagtgatatttttttatatgatctacaaacaagctaacacgtttcaatatttgaaaggtttcaaagttgtttgcatctcaagactttaaccgcgttcatagaagtgatggaaaatattcctcacatgttcattatgacatatatgcaagtcactctatctcttacactcctttttatgctcctttttatggatcacaaattaatatttcttgaaggcacatggttatatatgtatcgattgttaattagataaatggaacttgtgtactcataatatttaatatagctatttagacgggaaacaaaattattattgttcttattccaaccatccaatattacatagctacaataagcatgcagtcttttatttcttgtaatttatttggaaaccatccctagcaatccaagcctatactataatgatgcagtcatgatatcttggaagttactgtaggcatgactaggagtgaacacgcctgactccactctcctgttgtgcttgagtctcctagcttcttctcttgagatacgatatgcatttgccaaaacattgttaggaagtgcacggaagatggaattctttcccacgatttggctaacaatggaattagggttggttttgaatgcaatatataagcatccttctctttgtgcttttttcacaactacatggtgttgtggtataattagcagctgcccaggacgaacctctccatcaaacactgtctttccattgttgttgacaacttgaacccggcatgaccttgagtaatatagacaatgctatgagcattgatgttccaaaaaggtgaaaggagcgcgttctacaacaaaggg

SEQ ID NO: 58522 - DNA, 622 bp, Oryza sativa
  unsure (1)..(622): unsure at all n locations
tagcagactaggtgctgagtgctgtccatttttgcagactgaagagagaagatatacgagactgtccattgttagtcagatttgtaaaaatagactctgatgtagtttacttttgcccctattttatttttaacaatacaaatatataacagatcctaagagcttatcttaatttaggagaagttgctcgtttcattaaattaaactgtgaagtaaaaatgtgtgctcgagtctgtcaatgcaatcctgtgttcttgtttgaagatatggtgtagggcaggctaggatcgaacactgaatggtaagactgcttctgccttcatttgtgcacttggtgctgccacgccgattaagcagtagaacaaagtaattttgtcgtgcacaaatgagttatatttcattgaaaatcgaagtgaaaatgaaccaaaagaaatagaaagaaaaaaaaggggngggaaaaaaaaaccttttttggggggtttaaaaaaattttttaaatttactccaaaattattggtaagatttgatattagacgctcgattacttggcttaagttaaggatatcaaatttggggaagcaccaaaggaattattgtgaaggagttgtgggtgcataacgtt

SEQ ID NO: 58523 - DNA, 581 bp, Oryza sativa
ggccaattcgagctcggtacccattttgcttcttgcagacccatttgcttaatatgagtagaaaattgaacgcgaagcgctccttgctttcttttgttggtgtcattatcaatactattgagttattatcaggtatttttcttaataatacaatgtgttcgctaacacaataaaatgttaaacatccagtatgttaaagttgcagtctgacgcctattttgttttgctgcagctctttcaatacttcagaattcttctgttgtttccagctctacatatccgaaatcgtctaaagtctctcaacagagttactctggtaataacaaacaccaattttgtttgatcagttgatctcgttggcttttctatgcactgtctcaatatagtttggtcgccattcaagtctcactacagatgttgaacttggcctgacaccaaatatttataaaatgctacctgatattttttttaaaaattaaattttttccaaattggggttttttttccccccttttgaaaaccccaccatatcttgttggtcctcgtataagtttaattagtgacattcttgaagctttgtt

SEQ ID NO: 58524 - DNA, 774 bp, Oryza sativa
  unsure (1)..(774): unsure at all n locations
ccgcggttatgggcagtcaaccagattcaccgtgattagtctcaccctagtgtaatcttttgaatttggatagtttaggtggatggttgggcctgtcgcaacgtggtgtagcgttggacagtggatgattaatactgcttaattattacaactgttttcgcattcaattcctgtttataaatgccagtatttatgcaaatgaacctgcttagctatcccttgtggaatccctgcatcatacccccgttccggtatgacttgctgagtacagtgggtagtactcagccttgctctattttccccaatcccagagctcgagtatgtgtccgatggcgggttctccgaggagtaggctttgtccgtgccgtcgaggatgcctgtggagtggtgttcccgctgcagttcgagtcaaggattagctccagttatcttttgttttccgctgcatttttgtaagacttttatgatgtttgtaagacgtggatctgaatgtcaacattgttgtttgtgtaccccggctggtcctggacggggattttaatgcacattctgcttggaattctattcgggaatttctgggcgtgacaactagagggtcctatttatagctttggattaaagagatcggactcttcccgcaagaaatcggttcgggaaatctaaactcggtttttggggataaaatcgaaacgaactcgattcggataanatacccaaccatttgctccgattcttgaggggaaaaatagaggaggatgagaggataaaaaccct

SEQ ID NO: 58525 - DNA, 624 bp, Oryza sativa
tcaacttttggtgtaccttgcctcctgggagaaggattaatgcacgcacgcaaggaacgcccgttgggttatttccggtcgtgacaagttggtatcagagcccccttgaccctaggacgagccgttagatcccgagccttagcaatattttcaaaataaaaatcccttcttatttgtgaaaatcctctattctctctctgtcttgctgcttcatttattgccaaaatctgacctttaaaatgttgcttttctttttgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggagggtgacgatgcggagccccacgctgcttgggaggtcactgcagtgatcctcgctggctctcccgagcggatttcgctgacagtcaccgcgggtggggattccttccccgccgcttgccagagcgccgctctcctcgccatcggcactcttcaccagcgctacccggacgagttgccgcactcgccctaccgctaccaccctcgtcgcggaggagcccgcgactac

SEQ ID NO: 58526 - DNA, 2871 bp, Oryza sativa
  unsure (1)..(2871): unsure at all n locations
gtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgattgaacagatcatcgatccggggaagagggtacttgtttttgatggtgacttcattgagagctctgtagtcaacgcacatcctcttcgtcttgtctttcttctccacaaaaatcacaggagcaccccagggggaagtacttggacgtatataccccttttctttcagctcttccaactgtttcttaacttcggccaattcatttgctgccatacggtagggtcgcttgtacagaggagcggttcctggagcaagatctatccggaactcaatctctcgcttaggcggcataccaggtagttcttccggaaacacgtctccgaactctctgacgatgggaatttctgacagttctatctgatgaagttctgaactactgactgaggttgggggtgcaaagaaaacaaccggttgttccggccctcggtacagagtgacagtgcgtctcgcgcaatccactactccttggaattgagccaaccaattcatcccaaggatcacatccaagttcttggtgcctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaatgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggggcggggaggcgcttggccttgctgacgccttggcttcgggcatttatccgcaaagtgcccgggctcgaagcagttgaagcacagacgctgcggaccttgagcgtccctgcggccttgaccaggctgcacagtcggtggaggaggacggggcgcacgagtcccttgttgattctgctcctgctgcggctgtgggacgcgcaccacgaattgaggtcnangcgcggagcgaggttgctgctgctgctgttgctgctgcgaggaggatccccctggatagggattggtgtagcggaccctttggttagcaccctgttggttgtggaaattcgccaagcggcgcttgtgcgactccagttccttgtgcttggcttccaagcggatgctcttgtccaccagacgttggaaatccggataatccccggagactagacagacggacagctcagggtccattcctgccaggaacttctcttgcttctcctcatcttcccgcacatcctccggagcgtaacgggccaggttgttgaactcgtgcaaatactccatcacggagcggttgccttgcttcaactctcggaattcccttttcttaagggccacgactccggcgggcacatgggttctccggaaagcggcggtgaagcgggcccatgtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtggacagatgcggaggaactcggcgagtttagagtgttggggaggtggtggtggagcattatgttgtggcggattttggaggtggtggagaaaagcagtcatcatgttggcctgctgggcgaggatttgggtgagaatggcgttggtatctggtggtggtggtggaggcggaggaggaggtggaggtgggctgccatggttgttgtggttgctgccttcgggttggttgccatcactggtggcagcatttctcctggtctcaccatctgaaaaccccacacagaaccagcaaacagagagagctgacaattaaagctaaccacccacgactaccataattcttgaatttattactgctattaaattggttcattaaagttcaagttgcttaaacaaataaaataaagacaggctccgacacagttatgccacacaccggcataaccatgccccacacaacccaacaagaagacaaacgagaaagaacacacgtgcaagcctactaactgctcgtctactgctgcgacgggccaggacggaaggtgagcaacagcgcatcctccgtgctaccaacgccggaggcttcccccttctggggaaccacgggcgtgggctcggcacgaggggtctccacgaagcaagtccacgccagggactgacgaacaagctcgggcctggaggtgctcttgcgggcggtgatcttctggctgcggcagacgcggcgacgcttggggcggcagacctctccctgggcgatcttgagttgatgcagctgcgcctccaccgcatctaggtcctttttgagctgcaggttctcctgacgcagctccaggatcttcatgttgttctcgaccatcccacgacgcaccatctgatggaagtcgatacgagccgcgtcgtacgcctccaccatgcgcgccaggtgcacgatggtagcgtcatcctccgagctagcgtcccggaagg

SEQ ID NO: 58527 - DNA, 1404 bp, Oryza sativa
cagcatttagcaaacatttcagaatttaataaaacagttaagtaataattaaacaatattaatccaacactatacaacataccctgttgtataggcccaaccattctatacaaccataccggctgcacagttctatctccaaaccaggaatataccattccaaaccaggagctaatcaaattattaccaattatagcatcattcactaaggcgagaagtgtgaaactaatcacgaaagacactgttagacccgcccataactgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggtaggcatgataaatgtttcacaaccgaaacttgtgaaccggtccttaattgtcatgagcacaaccatcaaaaccatatgctcacaacccaccttaaccaagttttaattatcaattaattaacatcgcactattaaccatcgtgagctaccatttaatgtaaccataattaataataatataacataacttataattaacccctttagtcaactaatgtttctaagcatagttaagcaaacttacatatagcatttagttgaaccaatccaatatataaggttcaagctaatcaatttattacccaaggtatcaaggaatagggcatccaatacaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccagcgcactcacgaaccttcgcaacgacggaaacgacaagctaacacgcaaaacaaagtaaaagactaataaaaaccaaataaacaatacatataaaataaacaaacatgtagaacatgattttagatgaattatgagacttgaacggccctattctgacttcaaatgaatttaatatgaattttacaagattaaatctaattaaagcccattaaaaagaattaaataaatttaattcaatttatggacaattttaatatgtagatctttattttagaaaaatttagcaacttgaaccacctgaaacgaagctacggttattt

SEQ ID NO: 58528 - DNA, 916 bp, Oryza sativa
gacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcaggccacccaggtagttttgaggtatgtggcaggtactctgaatctcggggtggaattcagaaagaagcaacaacaggttcctcagctgaatggctatagtgacagtgatatggctggggatattgatgatagaaagagtacaaccggagttctatttaaattgggagacagtttgatcagttggcagtcacaaaaacaaaaggtggtagcaatatcttcgtgtgaggctgaatatatag

SEQ ID NO: 58529 - DNA, 703 bp, Oryza sativa
aactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcgatttcagtggttcccggaggcgagaagcggtggccggggtgcggctcggagttgccgatccgagggaggaaacggcgcagtccggcgtcgaccggggaggcgaggcgac

SEQ ID NO: 58530 - DNA, 2526 bp, Oryza sativa
tttatctggccccattttatattggaatttattaattaaaattagatcttcttttcaagacttttaaaattattttctagaaattccatttaaccaccaatttatataatttgaatttttagggtgtgacaaacctaccccccttaaacagaatctcgtcctcgagattcggaagaactggcgaacagatgcggatgagctgacttcaattcatcttctcgttcccaagttgactcttcttccgagtgattactccactggactttgcaaaaacggataactcgattcctggttcttctctcatctatttccaagatacggattggcttttcaacataggtcagatcctcttggacttctatttgttcaagattagctccttcggtaggtacccttaaacatttcttcaattgagacacatggaacacattatggactcctgccaaagattgaggtaactccaactgataagcaacttctcctcttctacggacaatcttataaggtcccacaaaacgcggtgccaattttcctttggtgtgaaaacaatgaactcctcgaagaggcgtgacacgaagatacacataatctccttcttcaaaactcaaatctctgcggcgattatcggcataactcttatgtcgagactgagccacacgcaatctttcttgaatgattttcaccttttcttctgcttcccttaggatatctgtcccgaaaacctgacgttctcccgtttgatcccacaaaagcggagtgcggcacttccgaccatacagtgcttcgtacggagccatctgaagactagcttgataactgttattatacgaaaattctgcataaggtagattcttatcccaacttccaccgaaatctaaagcacaagctctcaacatgtctttcaaaatctgattcaccctttcggtttgtccgtctgtctgcggatgataagcagtactaaagttcagcttagaacccatctcttcttgaagtttcttccaaaaatttgaagtaaactgacttcctcgatcagacactatcttcttagggacgccatgcaaacacacaatccttgccatatacaattccgctaagcgacttccagaataagttgtctttaccgaaatgaaatgtgccactttggtaagtctgtcgactattacccaaatagagtcatggccagatgacgttctgggcaaaccagtgataaaatccataccgatttcttcccatttccattcaggaatcttcaaaggctgcagcaaactggcaggtttctgatgttctgccttgactcgttgacaaacatcacatactgctacgtattctgcgatttcacgcttcatacttgcccaccaaaatctttccttgagatcctggtacatttttgtactaccagggtgaatagagtataaagtatcatgggcttctttcagaattgcatcttttaaatctttgttgtcggggacacagattctctcgcccaaccatacagttccgtgctcatcctccaagaaaccaatagcttttcctcttctcatattcttcttgatttcttgaatatcagaatcattaatttgggcttctctaacttgatcaattagagtgggcttcgcttctaaggctgcaacgaaacctctactgacaattcccaaatttaatctttcaaattccttgcataattccaatggcaactgtcgtccttctgtagcattgcaatagcctttcctgctaagagcgtctgctacaacattagcctttcccgggtgataatgaattcccatgtcataatccttaattaattccaaccatctcctttgtctcatgtccagatctggctgagtaaagatatactttaaactcttgtgattggtatacacctctgtacgagtaccgaaaagataattgtcgcgtcccaaatcgactctaaaatacatcctcgaaatcgtgctgagaataattaaaattcatgtgaaagccttcaacaattaaaatgtgcaaatttaaaagtcaaataaggcttggaggatttttgtatatttcctaaaagcctaaaatgcgtaaataaattttagtggaattttcagagcaaataataattgagaagaaataaacaaagttaaaaaggttttataaaaagaaaatccctaaaagtcttctttccccccccctttccctcttgggccggctcggcccaactccctccctctctctcctctcccccgcggcccatcggcctcctccccgcgcgcgcgccgccgacaggcgggcccgcccgccaccctcgctgacgggtggggcccacctgtcatcgcctacctcgcgccgcgcccgccgcccgcccgtgccctagcgccgccgccgccgccgaatccgccgcatcccgccgtccccgcgcgccataaagagggggaaatcactccccgtgattccctccctctttccccctcttttccctctctctttccatcggattcgctcggattattcccgtaaagttcgccggcgcatcaatggagcccgaga

SEQ ID NO: 58531 - DNA, 1880 bp, Oryza sativa
tctttttagctttaggaacatgaaggatatttttcaactgaatattgcgtatgggggtatgaataatagaatgaccaatatgcttaatgtccatacctgcaccgcttgccgtgtgaatctgttctttgccgttgtacttctcatgggttgtcagcttgtccagttctcctgtgatgtggtcagtggctctggtgtccatgtaccaatttgtatctacaccataggaagccgcagctgctgtttttgaatctggaatgaaattttcatcatacctgtaccagcagtctgccaccacatgtccaatcttgccacatagctgacaggtggggcgcggtttgttggagaagcgcgcgccgccaccgtttcctcgcccccggcctccgcgatcgccgcgaccaccgccacggacgcgaaacgtgctggtgttgccggtgttgacgttgttgctgaagccgccgccgcctcccttgcctcctcgtcgtgcgctgttgacggaggaaccattagcctgctgtcgcagcttggctcggctctcaaaactcaggagctgggtgtagatttcggcgactggtacagcctccgccttgccgacaagagtggagacgacgggctcataatcgtcgtcgagtccggcgaggatgtacgacatcatcttctcgtcatcgaggggcttgccggcggatgacatctcgtcagctagcgtcttcatcttgccgatgtactccgtgacactgagatcgcccttgcgggtcgtcaacagtgcaagctgcgtgttcagagcacgcgcacgggattgtgaggagagcatcgttgtgatcactctccatgtcgcagccgccgtttccagattgacgacttgggtgagtatgtcctttgatacagatgcaaggagaaatccaagcacctgttgatcgacgacaacccattcctcataggctggattgatcttggtgatgaccttgtcgcctttcttgacgtcgatcgctgccgacggagcgcgagtcgcgccggtgaggtacccctccatgcgggcaccgcgaatgatgggaaggatctgtgtcttccatagaaggaaattattccttgtgagcttctctgggacaacttggccggagagtggattggtggtggaattggaggaactcgccatttttggtagatgcgatctcacgcgtgcatgattggctctgataccatataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcacgtaacaactctatgtaacaaacctctatctctaacaggctgcaggcacgcgatgcggacaaatgatgcagggacaggacgccagtgctgacagcgatgcacctctggtttccttcccagccgtagcggcgctggttcactacaataattttacagttaaataaatgttgccacaatcagacatactataaagggaggtcaaattggcatgtaaaatcatattgcttgtattgtttcaatcaacatgcttctctaacttccgaagctctcataaaaactttacgtgctttcaaattaatatattcatcattcaacactattagcaatttaactcccaaaaatgacatttcaatgtagagttatctaaccagcggtcctgtacttggcgtctagagccagtgggccttttagaatatcggaaaagataaatgataatacatataaacttgaattgcctctaaagtttgaggttagtcccacatttaacattttcgatttggagctatatttgagagaaaaagat

SEQ ID NO: 58532 - DNA, 1182 bp, Oryza sativa
agaaagaacacacgcgcaagcctactaactgctcgtctactgctgcgacgggccaggacgtaaggtgagcacagccgcatcctccgtgctaccaacgccggaggcttccccctcctggggaaccacgggcgcgggctcggcacgaggggtctcgacgaagcaggtccacgccagggactgacgaacaagctcgggcctgaaggtgctcttgcgggcggtgatcttctggctgcggcagacgcggcgacgcttgggacggcagtcctctccctgggcgatcttgagctgatgcagctgcgcctccactgcgtctaggtccttcttgagctgcaggttctcctgacgcagctccaggatcttcatgttgttctcgaccatcccgcgacgcaccatctgatggaagtcgatacgagccgcgtcgtacgcctccaccatgcgcgccaggtgcacgatggtagcgtcatcctccgagctagcatctcggaaggtggcgtagtcgcgggctcctccgtggcgagggtggtagcggtagggcgagtgctgcaactcgtctgggtagcgctggtgaagagtgccgatggcgaggagagcggcgctctggcaagcggcggggaaggaatctccacccgcggtgactgtcagcgaagtccgctcgggagagccagcgaggatcactgcagtaacctcccaaccagcgtggggctctgcatcgtcaccctcctgctccggaagcggcctggcctggtagtccactccatgtggataccccaaggccacgcacatgccccgcagctccaagacgaaaccagtcatgtccaaaccacgacgggtgacgctgccggccatctacaaacaaaaacaaaaagaaaacaacattttaaaggtcagattttggcgataaatgaagcagcaagacagagatagactagacagttttcacaaataacaaaggatttttatttttgaaaatattgctaaggcttgggatctacggctcgtcctaaggtcaagggtggctctgataccaacttgtcacgacccggaataacccaacgggcgttcctgacgtgcgtgcattaatccttgccccaggaggcaaggtacaccaaaaagtgatacaattcagagtttaacaaggcggagcgtaatagttaacttattacatgggcagcgaaggcccaa

SEQ ID NO: 58533 - DNA, 5419 bp, Oryza sativa
acgacgcccccctcatcctgaacatgatatgatgaatggatgaattgcagtttggttggatgacttgcttgaattgaatggatgaattgcatgattgatgaaatatatgaggtgatgaatttgcactgtttgtggatgaaatatatgcactgtttttagtctttttgtattagatgattttaggattaattttggccttggtatatggaatatatagccagggttaattttggccttgattaattttggccctggtgattaattttgtggatgaaatatatgctactgctgttatatggccctgctactgctctgctgtttatgtttctgttgtttctgtttatgtttctgttgttgtttatggccctgctactgctgttatatggccctgctactgctctgatgtttaattttggccctggtgattaattttgtggatgaaatatatgctactgctgttatatggccctgctacagtgctactgctctgctgtttattaattttgtggattaaaaataatgactctgctgttatatggccctgctactgctcttattgcgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagaccatgtcaacgcccggcgcaaacccgctctccccaatacctgcgaggatccaggaagaagcaaacccagccacggagacagttgccgaaggtcatcccgcgacaacggcggtccaacaacccaaaattcatggtaatttataggataaattttcaccacatgaccacataaattttagctagcaccccttagcaaatattggcttctgtttgtgctgcagaattgccacaggaacaacatacatcgatgtcgggcgggacaagtgcaagtaggtctagtagaaatccctagtcacaaaatatatggccgaccatagtgcaagttataagagaggttgacgctagtggtaggcccacggcgcccaggactgtcattggaagatggtctaactgctgcgggctagaggcacgtaagaacttcgggatcctccataaaaatatcgggaaggtcacagaagccgagaaagagcgagcttggacggcaatggagaaatggttcacatttccggctgaagcaaaggataggctcaagcggaaggcattccaaaagatgggcaaagcttggaagaattggaagtcgaagctcttcaccgagtttgtcaacctgcccgacaatcatacgccgttcgatgaataccctcaaataaccgaagcggtgtgggaggaattctgctctctcaagacctcccaagagtttagggaatcaagcgaggcacatcgcctactacaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggtgcgggcaaggggtaaggtcaacccggacggctctgtcacatttgagaacaaaagtgatgccgtcgtctatcaggaactggtgagttcactacttaacctaactaatttccgctcgtataaagtacaagttcgtataaacgactattttcttttctagttgggcttggttgctgaacaagcttcacaaagcgagggttgagtccgcgccgaagaggcgcgaagatgacatcctcacaaaggcacttggaaccaaagaacatcctggccgaactcggggaattggtagcgatgtgccctggaagcatggactctctcagtacagctcccaatacaggaaatgaaaagtctccaaggaagagagggatgctcgtttgaaggccgaacataaggttgaggtcattcaagaactagaagctagcatgaatgcaagggtggaagaaagggttaacaaggtcctcgccgacatgaatataccccgtcacaacacctgctgtgcaaccaactcctcgtgcacaacacgacgcgagtccgtcacagcataggagtagttgtgcatccacagaggtgccggcccctggtcttccgatcgcaccactagctgcagtggaccacatcgaggtaattgttgttatccgatccatatctaataaaagacatttacacgttccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctactagctgggtatgccaaggtgtccatcgatatagtaaaggacacctggtcaggctatccgctgcccgtgcccccaaatgatgaaatcatgactttaggcgatgcgcgcaagacgttcatacaatggcccaaagaagacatagttgtgaagatgactcctcgtccaagtcgaccgacggagtttacacctcccaagtttaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacacggcaaggggaaggtcggggagttggcgccggagccaaaaagagacaaggctgcgacgtcgatgccaaaaaggggcaaggctgcgccagctcaatttgagctaggcatgccattggtggaggacaatgtgttagccgtgatgggtattgcttgccgagagctacataaacaatacatggagctaagcaatgccaagcggaaaatgagggagtcatccatagttagacatcacgaccaccagccgttcctatcgtcgcctgcctatataactataggctttgatgacctcttcgaccttttcaggatccggaaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagccaaggagtacatcatgtgcgcacacaaccaagagtaagaggacaatacccttcgtgtatattgtttttgaagttaaggttcttagtactaacactacataaccactgcgcaggcgacattgaattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaaggacgaactttatcatgacaccaagtttgcatgcgcacaacagatcggagaccaatgtggtttccacgtgtgccacaacatgttaacacttctaagagaggtgaaagatttcgacccttaggttgttgctaatggcgaataagctcatttcaatacctacattgctattgaaaacgtgctaattaacctcttatttattaaacagaaaggtagagctggcttcaagatctcacccatcaaccctcccgctatcagaggcgaagtgtgcgccttcattcttgcagaaataatgaacaagaaaggacgttttcatgtcaaatagactcatgaacttggctagataatttattgtgatgtaaaaagatgtttttataatttcttgcgatgtaaaaaattatgtttttatggagtgcaatgtaatttactttcatatgtgcaatatttatggtagtttactaaattgtcatcacatttgatcaactacgatttacgttgtactattcatctgttttctccttttttttcccttattgataggttgtggaggtcgagtacattatggctttaatccatttggtaagtatatatgcggttctatgagcaacgaccgaaattgtggctttcaaggggtgtgaatttgctgtgcaaatttgtggcatttgaactgcatatatgtgttgttggggatctgtgatgtttgagatggatctgtgatgttatattgggggggtgatgtatctgtgactagaatatatctgtaatgtatctgtgtttcagagggcatggctagcaaattctaagactagccaatatttagcatttatttattttttctgaaattaactcatcagtgacgggtcggaacaaaaatccgtcaaaggtaacctaacctgtgacggactagcaaataaagacccgtcagaggtgacctacttgagacgggcctttacttttggggccgtcacaggtagatcacctgt

SEQ ID NO: 58534 - DNA, 21857 bp, Oryza sativa
gtcactgcaaatgctaatgctctcacttttagaaggtcttttggggagagagaatctgaggaatggctagctattgtgcgatatcattaactctattgagttgtctgatggcccagatgtgtttctttgggggcttaataagaataaaacttacacctctaaatccatgtatcgagcaattctctttagaggagtgactaacactagaatgcagggtgtgtggaaatgtccctgccttgaaaaaattaaacactttctgtcgcttgctttgaaaaacaggattcaatctactgaacagctgaagaaaaatgggtggaagggttctgagttttgtgttctttgtgggatgcttgaaaccactgatcacattcttttccaatgcccaatggcctctttagtttggtgcatatgcagagatgcttttgactcgagtattatacctaggtcttttgaggatttctacctgatcaatggctctttgggtggggatgatctgagagttcttttgtccctacttgctgcagtttgctgggtgctgtggtccactaggaacaacatgatttttagagaaaaattagtctactcacccctatcattaatgttccaaatcaattcatttttgcagctcgggagaatccttagcagcaaggacgctgagaattttgacaagattactcggaagctcatggatgctacttcaactctgagacaaccaagatctggagttggctgatcgtctgaagtttttagttcttagtcgtttacttagcttgagagttttgatgttaagaccgtcttagagttgttttggttcctgttaatgctgttcagtttttatccccccctaatggtgttaattctggaccttttctgtgcgtgatgtaaaatgggtatccccataacgatgccgtgtttggctttctataaaaagccgggctaatggtctcagtttcaaaaaaaaaaaagatccaccaccacccgctcctcctctgccgcacttctctcctcctccctccccaccaatagtgggtccagcggttgctcattgtaacaccctgaaaattcgaccaataaaatgaaacccgaagttgagtactttcaaaaacttttaaataaattgcattgccaatgttattggttcttttgttgtgcatcatgatggatgttatggttgttattgcttgccaaactataaattgtcacaaatgaaaattaagctaaagctatacaactaagtaatagttataaaattatggtatttattgtgaaccctacaaatatttacacacaacacaacaaagcaatacaaagagaatgttaattactaatttaatttataggttaaatattaaatattggagccatgtgataagtgtctgtgacatctaagtacatatgaaatagtcaccactacaacgaccctaataattaagttgatatgtataacttgccttgaggctctcatggaataaatttcactcacataaaataattagtatgtaaataaattgagttctatatataaaaaggcttatatgagtactcgattcaatatttagactgatattgcaccaagtctcacagtgccttcatggaataggaattgaatagattaaacatatcaaaatgcaatacattgccatacaaataaactcgaccgatgtgctaatgtattattaaaggtcacattagaatattttaattaactttagaaatatcaaagccttcgagttatataggatgaatttaggatgatataaagtaaagccaatttcattttgggaaatgatgaatgaataaataaataaatattcaaatcaaatatttgaattcttaaacccaaaatgtataggttacatctcaattcagaattccaatccaagacattgtgcagtttggcccctccatcttttcctattcccttttcttccttttctctctttttcccagccgccactgttcctaggccgccaggtgctcgaccagagccctagcccaagccgcacacacaacgccacacctccgagccgcgaacgtgtcgcgcacgaccggtgcgccctcctggtcaccttgcaccgtgcgccgcgccgtgtgccgtgccacgcccgcgtgggaccgccgaccgaccgagccgccgaaatcccgcacaaaggccgcgtcaccacaagcgcctgcgtcgtcccgtctcatcgcgagtcgccaacgagctgagggataacggccgccacgttgttccgcgtcaccctagaaaatagcctgcacctctgtatcggcggtcgttaccactgcccgtcgccgctaatcatgtcgccatcgcattgccatctcgtcgcccctagctgagaccgttggataatgcgatgtttcttccccagctagtactccctcttctgaaaccctatcggctatcgcataggcaatcatgcccgatcgatgcattgaacccgaatcataggtggaggaaagcttagccgcgtcaacctccctaaacctaggccgtagacagccatcgagcgcgcctgtcgtcgaccttatcctccatgccattatggcttatccccaagccaaacccccataaaaaaaaacccatccctctctaccttcttcctcaaatacatttcatcgaacaccttaggtgcatgcgtagccgaagccggcgtagctgaccgcgggaaccgtggctcgggccgcctctgttgctgctgatgccttcgatcaacgccgggtgccgctggagcccgaggacctgctgtcgaacgcctgtgcgctcgccgccgtcggcatcctctgcttccttaccgcctccccaccgcgacgccgcgtttcgccgactcgccatcccaccttagcgtcctctaccctaatattagcacccatggccgtgccggcccggctgctgttccgccgccggcgatgtccccgtggacatgctatcccggaggcttccccttccatcttgttagaaaaacggaaccaccatacactgtagaagcttgcgcacccatctatttggttggaacctagccctaccgccctgtccccttgcaccccggagctcggccatggcggccatgccgcgccgctcgcccccgcgccgtactgcaccgttgttgccggcgggaggtcgctggagattcgcctcatcctccccggctgctgctgtgccggcctcgcaccgtcccggcatgcgcgctaggcgcatggcgcggctgcctctgcctggcgagaggtagaagacgacgggaaaaagaaagggacgagagagagaaaccgtgtggggcccacatctagtttgcgcacagtaatcctccacctaatggtgattaacccactcaatgacatgtggggtccctattattaaaatctaagtaaacttaattatagattttgttacaatgacaggcgggacccaccggagattatatggccggcttaaccacagtcaaaaaggggccggacccacctgtcaatagcacatctcatttcctttgaaagaataagataaagaaaaggaaataagaatggacccacctgtcagtcactaccacatacggttaatgctggaataaaaataaatcaattatgaatagtaacatttcacaattattggaattaattcaaatttgaatctttaaacttgcataactcactcattttaactcggattcgaatgaaacttgaacctaaatttatctaaaatcaagatctaactgttggtaccactttctcgatttaatttgtaatttttgaatttttggtgattttatttgaattctaattgaattcaaatcaaatctttcgcacgtaaatttagattccgaaggagttgctgagttaatcgaagatccgggtcagcaaatctgcgagcaaggcaagtcatcactaatctttgagcatgttggacttattgcgaacttattttgatttaaataaagtttgcatgctatttatatgtgaatgtcctaccttgttatatgccatacctttgatattgattatccatataatctttgtaatccatgatatcgtgtgtctttagtcaatatttgacaaatgcttagcccatgctaattttgatccatgcatattcatatttgtcaaaatgctttatgcttgggcaattatcttagggaaggtaattgacatacagcatgtggagacatgagcgccacattgccatgataatgatgagatgatatgtgaaagaaaattaaactgaacaaatgttttcgactagggcggctggagggcttgggtggtgtccagtaaaggctagtgccgtccctgatcagttaaggatcgagccatgaagttaagcatgaaacgaccccagtacaaccgtacttctcgaatgggtatagacctagcggagtagataggcgagcggaggcagtatccctacatagtggtttcacttaggtgtgtggacgaacaagcagtttgctggctgatacccgatacggatggccaaatggcggatacctgatatggatggccagagactgacttgtcaagattacaagactacaaggagatacccaaaagaggacagcatggattgggttcaactacaggatgcaatgttaggcttgcgtgagtttccccctcgggagtgccagaactcctctctgtgctagaaacttatgacgcttagagtgcatgaggatgtaagttcatggagcgggtactgccaatgtaaggtgtcacgcccggaatttctatccaaaattccaaacgcttacatatgtgtgaaccctcgtccaggaatcagccgaggcacacaataacaaattgataataggatacaattattactctaattaataagcgaagaaaatgtcattacagaggtagatagttcctctcaaacaataaagatctaagcagcggaaaaaaaagataaacggcgcagacggctccactccacagggagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaagtaataattaaacaatattaatccaacgctatacaacataccctgttgtataggcccatccattctgaacaaccatcccggctgcacagttctatctccaaaccaggaatataccattccaaaccaggagctaatcaaattattaccagttatagcatcttctattatggtgagaagggtgagactaatcacgaaagacattgttcaacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtacaacataacccattacagcgcacctttcctggatcataatcaccccctttaaaacaaggcatggactccccagcgacccccatggacttctcgccacttctcagtctggcgcactataatgaattacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccagattttaattatcaattagttaacatcacacgattgaccatcgtgagctaccattaaatataaccattattaacaataataattatgtaatataatttatatttaaccccttttagttagctaatgtttctatgcatggctaagcaaacctatatatagcatttagctgaaccaatccaatatataaggttcatgctaatcaaattatagcccataggaaaataaagtcatcttcggccaataaataactgggaaaggttcaccacccgatgacattcgaaaacaatgcatagttgaaataaaacaatagctttaaacgggatcaacatgctcaaagggttgtttgggatctgtgtgacttgccttgggcttccacaaacgcttcggaacctttctcaacggaaacgctctcctccggaacgtcggaaacaaaagcaaataaacaaaatcaacaaaacagtacaaaaacaagcataaacagtacatgaggatatttttaacatgtagatctcaattttagaaaaatttagagacttgaaccaactaaatcggagctacgatgaattagttatgattttttgaagatttaatcagattaaaacacttatattgattttaattgaattatgacgcaataatgaattatttttgaaaaggaaaaagggatttattgcgtcagcaggctagggtttcggtggaccgggcgcacggcggcagttcacgcgaacggacggccgagatcgatccatccaaaacagacggccgagatcgatcggtctacgaccggctcacgggagagggcgacgatgacgtcggtgatgacatcaccaccggcggcggcggctcgacagctcggacggcgcaagctcaccggcgaacggcggcgcttcggcacgaacggaggacaccaacgggtagagcgcgacgcggcgaactcaccgatgaccaaaggagcggcggaagaccaacggacggcgacggcgatgaggttgaaacggcggagctcttcagcttgacgacggcgacggtgctccggcggtctacaacgacggcgaaggggcggacgaggacggcgatgacttggcgaccacaacggcggtcttcccgagcgacggcgacgacgagaacgacggcggcgcacggcgggagcgacggcggcgacggcgacgctagggcacacggcgctagggcgtttccgacgacgagaggagaaggcgagggtggcggcgggtagaggagacaccggggagccttttaaaggggtttgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaaagtcctcttttggctttgggctgaaagtcggcccaaaaccgcttcctctctctctttccctcggcccagtccggcccagttcgtagccgcccgcgccgcgcgcgcgcgttcggtcgctgacaggtgggtcccacctgtcaggcccgtcgtcttcctcgggccgaaaccctagcgcgccgccgccgagccgccgccgccgtttccttccaaatccggccgcccctttccgtttccggccgaattgatagaggggaaacactctccgggatctcctctaccttttctcctttggaatcatcggctaaatcggtttggaaatcgagggattcgagttcgtctcggattcatttttcccgaaccttccttcctcatcgccggtcgcagtggcccttcgccttcgcctccgagcccctttaaaagtttccccgagctcttctctacccaccgccaccctcgccttcgcctctcgtcgtcggaatcgcgctagcgccgtgagccctagcttcgccgccgccggcgccactccagccgtgcgccgccgtcgttccagccgtcgccgtcgctcgggaaggccgccgtcgtgttcgccgtcgcgtcgccgtcctcgtccgccccttcgccgccgccgaagaccgccggagcgtcatcgccgtcgtcgacccgaagagcttcgccgcttcttcctcgtcgccgtcgccgtccgttgatcttccgccgtcgttttggtcgccggtgagttcgccgtgccgcccgcttcgtcctggtgctttccgttttcgtcctcgcgccgccgttcgccggcgagcgtgcgccgcccgagccgtccgctccgccgagccgccgccgccgtcggtgacatcattgctgacgtcatcaaggccgtccgccgtgaaccgccgtggacccgatcgatctcggccgtccgtttggattggatcgaatctcggccgtccgttcgcgtgaaccgccgcccgtgcgcccggtccaccgaaaccctagcccctgacgcaataaaccttcttttccttttcaaaaataattcaatattgcgtcataattcaatttaaaccgatttaagtgttttaatccgatttaatctttaaaaattcataactaattcatcttagctccgatttagttggttcaagtctctaattttttctaaaattgagatctacacattaaaaatatccacattactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctttatgtattggttcaactagatattagatataattgcttagccctgcttagaaacattagctcactattgggataacttatgactcactgttatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaagtgtttgctaaaagctgcttttgcaaatgaaaccctattatgccatcctttgttatcctatgcacttgcatatttgctgcgtggcttgctgagtatgtcatatactcaccttgcaattattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacagctaggaggcgacgacgaaggcccatggcggccggcgacgagatggaaagctcgagctcgaagagagaaaaaccgatccaattcgaactcgaatccaccgatttccaaaccgatttagccgatgtttccaaaggagaaaaggtagaggagatcccgaagatcatttcccctctatcaattcggccggagaaggaaatgggcggccggatttggaaaggaacggcagcggcgcgaaactagggtttcgggcggcggcggcgcgacgaagacaacgaccctgacaggtggggcccacctgtcagcgggagagagagagaggagagcggcggctcggactgggccggctgggccgaggagagagagaagggttttgggccaactttcggcccaaagccaaaagaggacttttaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaaggcttttaaaatcatttctaaaaattccaattaaacaacaatttatatatttaggatttttagggtgtgacataaggttattgaaaggctttgccgtgacgcgtctcctgtgttgggacgaggctcatgtgttgggcagtcatggatgtcacatcctgattttcgcctcaggatttataaattatttaataaattaataatagaatttatattaaatgttcatcaatttacaagtgaagttaaatgcgggaaataaaatttcctaaataaaaagcatggatggatttaattcttattaaattctccatggttaattatactctctggaatattctcggatttttcggagctcaattattaattttaatcatacaaagagaagttcagcaattatttaaatattaaattaatcatataatgatctaattataattgttaagtgcttttcctgtttaaaatccttaaattataaattgttgtttaaaaggaattaatagaaatgattttaaaagtttaaaagagaagatcttttcttttaatttgctaaagttcaatataaaattgggttagataaaattttattaaacactttgcttgttcctctattttctagatttttctgggaattatttgagcaagggaagtatttttaataaatgaaacaacatttcacgaattattttaattgaaaaagttttaaaaatcctctcttaggccgttgggccgatttcggcccaactctctctttcctctctctccccgcgcgcggcccacgccggcccaagccgccgcccgcccctctctcccagccgctgacatgtggggcccacatgtcagggccgtcttcctcctccggccgccgccgcgcaagagcccgaaccctagcgccgtttcccgcgccgatttcgcccaaatccgagctcgattccttcgattggttgaggggttttgttcctctcgatctcctatttcttttcccccaagaatcaaaacgaatcgtggaggtttggatccgaatcgaactcgttttgttttatccctaaaaaaaccgagttcgatttcttcccgattcgattcctctcgtttgcggcttgatctcttcgatccgagttcatataaagcttctccttgatctcctcttccgtttgccccctttctcgagctctcccgtgcctcctagagccgccgccgcgtgcattaggtttgccgccgccgccggccatcttcggtcgcgtcgcgccgccgcctccgtcgtcgccgccgctcgccgttgccgccaagaggagcgccgtcgtgtgaggaagctcggccgccccttcttttccgccgccgaccaccggagccccctcgacgccgtggacccgaaccgccgcgccgccttctctcgtcgccggccgccgtcgtgcatcctttgactacgtggtgagtaccaacgggttcgcctcgttgtcctctacgcgtagatggcctccgtttccgccgtcgactttcctagcgccggcgagctcgcgaacccgagccggccgccgttgggtgacgtcagcgtgacgtcatcgcaagggctgacgtcatcagggccagggctgacgtcatctttctctctttttcctttttcccgttttttctaatagattaaaactttggaaaatcataactaaataaccgtagatccgttttaggtggttcaagttgctaaatttttctaaaataaagatctacatattaaaattgtccataaattgaattaaatttgtttaattctttttaattgggctttaattagatttaatcttgtaaaattcataataaattcatttgaagtcggagtaaggccgttcaagtctcataattcatctaaaattatgatctacatgtttgtttactttttatgtactgtttatttggtttttattagtctttttcttcgttttacgtgttagtttgtcgtttccgtcgttgcgaaggttcgtgagtgcgtcggaagtgatcaggaagattaattgaagactgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccttattccttgataccttgggtaataaattgattagcttgaaccttatgtattggtttggttcagctaaatgttagatataattgcttagcaaagcttagaaacattagttcactaatgggatgaattatatatactacattattatttgtggtcatatttaatggtagctcacgatggttaatcgtgtgatgataattaattgataattaaaacctggttaaggtgggttgtgagcatatggttttgatggttgtgctcatgacaattaaggaccggtttgcgagctactgttgtgaaacatttaccgtaccaaccacaagccagcgtgggcaacggctttatcttttgtatagcatgattcattatagtgtgccagactgtgaagtggcgagaagtccatgggggtcgctggggagtccatgcctctggttgtagagggggtgattatgatccaggaatggtgcactgtggtgagttgtgttatgtagggggtaatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatttgtacagccgggtacggttgttcaggatggttgggcctgtgcagcatgggtgtgctgttcagtgttgattaaaatttctgattaattactctactgttttacttctcttaaatgttttgctaaatgctgcttttgcaaatgagcctatattttgccatccattggaatccttgtgcacttgcatatttgctgtgtggcttgttgagtatgtcatatgctcattcttgcaataataaatcaacctcagttgaagaaaaaggatccagaaggagaagacgtttggcttataccccagttgagctgcctgtgggagtggagccggagcttcgctagattttattttttccgctgcagttttcttcttggtgaggactaagtgcctcataagtaagtatttatcgttttagtttattatgatggatttgtatattaaattgtcagtttgtgtacctcggctgattcctggacgaggattttatgcacaaataagttcggaaattattagtgaatttccgggcgtgacaatggagtacgggtgaagtgtacatccactgcagtgtgagtaaaccgaatatattcgaatagccgtgctcacggttattgagcaccgggacatgtattacacttggctagactctgaactcttaaaatgatgggtgggatatgcataatgattttttgactagtggatcaacttctcgagaggcgagaaggggtagaccccagaaaaccatgacgaccagtggcgagaagctatccttgggagcacaatggatggtggacagaaccatcgctgtttaatgaactatggagataaaatttgatcagttatgctaggtcttaagcttgtgaaaagaattgcaaaattgactttatgcaaataaaccattagcctttcattgaatatcctctatcatatgcatcgttgttgtgggggcttgctgagtacggttggtactcactcttgctatttacaaatttcatcagaagccggtgatgaagtctcggatgacccacatgcttactaccaggagggtgaagaagatggcggcgcttaataggtcttagttatggtcgttgcctgtggcaatggcgtcgccgctgccttgattccgatgcttatctatttctgcttttggtatgtattccggaccgtttggtcctatgttctaagactccctgcgggtctatgatgtaataaatcgcgctagacaatctatgtatgcgcaattgatattccagcaatgtaatcgtgaataccagactacttgatccagggaaatggtactattaacacgagagattcctgttataaaaacaggggtctacactcgtgcaagcgggggcagctccggtggcggctagcgcaggtgatggctcagcgacggaggagggggatcatgaaggtggtggcaactacccgggaaggcgacgacaaggagaacagcttcaccgccgggccactgggggcacggatcggccaccaccgggctcctcctcccttgtcccaggtctagtaagcagtggtgttaacaataaaatttggtaagccccgaagagaattctcacatcgccaatagtcgaattcatgctatattcggttaaggaaattaatctattaaaggaatcttatccagaagtgattgacttcaaggaggatgtggtatgcaagttatctattaattaggaatagtttgttagtttccttttatctttagggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataagctttcgatctccggcgaaggggtaagtcctacgttccaccggccctggcaactatattggcttcatcggcgtcgttcaaggctgcctcagtacgttcgatctcttggattgctctggttcggtcgatatatttacctacttatttatcatatgtctctattaatctagtcttagcatatcaatttagctctatcggccgcttctcgctttagggtttccgctggtatcggctaaatcgtgttgctagattagattagcttagacatccaccaccctgaaaatcagttaacggcttgattgtctagatattatgtttatttttatacttagtgctgcatcagttaagtttgatctactaagtcgtgtttagaaccataatctctagcctgtttcttgactgccaataacggtttcatcgggattttagccgatgaggtatctagacgttgcatcggcctacaaggattgcatataagttggatttagccgatgacatccaaggtttttactgtttatctaatcttgtggattttatgacatcggacttccagccaatgtatgctttaaccttcagatcattgcttagtctatcatatcattattagccgattgtttctactggatattattattgttatattatatcactatcagccgatcatctttatttatatcaagtgtcatattctatatcaaacatatagccgattgttcaaaaccctattgctatcgactggtatcagtatcggctggaatcactccatcggcttgtcagccgatcggttatttgatctgctatttgtatatcttgtcagttgcaggattaaactggctggcacgtcagcatctcatcaacctttggatctgcactggagctaagcatatctcccaggcaagtgtgtgtttttcacgtcaacaggtgggtcggggcgtggaattatgcgggcagcaatgtctgcagcgaacacagcgggcgtcacacatcttctggctggcagtgcagatgcatagatttgctttgtgacttgttcttggatttgctttgcaattgtgctcattgatgtgtggatttgcattgtgacttgttcttggatttgcttaatgcaaggctgctgcatctgggcattttcaaattttgtttgaacatctttgctggcggtcagagcaaatgggtgtgctttgttttcaactttttctaaaccaaaattgaactttgcaggcggccgtcgtaagacagatgtctctgaaaacggattattgtagacggcgtgcggaacacaccgcaaacaaaaactgattttcacttgcagcccacgtaacacagccgccagcgaaaacctattgtcgctggcggttcaaatcccatcaatgatgaactttgattttctctggcctttggtcgcaggcggctagcctaaccgccagcaaacgttgattttagccgccaggaaactaatgtgtttgtagtaaatgggaatttagcaaagactcctaataatcccttctttctatataaagctatgtgcactaaacacctaaagctcagcatgcaaacaatgtatttattagcactcctaaaacccagatgcaagcataccacatcaacccattaagcacacaaagctcaacgtgcaagcatatagtaattatatctacaatttatttcatttaaaactaaacatacacatgctaaaccatcattctcaaatcattttcataatatttgaatccaaataattttatcatttctccattagctaacatatatcctgcagcaaagcgcggggcatcatctagttatagtatggagtagtatatatagtacgtatagtatccaaacataaacgtaacataacaaagttatttgttaatgaaggtgggatgtaaaaaaactccatcactactacaacatctattttcgcaagatgacccccttactgtacatatggttctctgcagcctactgcgccttttcgccaaacctggtggttttcaccacttctaacaatcttcgcccgacgaaacaatatccatctccagtccaagggttcgatgacctttcctccaacggctagcatattttctttgctttgggtatgcctagtgaaacactgccatcaaataattattaccttttgcaactgtcaatgaaccaggtgtgtccctagttgtttgcagattgtcacagtgatcggatggcagcactttatgctgagattgctgctgaaccttagtctttggttgtataatccacgtttgctgatcggccgataaccgcgcatcctcccgccatgcggcacagccacgtggtgcgcggagagggggatggcgggagggcgcgggagagggggcacgtagcggttttttctattttttcagtattttttgttttatatatacatatatatatatatatgtatacaaactttgtatacgtgtatatatttttttatacgtcaaaactatatactgttggcaactttttatgacaagtcgacaagcacgatcgcaacacctaaacgccttgtggtgatatagagtcgccaaccacctcgatctagccaaagggccaaatcaagatgggattcgtagaaaaacagctaaaccggctagcgaagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacggcgcaaactgacaaagatggactaaactagggtaaaatagaaaacatagtaaaagaacgattcaagtagattgtattcggggattttacaatgaaccggccttgtcccttaaataggggttggtcttgccctctacatgctcttctccacatccaactcgggatagaaaccaaagaaaacacgaaacctgccttcccgagtaaggaaacccgtcactttccaaactttggcaattttcccctatttcgtccataggtgccatatttgggtgtaaacacatgccccctgcctttttggtgaacagacgtgaacctaaaagcatagaacatgttatctccgggcgataatccaattaccggccataggacttcctaagcatcttgccaaatgctcgggaagtatttctttaagtatttcccattaattgatctctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagagccaagatttacctcaactggcaaaacggcaatttcaacaatgttttgttactcgactcggcttatccattagcccgagcgtagtaaagagaagaactcaacaacttaatatcataagattcggcaaaacttctcacttccttggacataaaagaagctcctttaatgttttaaggaataccgaatctatgaacgatatgcttcaaaataaagtcaattacttccgcataagtaatattctcgagcgggacaaccttggcccacttagtgaagtaatccattgcaactagcacgaaccaatgccattttgatggcgaaggataaatttgacccatgaaaaccaaagcccaacctcggaacggccatagtttaatgataggattcaatacagcggtaggcgttaattgaacattgccgatccgttaacaagcttcactctctctatagtatttagaacaaaatcatcaattaattgtcggccattgaaaccccactctcctaagcaaccaatttatcttacggccgattgatgaattccacaaatcccttcatgaacttctctcctagcaactttagattgatcattatctaagcatttcaacaatactccatctatttttcggcgatataatatttgaacatttgccgccgaatcttccgatcaatcttaagtgtaggatctttcaaatatctaatcaaaggaattcgccaagctatttctatctcatgggcacaaatgtccgaattcacaattaattcggccttttaatcaattgtaacgtgccccccagcctcctgtctgggttcggtcagaccggccacgcaatgccggtcagaccaccctgtctgcccggtcagaccggccatgcagagccgatcagaccgcgggtaccactggtcagaccggccgtgcaatgccagtcagaccacccctagtctatgactttgccaatttcgtccaaacttttgaaatcaagcatcggcctttagtatataattttttttttcacataatagctagatgcttggtatatcaaattattggaccaaaattccttctctatagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatatattccaataaactaaaaatgtaagtaatcggcttgagcatgtatgcaaaatattaacaatgccaatgttcctaaagaaaaccactctagagcaaatcatcacattgaccattgacattagccgaattactagtaagcaaaactttcatgatgcaataaatatgaaatctatatcttatatggtgatccataaaaacacatatgatttggctttaaataaatattaaagagtcatgagccaaatcatacttcaaacaaattatatgccaacctaccaattctactacctagaactggcatttgcaacatgtatgtataatatcaatttgataagcaaaaacacacatgtgctagatagtaagcaatattctaacatggcataggcatataatgataaacacaataaactcataccttgccttagcatccaacaaatggcggcacaaagatgtggtattgtatccatcgccgttcatcttcccttggttccctcatgagcatattaatgtcttgccccacaagcaaaatcgcctttctcgactgcacgatttcgaaggcaagacgaacaccgcaccaacatcaatagcatcatgcgaaagagacttatctctaatgaccgatgattcttctctcatcaaattggatttatcactactactatgggaaatcaccggtctcttaacttttacttctttagatctccacatttgcttaagtgtcgttcgaagctctaaaatgttacatgttttgttctccacatctttggcctccttttatttttgacctatggcccgaagacgctgtagcctcctcttttgagagcgagataagccagaaggtatccacttcggctgtggttgttttccaggagctaaacaatgattcttgatattttttgttgaagtgaagctcttatgttgctctcaattttcctactcttctccaatgccccctggtcaggccagcctttgggcccggtcagaccggccagtaaggtcggtaagactgcgcgtagactggcggttagaccggccacctgtcccggttagaccaccaatgttgacagtcacggtgtcgtcttcgatctcctttgcttgcgtggtttccaccgcatctccagtaggtacataaacatcttgagactcctctttcatagcaatgacctccggagcgttggcttctttcctcacccacaccttcttcacctttttcacttttttcacctttgatccaccggaccgattcttttgtgggaaacggtcctgccttgggttagacgaatgatttagcactgtcctaggtgattccttccatccttgataatacggcataggtggttgaggcatccatggcatataatacataaaaggatacccatatagtgacattgaatatagataccatggcatcacaaccggaggtttgtatggagttggtatggttgatggctccgattgctttgatgtttgaccaaatctcttcctacgagatgatcttggtctttttgaatcactagtttgattatcaactcgttgaccagctaatcctttcttgtacttagccataagcatctcaaaagtgagcttcagttttttggtcttttgggaactagatgactcatcctttgcaactttacgatcttcggccttcgcatttttgatcctattcttgggccgaggatccccaataataacacttgtccctttctttttgtcaacatcaatagaattaatagggagaggatcactaccaatttcgatcttagccatagatgtaaccgaaatagtttcacaagtgccgatgaagtatcaatcggtctttgctccatt

SEQ ID NO: 58535 - DNA, 1515 bp, Oryza sativa
gtgtgccctcattccatagcctttcgaagtcatcgattatcgggtcaaggaacacatcgatatcgttgccaggttgtctcggtccttgaatgagcatggcaagcataatgtactttcttttaaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttaggcatgccagcgcacaagcttagcttgttccttgttcgcaaacattctcttcatgtgctccgcaattgggagataccacaccacctttcctgggcctcccctctttgacttactttattcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaagaagttctgtaaaactcttgtccgaccagccattacaagccttaagcttcatgagttccaacacgcatgacaacttgctgtgcttcgacttgcattcatcatacaacggcatctggcaatcttccacccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggttttctctacatcctgatccaacacttcttcagctgcaatatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacaatgcgcatagtacatccatctacgatccatctgaaatcaacaacatacgaagaaaaataaatgataatcgatatgttgagaatgaatggagaataatgtgttttttaccttgaattttagcaaaaaatcgccccccttgccctcccaaccgatttgtgaacagtaaaatggtcgggatggaaagcagttggcagtttgaggggtatttatagacccaacacacctcaaacgggttagataaaaaaagcccgtcaaaggtattggtcatacctttgacgggcttctattcagaggcccgtcactggtatcccct

SEQ ID NO: 58536 - DNA, 1709 bp, Oryza sativa
atccattttcactggcagtccatagccccccaccccttagagtattttcgctggcggtgatcatgtatagccaccagagaaaaaaaataggttgacggcatgaaaaatcgtaagcccgttctaggattctgaaaaggctatcaattagaaagagaatcatatagaccatcaaatttatgtataacttgtgtaacctatggcttagattggatttataatgagacaatgcatgaaccacttatgaaaatcttattgaaatccgttataaacacggctgtatggatgatctaaggtggctgagcctacattaggaaatctcatacaatgtatatataagttttattgtgaatgttgagtgccatttcctttaatattatgtgctttaacttaggattctagaaaaatacacaggctatgtttgggaggtgaatttggaacttaccggaaagaacacagctatagtagagtgtaaaatttcaatttttgctcagatgaatgatccgagaccatggatgactagagctcatcaaataatgtgaaatatactatatgcacatttgttgtaatcagagtatctagagtttgggtgaaattacggcacaattgaattaattagttcggatcatccgatttccattattaagagccataattcttttgcaacaaaaagaagagagagaaatacagagatgctggagggctcttgcatgttttattaggatgaacaatggtcacccggttggctgctcatgtttctgcacatgcccatgtgcctgagccgtcgataccaccggtcgcagacatgcgctgcatgtcacatcaggaaattaccatggatgtatctatcaggacgcatggcagttggtctcgccatggctgggtctcactaactagttttgccagctcccaaccatgttggtgctcatggtcgtgaacgggcaatatggatgcccgatgcctccgaagcctagccacatcaattacttgttcgtgagatccatggctgaaaacaatgcaggcgagctgcttatccgcttccccaggagtacaacgcatggctgaaaataatcgacctcgacagatctacgcacgggttcatcgaccacgtctccttcgcttcgactacatcgactatggcacaaagggctatcatccgtattgagcattctcgatggttcattggtggagaaaccatttatactctcggttggtaaccccttttagtcccggttttccaatagggactagcaatccgggactaaatatacacttctttagtcccggttagtgttaccaaccgcgactaaagagaaggtatctttagtcccggtcttttttttcattgtttcttttgccatagtttaatccctgtattttctcccaaatcgagtgggatgcatatcccaaatcccaaatcaaagtaacatcccataacattcacatcacagatcttaagttacttatacacacaaatcaaatacatcacaaatcttaaaaaaattacacacaaatcaaacacatcacatattatacattttagatccatgcaacgaatcacaaaattatacatctaagtgaatcacaaattgaaaaaaaaagagaaaggatgctggcagtggctgccccctgccgccgttcgccactcgccacaggcgcggccccgctggctgcctgctgcgtgtggtcccgccggccttcggatgggaagg

SEQ ID NO: 58537 - DNA, 9446 bp, Oryza sativa
ttaagttcgggtggaatgcacggacgttaagagcgtgccaatgactttttcgacctagagcgtcggcaaccacgttggcctaccaggaatgatagtgaattcccacatcataatccttgatgagttctaaccatctcctttgcagaagattcagatctgactgggtgaaaatgtatttcaaactcttatgatcagtatatatttcacagcgattcccaatgagatagtgccgccagatttttagagcatgaaccaccgctgctaactccaaatcatgggtagggtagttgccctcatgaggccgtagctggcggaaggcataggccactacatgaccatcctgcatgagcacgcaccccaatccttggcgcgaagcatcacagtacaccatgaaatccttgcgggtatccggcaagattaacaccggcgaggaaaccagcttttccttgagagtttggaatgccttctcgcattgcgggctccacacaaatttctcttctttcttcaacaattgtgtcatgggtcgagcgattttggagaagttctcgatgaacctctggtagtatcctgccaaacctaagaaactgcgaatttgggtgactgtcttgggttgcttccaatcggtgacggcggtcactgcttcggggtccacagcaactcctttagcagatatcacatgccctaagaatttgacttcggtcaaccagaactcacacttgctaagcttggcatacaattgatgttcccgcaactttcccaacaccaggcggagatggtgctgatggtcttcctctgagtgtgagtatatcagaatgtcatcaatgaaaaccacaacaaacttatccaagtattccatgaacactttgttcattaagttcatgaagaaggcaggtgcattggttagaccgaatgacatcaccgtgaattcatacagtccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctctacaaaaatcacaggagcaccccatggagaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagtcctatctcatgaagttctgaacttttgacagaggttgggggtgcaaagaagacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaagcccctgaatttctatactttgctgtcataacccctccaggggtggtgatgagcagagggttcctaagcctttctacccccaactgatttctccccacgaatggcacagatataaaagagtgggaagctccagagtcgaacaaaatggtagcagggatggagtgaatgaggaacgtaccaacgatgacgtctggagttgtcagcacgtcctcggccgtcacgtggttcacacgaccccgaatgacatccttcccaccattgttggagcggggaggcgcttggccttgctgacgcctcggctttgggcatttatccgcaaagtgcccgggctcgaagcagttgaagcacagacgctgcggacctgaagcgtccctgcggccttgtccaggctgcacagttggcgtaggaggacggggcgcacgagtcccttgttgattctactgcggctgcggctgtgggacgcgcaccacgaattgaggtcgaggcgcggagcgaggttgttgatgctgttgctgcggctgcgaggaggatccccctgggtagggattggtgtagcggaccctttggttagcaccctgttgattgcggaagttcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctctggggcataacgggccagattgttgaactcatgcaaatactccatcacggagcggttgccttgcttcaactctcggaactcccttttcttaagagccacgactccagcgggcacatgggttcttcggaaagcggcggtgaagcgagcccaagtgataggttgtccctctggctgcgtagcctggaagtggtcccaccagagagatgcgggcccctgcagttggtgggcggcgaagatgactttctcctcatcgctgcactgcaccgtgtctagctttttccccacggcatgcaaccaatccaacgcatccacggggttgttggagcttgagaaggtaggtgggcggatgcggaggaactcggcgagtttagagtgttgtgggggtggtggtggagcattatgttgtggcggattttggaggtggtggaggaaagcagtcatcatgttggcttgctgggcgaggatttgggtgagaatggcgttggtgtctggtggtggtggcgaaggcggaggaggaggtggaggtgggttgccctggtggttgtggttgctgctttcgggttggttgccatcaccggtgttagcatttctcctggtcgtcaccatctgaaaaccccacacagaaccagcaaacagagaaagagctaacaattaaaactaaccacccacgactaccataattcttgaatttattactgctattaaattggttcattaatgttcaagttgcttaggcaaataaaataagacaggctccgacacagttataccacacaccggcataaccatgccccacacgactcaaaaaaagacaaacaagaaagaacacacgcgcaaacctactaactgctcgtctactgctgcgacgggccaggacggaaggtgagcaacaacgcaccctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagacgcggcgacgcttggggcggcagtcctctccctgggcgatcttgagctgatgcagctgcgcctccactgcgtctaggtccttcttgagctgcaggttctcctgacgcagctccaggatcttcatgttgttctcgaccatcccacgacgcaccatctgatggaaatcgatacgagccgcgtcgtacgccttcaccatgcgcgccaggtgcacgatgggagcgtcatcctccgagccagcatctcggaaggtggcgtagtcgcgggctcctccgctacgagggtggtagcggtagggcgagtgctgcaactcgtccgggtagcgctggtgaagagtgccgatggcgagaagagcggcgttttggcaagcggcggggaaggaatctccgcccgcggtgactgccagcgaagtccgctcgggagagccagagaggatcactgcagtaacctcccaaccagcgtggggctctgcatcctcaccctcctgctctggaagcggcctggcctggtagtccactccatgtggataccccaagaccacgcacataccccgcagctccaagacgaagccagtcatgtccaaaccacgacgggtgacgctgccggccatctacaaacaaaaacaaacagaaaaacaacattttagagatcagattttggcgataaatgaagcagcaagacagagagagactagaggattttcacaaataacaagggatttttatttcgaaaatactgctaaggcttggggtctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacggcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattataatataaagggttagggttgcagtaaacagcatttaaagacatttagttgctccaaagctattttgtaaacacgattctagaactatacaatgttattaatcacggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggcagaggtgctactgtcaaaaccatgcacccctagcccagcccaaaaccattttagggattttgaatagaaggagcggtgtgaagccggttccacgataaccagaccattccaaagtatccaggtgacttgaatatttcccaaagtctaaagttgtaaaaccacctaatgttacctaattaacttgcgaagcatctacctaaaattaaactagtggtgccatgagtagagtgtccactagttggggttttgtttattctagggtgaacaaggtaatattaacaataacaataataaggtcataacaaaggaaaataggcatggctaaataaaacagtgataacgcgggaatttaaataaagtgataatgcaataatttaaatcaacataattttacaaactgggattcaatatgttcaaagatgatgtgacttgccttgctcgctttcccaaacgtcgtcttcaacttccacgaagagcggatcttccgaagctgcagcgtctacacgaccaacggaaaagaaaaggctattaccctaataaactccatataacagcagaaataaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggcccacggtggaccgggcgcacgcggctggcgtcggccggcgccgtgggtcccacgcgttagccgcacccacgggcgcgggcggctgacggccgggcccacctggcagccgcgggcgcgcccgaaggcggcctcgccggcacggccgacgggaggcggcgcacccgcgccccgatggtcgccgccggcgaccaacggcgcggcggagcggcacccgagagagaggagggaagagggaaagcgaacggcggtccacggctcaccccgggacgacgagggcggcggaaatggcgaccggagcggaggacgacggcggcgcgggctcgggtcgacgaggacggcggcgttccggcggtcggcgagcgaagcggaggggcggacggggtcggcgaggacgcggcgaagccgaagggggtgacgccgaaacgggaggaggtccggagcgacgacggcgactgaccggagctcggcggcgatggcggagagagagaacgacggcgcgggctcgattccgacgggaagagtgagcggcgagcggcggaaacggaggagcggagctcgggaagcgattaaatagcgccgggagagggagagagcgcccggaggggaaggaatcggccgcggaaatctcggccgccattgatgacgccggcgaagatcgcgggcgcgatttcggacgaatccgagggagagagagaggggaaagagggggaaaaaagggagggaatcacggggagtgatttccccctctttaatgcgcgcggggacggcgggatgcggcggattcggcggcggcggcggcgctagggcacgggcgcggcggcgggcgcggcgcgagaaaggggatgacgggtgggccccacccgtcagcgagggtggcgggcgggcccgcctgtcagcggcgcgcgcgcgggggaggaggccgatgggccgcgggggagaggagagagagggagagggggaagtgggccgagccggcccaagaagggaaggggggaaaagaagacttttagggtttttctttttataaaacctttttaactttgtttatttcttctcaattattatttgtgcgctgaaaattccactaaaatttatttacacattttaggcttttaggaaatatacaaaaatcctccaagccttatttgacttttaaatttgcacattttaattgttgaaggctttcacatgaattttaattattctcagcacgatttcgaggatatattttagagtcgatttgggacgcgacaaacctaccccccttaaacggaatctcgaccccgagattcggagggactggcgaagagatcgggatgggctgccttcagctcatcttcacgctcccaggtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacgcatgaaacacatcgtgcacgttgcccaaggaggcgggcagctccagctggtaagcgacttctccgcgccgggcaatgatacggaaaggacccacataccgaggtgcgagctttccctttgtctgaaacctgtgtacacctcgcaatggcgtgactcgaagatacacaaagtcacccactgcgaattccaggtcacagcgacggttatctgcataacttttctgccgggactgtgccacctttagattatcccgaatgattctgactttagcttcagcttctctcaggatatcagtcccgaacacttggctttctccaacttggtcccacaatagtggtgtccggcatttgcgcccatacaacgcttcataaggtgccatttgtatgctggcttgatagctgttattgtaggagaactcggcataggggagactcttatcccaggtcttcccgaaatctagtacacatgcgcggagcatatcttctaggatctgatttagacactcggtctgtccatctgtctgcgggtgatacgcggtgctgaaatttaatcgggtacccagctcttcttggagcttcttccaaaagtgagaggtgaattggcttcccctatcagatacgaatttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgttggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctatttaagttctctgttatctggaacgcatacccgatttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgactaactatgcttagattcagggcttccatctgttgactaagttcgggtggaatgccacggacgttaagagtgttgcaatggctctttcgacttagagcgtcggcaaccacgttggccttaccaggatgatagtgaattcccacatcatagtctttgataagttctaaccatctcctttgccgaagattcagatccgactgggtgaagatgtatttcaaactcttatggtcggtatatatttcacagcgatttccaatgagatagtgccgccagatttttagagcatgaaccaccgctgctaactccaagtcatgtgtagggtagttgccctcatgaggtcgtagctgacgtgaggcataggctactacatgaccgtcctgcatgagcacgcaccccaatccttggcgcgaagcgtcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattatggagaa

SEQ ID NO: 58538 - DNA, 12054 bp, Oryza sativa
attaacagaggaacttatgccagtacctgtctataagttcgaaaaccttgtcaaacgtagactcttttttatccattgagtcatatacgttgacggtgcaagccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgtgccttcaggagatggacgagattgtcctctgtttcttgtggatattggtcgagcattgcgacgtttactctccgagggtcgatgaattcagtatcgaaaaccctccgccgtcgggccctttgaatctccattctacaacgataaaagggagtattttattttatatagtttacttatatacaaggacctaattaaataaaggagacgtagtaattaagaaatataactgaacgatatacttacaaaatccagcaactcataatagagacgtcgagggcgtccagctggtatacttgatagattcccttgaaattgatccagagaatatcatctccttgcaagaagtccgggtccctgatcctcgctccgatcatctctctaccggtggcgctcatctccatgtacaactgatggaacttgtacatttgtgtgggtagggactgcaccagctcgggcttgacaagcggtttaccgagtttgtacatgtctttcaattccgccttttctaatggttcaactcctagcaattgatccgtagttagactggtgtcaataataaattcttctatcgtcatgtcttccccggtcaccaacggcttgatctcctggtttggttgctctccaagctgagggactggtttggactttccagaagatgctttcttcagcgttcgctcatagtctgatagcttgatggcctccttgacaggtgcagacatacccctgaagaagttcctgacactggggtctacaggaatcttcttttctggacttcgaggcttgaattgtctcttgacttctgatgcaacgtaagcgtcaagctcctcttgcgtgcaatcgtaccccgggtccttgttcttggcggcgtcaacttttgccttcttcgttgcccttgtgtgggcaggcggtggagctggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtacacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgctgtggtaagtacctgaagggtccgttgggatggccatgcctgacaccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgagacaggtcgattcgtcctgtgtttgcatggcgtccatgctctgtgatcttacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgaggtcgtagctcgatacccggaactctagatctgcaatcttcgcctcggtatctctcttgctcctcatccgactcctgtgcgtgtggatgtcttccttgaaaccaatcttccaaggaatcacccctttccctcgtgttcgtcctggatgctctggagtctgcagggcgagtgtcagctcgtccctatctctgtccggtcggaacgtgccctgagaggaggcttccactgcatctgttagtcatcgcgcagcctctcgtatctgatcgccgaagaccagtgagccatcagctgggttgagcgttccaccgtgagcatagtaccagaacttcgatcgttccggccaattggcggttgccggttcgatacccctctcaatcaagctagcctccatctcctcccacttcagcatcgcgacgctatagcctcctgaccccaagtggtgatggtacatcttcttggcggcattttctttgtttctttccatcatcgcctgcccttgttcacctgtcttatatgcaacaaactcgtcccagtgatcccttagctttgggaatgtgtcgaagttcggtgtctgccccttcaggatatatttcttgtacaactctcccttgaagctctgaaactgttctgccattttcttcagagtccaccttttcactttgtcctctatacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctacttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactatacaatcttatatgctaagtctaattacaagtctaatattatttgagtgcattacaaatataacaatcatttatattattacgtcacttgcctgcacgaattccttctagggctagctcttccactccggcttgagggatcactccgacaacacgtcttttctgcaagatacaaaaaatatgtattaggataaatgcgaagtaacatatatatattgcatttcacattcacgttcgttcacgttcgttcgctcgttcacgttccctagctcgttcacgttcgttcgctcgttctcattcacgttcgttctcgttcacgttcgttgtcgttctcgttcacgttaattcgttcgatcgttcttgtcacgtcctgataaattcatcccgaaataaaaatcattctctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtcttttccccccttttttcccctcttgggccggctcggcccatccctttctctctctctcctcttccccgcggcccatccggcctcctccccgcgcgcgtgccgctgacgggtgggcccgcccgccaccctcgttgacgggtggggcccacctgtcatccctgtcctcccgccgctcccgccgcctcgcccatgccctagcgccgccgccgccgcgaatcccgccgcctcccgccgtccacgcgcgcaataaagagggggaaatcactccccgtgattccctctctctttccccccatttttctctccctctctccctcggattcggttggaaaccgctcccctaatctcgccggcgccattgatggcggccgacctcccgcgccggtttcctcccttccccggccaccctccctcgccccggctctatttaaaccctccccgtgcctccctcctccgtttccgccactcgccgctctttctccccgtcggaatcgagctcgcgccgtcgctctctctctccgccgtcaccgccgagctccggtccgccgccgtcgtcgcctcggacctcctcccgcttcggtatcgcctgcttcggcatcgccgcgtcctcgccgatctcgtctaccccttcgtttcgcccgccgaccgccggaacgccgccgtcctcgtcgacccgagccgcgccgccgcctctctccgcttcggtcgccattcccgtcgtcgccgtcgacccggggtgagccgttggccgccgtttcgcttcccccttccctcccctctctcgggcgccactccgccgcgccggtggccgccggcggcgaccatcggggcgcgggcgcgctgcctcccgccggccgcgctggttcgccgccctcgggcgcgccgagtggctgccgcgtggggcccggccgtcagccgcccgcgccctcgggtgcggctgacgcgtgggacccccggcgccggccggtgtgagccgggtgcacccggtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttagccatttgaactcggaattggaccgttcaagtctctaatttttccttaagaagtcaagaacccatttttgtgctttgtttctgcttgttatatggagtttagtcgagtaaaagccttttcttttccgttggtcgtgtagacgcagcagcttcggaagatccgctcttcgtggaagttgaagccgacgtttgggaaagcgagcaaggcaagtcacatcatcctcgaacagattgaaccccagtttataaaattattttgatttaaattattgcattgtcgctttatttaaattcccgcgttatcactgttttatttagccatacctatttacctttgttatgaccttattattattgttattgttattattaccttgttcaccctagattaaacaaaaccccaactagtggatactctactcatggtaccactagtatgattttaggtagatgcttcgctgtttaattaggtaacattaggtggttttacaactctagactttgggatattctcatcacctggacactatggaatggtttggttattgtggaatcggcttcacaccgccccctctattcaaaatccccaaaatggttttaggctgggctcggggtgcatggttttgatagtagcacctcagccatataaggaccggtcttcgggcctctgttgcaaagtactaccgtacttccacatgtctagtgggtaaggcttagtttgtggctcagtctggttataaacaaaagtacacggattagagatggacgaagtagggggtcgatggacatctctaggacaaatgaaggctacacgagctgcggcccggtagtcgagatgtcatggcacagggctggtgtcctgctgctaggggctctatcctgcctacctgtcccggaggttccggccgtaggtggggttgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagttagtgttttaattcttaaaatttggcttaacaactaaaatgtggaatggttggcctgggttggcttgggacgagctgggacccagggtcgggttgccagttcggtctgaatcatcgtaggccttgggttaaggcaggttcgtgtgggttcacggccttgattaatactactgtgtagctctaggatcgtctttataaaatggctttgggcaactaagtgacttttaaatgctgttttctgcaaagcttaacccctatattattaccccttgtacccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgcgaagttggagccgtaggcccgctagtccgctgctgtttatttttgattgccaggcctgaagcgcctttgtaataatgtaaatattatcgatataataaagatgtgtcttttatatcacgtttgtgtggtgtaccccggcttttcctgggacggggattaatacactagcgttcgggaaaaggcaattttcccggtcgcgacagttctcgttctcgctctcgttcgttcgatcgttctcgttctcgttcacgttctcgcggcaacgtacgttgacgtgttcgttctcgctctcgttcgttcgatcgttctcgttctcgttcacgttctcgcggcaacatacgttgacgtgttcgttctcgttcacgtgttcgttaacggcggtgtggcggcatcgggccggctcttggcgcggcggcgtgcggtggcggcggtggcgtggcgacggcggtggcggcgtggcgttgcatgcggcggcggcgttgcgtggcggcgaaggcggcggcgtggcgtgcctgcggcggcgtggctcggcgtcggcgtggcgcggcgtctcgtggcgggcggcgcaacggagagagagatcgagatcggagatcgatgaagggagaggcggcggcggctctcaccccagagatgcggcggcggaggaggaggcggaggcggcggcgaggacgacgagctcgagacgatggcgtcggcgcggggatttgccctaggcagtggcggcgaaggagagaggccgagagagatcgatcggccgaaaacgttgagtgttggtggagaagacgagggcgcaccgggaaaatatatacccccggatctttactcccggttgttcttaacaccgggactaaagatatctttagtcccggttgttctcatcaactaggagtaaagatcttttcccgctatttccaaattctttttaaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataacaattataatcatcatatatacttagcgtaggaattatattaaattaaaagttaaaaactctaattaacatatgtaaatgccacatgcatgatttaaccttttaaaaattggaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtgaattatgccatacatcaattgatttatatggataatcaatacatccaaaatagtttacatcgtgtacacaataattacggcattacatcggcggtgacggttgtccgcacgtactttctcctcactattgttccctccttgtgatcgctgcgtgagtaaggggtgtcttcatttgatagaaggatgctagggtcaatcgtcaccgtgaaaggggttgctcatccaactgatcgtaatcctcgtcagtcttattctcaactccgacgatttttattttgcctgtgagaaccacttgacacttaggctcgtcaggccctctgcccttctttcctttgctagatatgtccttcacgaaaaagacttgcgttacatcattggcaaggacaaaaggttcgtccgagtatccaaccttgttaaggtcaacagttgtcataccactatcatcaatcattacgcctccactagtcaacctaacccattggcaccggaacagaggaaccataaggaccatagtcaagttcccatatatcctcgatggcaccgtaatacgtggcagttgttctatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgtgggaaaagtatcaatgtgatgccgtgtaatccatgcatcggacttaccgatgttcttggcgtgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgatttaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaggcccgagaatacggatctctttcacaaggtgacaaagcagatgcgtcattatattgaaaaatgaaggtggaaatatcaactcaaaactgagagacattgcaccacttcattctgaagggcttctaatctatccggatcgatgaccttctgcgaaattgcattcatgaatgcacatagctttgttattgttgcccggacattgtctggaaggataccccttattacaactggtagcagttgtgtcatcaacacgtgacaatcatgagactttaggtttgtgaacttcttctccttcgtgcttattattcgcttgatattcgtggagtatccagatggtacctttatgctctccaagcattcaaacatactttccttctctgccttgctaagagtgtagctagctggactcaagtaatggcttcctttctcctttggttccaggtgaaggtcgccgcattgttccatatgcttcagatcattacgtgcttccagtgtatctttcgactttctgtatacacctaggaagctaagaaggtttatgcaaaggttcttagtgaggtgtatcacgtcgattgcgtggcgtacgtccaagaattcccaatatggtaactcccaaaatatagagttctttttccacatcgccgcgtgaccatcttcgctctatataggctggcttccaggcccctttccgaacactactttaagatctttaaccatagcaaacactgttttcccgctgcgatgtttaggcttcgtacggtggtcggccttatgttcgaagtgcttgcctctctttcgtaccgggtggtttgctgcaaggaatcgacgatgacccatgtatacaaccttcctacagtgcttaagatacgtactttctgtttcatccatacagtgagtgcaagccttgtaccccttgttggactgtccggataggttactaagtgcaggccaatcgttgatggttacgaacagcagcgctcgtaggttaaactcctcatgtttgtcctcgtcccacacggggacacctaccttcttccacaactgtttaagatcttcgaccagtggtcttaggtacacatcgatgtcgttaccaggttgcttggggccttgaataataatcggcatcattatgtacttcctcttcatgcatagccaggggggaggttgtagatgcacatcgtaacgggccaagtgctatggccgctgctcatctctccgaaaggattcatgccatccgtactcaaaccaaaccgtatgtttcgtacgtcctttccaaattctttaaattttctgtcgatgtttcgccactgcgaaccatcggcggggtgtctcagcatcccttcctgttgacgctcttcagcgtgccatcgcaacattctagcattccccttattcctgaacaaacgccttagccatggtattatagggaaataccacatcaccttagcaggaattctcttctttgttagctgcccgtcaacttctcctggatcgtctcgtctaatcttgtatcgtagtgctttgcaaacagggcatgcttctaggttctcatactcctcaccgcgatataggatataatcgttcggacatgcatgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaagaactccagagtggtatccaactttttgtgcccctactcgcaacctgggtacaacgaagttctgtggtcctccaacatcttgtccatttataggcctccttttcactttcgcaatcctccctggcatcctgcaacatctgaccaagatcatccgcaacgtcgtaccatcagcagctgtttcctcctcgcccgtttgattttcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattctcacaattattgcatggacaacaaataaaacccctttgcctgttagcttcggccactctcaaaaaatagtgcacgccgtcaataaactcttttggaccgccggtcagcgtacatccattgccgatccatctacatgagtcaaaaaaaaccgtacacaaataattattcttacaataatgacagtcatacaataattataagatatctttattcatacaaaaataataaaatattacaccaaataattcttaaaaactatgtgtaaagttttaaactaattttaatgtgttttacttcttttaattttcattttagtttgttttctattatttaagattaactttcactagagttttccttctcaactattttataaaacc

SEQ ID NO: 58539 - DNA, 763 bp, Oryza sativa
tgttgaactcatgcaaatactccatcacggagcggttgccttgcttcaactctcggaactccctcttcttaagagccacgactccagcgggcacatgggtcctccggaaagcggcggtgaagcgagcccaagtgataggttgcccctctggctgcgtagcttggaagtggtcccaccatagagatgcgggcccttgcagctggtgggcggcgaagatgactttctcctcatcgctgcactgcaccgtgtctagctttttcccaaggcatgcaaccaatccaacgcatccacggggttgttggagctagagaaggtgggtgggcggatgcggaggaactcggcgagtttagagtgttgtggaggtggtggtggagcattatgtggtggcggattttggaggtggtggaggaaagcagtcatcatattggcctgctgggcgaggatttgggtgagaatggcgttggtatctggtggtggtggcgaaggcgcaggagaaggtgaaggtgggttgccttggtggttgtggttgctgccttcgggttggttgccttcaccggtaacagcatttctcctggtcgtcaccatctgaaaaccccacacggaaccagcaaacagagagagctaacaattaaaactaaccacccacgactactataattcttgaatttattactgctattaaattggttcattaaagttcaagttgcttaagcaaataaaataaagacaggctccgacacagttatgccacacaccggcataa

SEQ ID NO: 58540 - DNA, 834 bp, Oryza sativa
atagatctccatgtttctgctctgatagcctctctgatctcgatcttcagttagccaagccccctgccctgcatcatgatttatcgactactgagatatactatactatactatactatacatgtgtatgagagattcaaacatgcatgacagacacaatctatcgatgtatgcagtacacacaaatcaaacaagcagatgatcgatatatttttagataatgaaaatgatttacatctacggcctcggcacacaaccaacgagttttagcacctaaagaaatcaagccataaggtgatgagacaaattaaacccccaactcggtctagacaagttcaactcaaaaaaaggttataaaatcacatcacttttgttcgcacagcactggatgcatggatgaattgaaatgaacatggcagatgattaactttggttgatttggagtatgtatggatcgccccctcgcactggagcacacacgcgccggacgaaacgaacgaacggaaaatctatcgatcgagtagttggtggcctggcctcaactaggatcagctagcaatgcaagccggagaacgcgtatgcaggatcatctacgatcgagtgcggaggaaattaatttaccttagtcactcactgtaagtatgtgtagtggttgaagagcgcagcgccggccggtcgccgtcaagggtttcgagcggccgccggcttcttcttcgttctctgctgttcaaatctgctgttcaaatctgcggcgacgggaatgagattagctaactcaattccagcgcgcgtgcgaggacggcgagctcgccgaggaaacttacctgaatctca

SEQ ID NO: 58541 - DNA, 19778 bp, Oryza sativa
cctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtacttgaaggtatggcatgctgacaactactggaccccacaaccctttttcccccatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtccacaagctttcctgcttctgcttgtatggtttgcttttgattgtaacgattttggagcaaatagagcactgaccatcgtgtacagtactgagatccgcggaacgaaccaatgaggcgcgcatcggcaatggacctctcgccctcttcaacaccatcgccgccgtcaaggtactgcaatatccacgatccaacaggatggcagtgagttgggcttgctggatgggatcatgtgaagcttcccccacacatgtttttcctacatctctattcattgcaaaaaaaaaaaaagtgggctaccttggcattgaattagcaattactagatgttattatgagaatcagagagcgagaaatgaaattatccttagcaatattgccagttgactgacaattctaattgtgaatgaaggaagtaataactgaggcgtacgtgctgccatgtatatgaatattcatgtagtacatttccatttagtttatattttttgaaattttgatatactgcatttggaaccaagcttcttgttttatttaacaaagagattcaagaacagtttctgttttatttttgacataacactcagtaatattttgaagaacagttatatcactgtcgttatgaattggaccttatcaaagtaacaacaatactcggttatttgcctcggtataagtgagccgtaacactgttgaatctttcctagttcagtagatttctctcagttcctgtaaaacttttgattgaatactctggtgatgttcactgggcaaagagctaacttccccataacctaccttggaatgcccctcacgatccacagactcagaaaggtccacgtgcagtacctcctagacaggattaaggcaaggctcgcttgatggaagaaaaaattactctcagcagggggagaagagaattagtcatagcagtcttaagttcaatgccgatctatatcatcacagcgctcaagatccacaagcagctcatccaagaaattgacaaagctaggagaaaatttctttgggacagaggcgatgagatccatggaggcaaaggcaaggtgaactagaaaagggtctgcaggccaatcaagtatggtggacttggaatacctgatttgcaaaaaaaacaggacacgcaccctggctgcgatgtctatggtacgagcggaccagcccgaacaaaccatggataggcacgcccacaccctagatgaacaagataaggagctctttgctgcctccaccgaggtcctcgtgggggacggccgaaaggcactcttttgggaatcaacctagacctcgagcaccccccccctaagaacaattgcctcaaatctatacaagcactcaagaaggaagaagcgaatagtggcagaggccctaggaggagataaatggatggatgatatcagacacaacctgaccacaacactcgtcactgaattcttcaaagtgtttgaatgtctgtggaccacaaacaccatactaactcaagggactgaagacaacatccgctggaagtggacagaatcaggggaatactctgccaaatcggcataccagatgcaattcctcgacggagttccctcgatcacgacaaatgtggtgtagaaatgttgggcaccaactgcaaaatgcaagtccttcacatggctgctccttcaaaacaggatccggacgacagataggctccaacaaagagaatagcccaatgaatatttttgtcaactttgcttgagaaaccttgaaacggtgcaacaccttttcaacgaatgcccgatgaccaggaaaatctgggatgtggtggcaacgcggatgacctcccacagctgaaaaccgcaaaactggttcgacacgtcatccctcgaggaatggtggtgccagagtgtcaaggctgcaacaaaggagaaaagaggggggggcatcaattagatcctcatctcctaggaaatatggagagagcggaatagtcgcgtcttcagaaaagaagaactgtcgctgcaacaaataattgaacggatcacggatgagatctggttatggccggcagctggtgcaaagggcatcaagtgtctgatcccaaacacccaagacgctatcagtagcctgtaacaaaacatatgtaattttaggcatgctaggcatcccgtggtcgcccttccctcctccctcctctttttctttccttccttcttttaatgtaaccttctagcccttggctattgtacagtttttccccctaccttaatacaaaatacaagtacaccccgacggggtttaaaaaaaataccctggtgatggtagtaagattatgccctttctattttggattgagatgaacatatgcttgatcatgttcacttcaatcaaaacaggtgaaatgtgtgggatattgtgtgagaaacaactttgaatgtgtacataacttagctttccttgaatttaactttattgagttttactatggtgctcaaatctcttttttcatgccatcagtggttgtggacatatattatgattaaatatgtattgaagtgattacacataattgtgatattaaataaactttttcaaacaaaaatatgatatgttttacttttccttaaatatatttcatattatcatatatgacccaaatcaagtaaagctcatttggactgattagagaaaaattaatttgactaacatgcaaattaatagtataatttattagccaaaatattattgtgtgtagtgttagcacagtatattaatagtcacaatgtaaaatgtgacgacgctagcatagttttaattttgtacgaatttgaatatcatgtacatgaatagatgaataataatgacgctatataaatgacatatttgtaattgcatggattaaatgacatatggaccatccctattttttaatcacccaggtagacatccacacatttattcagtggcggagctagaaccaaattgagggtggtgcactgcttcactatatagatggtggcaattactctaaataatggtttttgaccatttatagatatctattgacaccaaatcattgagtagcaagtaaaagtgtttacagaaatttaagatgaaagaaaccacgaatggaaacataaagaaagatatacatcctcgacattaaagttgtcaatgtcaatatcatcgatagttcatagcctacaataataccagaacataagttagaaacatcttaattttgaactaaaaatttatatccaatgaacatgtaaaaaacataaaaataaatatgtttagggtttagggtttatgttccaatgaacacaaaaagatattgggactatcgggcgctttcctcttgagatacttgtccataacatgtcaattaaataattttattatgttagactatacgtgcactgtacaatagaacaatgtacgcttcaaaagcaatgatagtttgataatagcatagtgtcacagtgtgcttacaattttactagtgatggtcccttcaagagagatgatcaattaaaactgaaacatccagttcttcaaactttaaacggtttaaacactagcttatataaatctggacaattgaaaaggcagtatatgtcaacaggttacaaatctaactaatcaacaagttacaagagaggaggataaattcaaagtttagaactaatcaagagaattagagaatgaataatgataaataccttcatcaatttcaatttggctgtgctgctgtgcattgctcggctgccctagtgccctgctttgcagtccagctgctactgcctgctgcgagcctccgctgctccctgtctccctgttgtctgtcgatgcacgcagccacgcagccactgcgatggcgcgatgcacattcacccgccactacctgcggcgctgctgcctgtcgatggtgcagctggctagagagactaggtgggcgacggcgatgctgcctgctagtgcggcggaatacggatgacgaacagacggggtatcgtggagacgcggaatcgcggtgggaaaaagaaaggaaaaatataaaagaaaaacgggagacgaggagttcagaggtgcggtgatcgagcgagcctcgcgggtcgcggcgcgtcgctcctgggtgcgtgaggtgcgccgtgcgcctcccagctttcctcatgggcctaaggccttcacttgttcgctcatgggccatgggtggtgcacgatcttgagctaagaggttagtccacttagactcccttaaatgtcggccgaatctaaatcgtaacccttaaccaaccggataaaatgactctccgacctattgaaaccggtgcaatttgactccctgggtggttttgcaagcggttttggctgacgtggcgcctacgtgacggtgttgacccggtcttcgtcccacatgtcgtcgacgtgtcgcttacgtggaattagagtaaaaataaaaaaacaaaattctgtaggccccacatgtcattcacacaaaaaaagtgggacgctcgtcggcaccaccatctcctcctcgtcgtcgtcgagcaacacctccgaactccggccaaggagagctcttccagagcaagagtcgacgacgacaccatgcgcgtgctccatcgccgcctccattggtgacgatgtcctgctgcttcatcgccgcctccagcgcccacgccgtcgggccgctgcggggagtcttggcggcatagccagcggacgaaggaggcggcctcgcgagcgcggcagcgcaagaggaggtggccaccgccgctctagcgcccacccccctgcccgtcgcagttgccgccacgcccgacccctctcttcctcttgcagactcgcacgcaacaccggccccggaaggtaaagagaggggggccactgccgccgtcatcaccaccactccgcccggccttcgccaccaccgccgctagcactggatctggaagttgcggggctacggcggcgcaacgggacgaggaagctgcggcggcgaggggcggcgcgagaggacgtggccaccgccgctctagcgcccacccccctgcccgtcgccgccgctgccacgcccaacccctcttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaagaaggggaggggaggaaggatgacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgccatggacgtggagtacgacgtgatcgtgctcgggacggggctcaaggagtgcatcctcagcggcctcctctccgtcgatcgcctcaaggtggtctccttctccatctctctctctctctctctctctctctctctctctctctctctctctctcccgcccggatcgatctagctagggcatcgcgtcatggatggaggattaatttccatttctaattgcttgatcaatcgatcccctcccgtttctggctaaccaatcaaataccctttcgtcctttgtgatgccatttttggatttttttttaccgggtaaaattattcgaagaaacgacagatctgatcgtgaatcgctttgtgatctgattaacaatcacaaattcacaaataatgatgtgaaacaaaccagcaattttttttatgttttttgcgagtgatcttgaatttgtcattattttgtcagcgaaaaaaaaaattctcatcagaaaatgatgaaaaacgtgtcccatttctgttttgtcaccaggtgctgcatatggacaggaatgattactacggtggagactccacatcgctcaacctgaatcaggtgacaaggcttcaccctccgtagcaaaaatttgccaacattatcttacctacctgtctgccaacttctgttttcctgacgtgctaagggatgttagaaatttcctcatcaatattagtttcagacaaatttgtgtgaggttggttacctatcagatgaaattatctgatcaagctcattgtttatgtatgccagctatggaaaaggttcaaaggtgaaggtactcccccggcgcaaattggggctagcagagactacaatgtagacatgattccaaaggtcaggcccggctccaatttatatttgattatattctggagtttgtgtgtagtttgttgggcttagatggcactgctctactttattatggagagtggagacatacacaaaaacttattggaacttgggttttaagtgtcgcacagttaaatattcttcgcatgcgcatatgcaaatatttataggaaattctttttagattgtgtgatgattaatttcaccctacttcctttctagttactgacatattgtgaaatgctattttgtctagtttatgatggcaaatggtacattggtccgtgtacttatccacactggtgttaccaagtacttatcattcaaagctgttgatggaagctatgtcttcaataagggaaaggttggattctaattctaatgcgtgtagatcactccataactcaattggcaaatctataatacaattttgtacatgatatttggatcacagatccacaaggttccctctactgatatggaagctctcaagtctccattgatgggattgttcgagaagcgcagagcagggaagttcttcctttttgtccaagattacaaggaaaatgatccaagtacccacaagggatatgaccttaacaaaatgaccaccaaggagcttatctcgtgagtacccatgtttactgctgcttttctacctttttttttatttcacgaagaataagtgcttaattttattttcagatgtaagtagttgatttggtttgtttgtgaaatttatatttgggtcccatatggttcctgtatgtactcagtcgtatcttcagtgtacatttataccacctaaatgatccatgcacaaaggaattgtatggttttatttgtttatatacatatataataccttagaatcaacaaaagtcctgtcaaaaaaaaaagaatcaatgaggggcctcaattgcttttttatatgctctgttcaataaatctgcaacatggtacagtactacagtggtactcacatacggatacattcaggccaacacatacagatacatcaatttaattcctaaattttcataatgtacatccacatggatcaaaaatagctccccttcattgaaatatataaaaacaattatgccagttccgcagctgcacttattttatcatcacagagccatccttatacggtacacttcttcagttcatttatagataagcataagaattaggtgaattttattcattagcgatgaattgacacatcaaacttattcatacaatctgatttatgtttcatatatattttctgatattttggtctatcatactatttgaagaacctgaagttgtagtgcctcttaatgattcaatttattgagacttctctgctcccctttatttttttccagaaaatatggtttggatgataatacaatagactttattggccatgcagtggctcttcataaagaggataactacctgacagaacctgcaattgacactgtaaagcggatgaaggcaagtattgagtctttcaacttcaaaatattagaaaagaagctcggatcaaactagtcctgacagtctgatgaaattccacatcacactttggcgtacatacatcgaatagaacatcagctgggttatctgtggacaaaactaaagccattttagtcacaatatattgctggaaatcacaactatgaacatgacgtgtctctgtcaaccaactaaaccacttcttccaacccgttcgaaactagacattttactgctgttcccatgctatagttagcatatatggtcacttcactttcactcccagatattgccttttacctaacacttctttgaattattgcagctttatgcagaatcagtgggtcgttttcaaggaggatcaccatatatttatcccttgtatggcttaggagagctgccacaggtcattactattaaactgtgtcatcaattccagcaatcacagagatcataaatggttgattttctaacttgtttttatttgatccagggttttgcaaggcttagtgctgtctatggtgggacatacatgttaaataagccagagtgcaaggtataatttgtgttgttattgtgagttgaaccttccaaataatttctttggtgatttgggcatggtgatcacaatgtgaaatgaaaattttaggattttaaggtgcaaaagcaagaaaaaaaatttgaggggggagggcaggagatctgccaatttcattaaggaggatagaaatgatacaagttcgcctctcaaaggttccatagaagaaaaaattaggaatatgatgattattgctttgaaaaggaagaatagatcaagctgtcagagtttgacaaaatatattatgttaacataatccaggcttggatttcaccagttgtatgcatggtagatgctagtgctaatgaattgtggcatgacaatctaaaaattgttctagaagctgtaatgttaaatccatttcagtggtaaatatgtgattttctgatcaaacatacatgggcatattcagatagaatttaatgatgaaggaaaagtttgtggtgttacgtcagaaggggagactgcaaaatgtaagaaggttgtctgtgatccatcatacatacctgataaggtaaaacacttttttttcatacaaacaaatagttgccctcaaagggagtatatcttagtgattaccttcctaattagttaattatactgtacttttcttaagattatttgaaggagacctactatgtctgataaataaattgtcctttgttgcattaaatttatttattacttattcagaatcaaatagaagtatgatgcaatttagtgtctctcatgttagcctcctcagctcttctgtaaatataagtcatcctagaacattgaagtacttctatacagtatctttttcacttttgtcctatatatataaatgatactgttctcatggataaatgacttatcttttgcattctgaataacaatcaagggtgagttatttagttaatttctaagtcccagttctgtttttcaactccaaacttcaatttcctcgttttccgttagcacgcttttcaaactgttaaatggtgtgtttttgacaaaaagtttttacatataagttatttaaaaaaacaaataaatctatttttaaaatttataataattaatacttaataaatcatgtgtggatgatgtttctcgttttgcgtgcaaccaaaatctgtctacaaaaccccacattgaacggggccttagttcctattcacaagtccaaaacaacttatgcttaggattagaggacgtagaagtttacaaaatgttggtactgattagaattatctgctgttatatcaggttagaaaagttggaaaagtttttcgggcaatcgctatcatgagccatccaatcccaaatactgcagattctcactctgtacagatcataataccacaaaagcaacttggacgcaaatcagacatgcaagtattctgtatatcacctctggtttttatccattactgggcattacacctatagattactcttggtctacttgtcatttctattattgtaacaaaagaatgttcactggtgcatgccaggtatgttttctgttgttcctactctcacaatgttgcatcaaaagggaagttcatcgcgttcgtgtcagcacaagcagagagtgaaaatccagcggcggaattgaaaccagggatagaccttcttgggccagtggatgaactatttattgatacatacgacagatttgaacctactaatgacccatcttcagacaattgtttcatctcaacagtaagtcatcgcagaaatatcaagtgtatgtaggttagacatatgaccaaaaaactgcatttgaaataaacatttaattcgatttgcttttcagagttatgatgccacaacacactttgagtctactgtgatggatgttctttccatctatacaaagatcaccggaaaggtacatttgttttctgttcaacttttaatggctgcactagagtacaaccccaaccttctgaattgaaccttaccagcactaattgaaccttaccagcactatgagttcaacattgtttgcacttgtgctattctaatcttgtattccacgtggcaactataatcaatctattctatcatgagaaggaaatgggcttttcaattccacagatacagtgctttataaaaaggcagctagttgagtagcaaccttgtaagaatatcagtatataactcttagcatcatattcagactgtatcaatcagagtaacttacattccaggatcgcaaagtgataattgaactaatattgcatttttcatgatcttgtatcaacctaaaaaaacgtgtgtttaatgttttaaatttcctttgtctcgatagtgatttcctagttgcttatgctaatcgacatgccattttatccagacggttgatctcagtgtggatttaagtgctgcgagtgctgctgaagatgatctctaatagttattggactgtcctttggtgcacagaggaaaagatttgtgcgttgtttttccattcatattaggtttatatatgattttttttcttttattccaaactatagtggctgagttttattaataatttgataatgctgtatattctaggttcatagcaatttagcctgtgagtaaacagctgtttttgttgttcagtttacttaatttcacctttaaatgttgtggatagtgctaatgaacaccgaactggtacctccaattattttgaagaataccttgtaagatttctataaaatatctttgcaaaacatgttttgagatgcaaattgtcacgtaagagctatgagatacgcgaccatggcatcaattgatcattactatttgtgtcatgcatgtgctcaactgctcaggaaaatcataattactcattccatattgtgaaatatcaggaatttagcatgtgcggtataaattgcgacttgatttccaaaaaaaaaaaaaaatagggcttcagctgaatccccataccccttgtttggtcctcctcagtacgtactgatgagctttatttacagtttactatcttgctttttctccattccatttatctaacatcaggctacatttttatttttgaaatttcatattttcagcgtagttgcaatagagaaactggggttcagctgaaccccatacggtcataccccattattttttttatttatcgtcgacatgactatggtctgatgtccaatctaagccgatttattgaaaggtcaaatgttcactgaggctgtgctcctacgtggagcgttgcttcgttgcgctagcgggaagattcattgacacgtcggcaccatgtgcgtcccaactgagccgctcgggccttcgatgggggacgagttcctcgctcgcgctcaaggacgtgcggcgaagaaacgaggatgcgctaggcagaaataacttggccatccgtattgtagaggtcctgccctggcatcatgtttccatcacatcgtgcgtcagactatgcagaggaggtcacatgcactgtgaagtgcatggcatacggatgcttttggtttgatttcattgcacataccagctagagacacgcgatgcatagtttgcactgctactgccctaagagcaccacgcaacaaaggtgaaacatactggaaacagtaagatacaaatatagtgaagatatgttccaccaaatgtgatataaaaaaatatcgtgcgacttaaaaaaacgtaaaatatctcaaaagcaattggtgatgagcatcgatgtcgtcactacataccacattattgtgattgtgctggtcaaatcatttccattatggtggttttgcaattgtgttgtggtcttcatggaatacatcatcgtcaacacgaacatgaacataggtcgttgcattaccaaaggtcgttacatcacccttgttatttagccttagttgtgtgattactcttcaccatcgtgaatgctacctagcaacatgctctagtcttatatgacttataacaagagagcagttcttttctccaacaaaaactaggtaaacttttagataaaagtggcacgctttttaaactgctaaacggtgtgtttcgtatgaaaactttctatatgaaaattattctaaaatatgatatatatatatatatatatatatatatatccatttttcaagtttgtaataattaaaactcaattaattacacgttattaccaccttttttgcgtgaaacacttacaaacaccacctaaaggtgtgttggagaatactacctccgtttcaggttataagactttctagcattgcccatatttatatagatgttatatgtctagattcattaatatctatatgaatgtgggtaatagtagaaagtcttataatatgaaaaggaggaagtagcagtaatgggcatggaggattgcgctctagtttgtcttcgtcgagaagaaatatcacttcagcgaggaagtgagtgtgaacataacttttgttcgactcaactaaaaattgtctgatcggcttaagtaaaagtaaaaaacacttggttaaagatagcaaatatattattatattctgacatgtttaacttataggtctatctttatcttgcgacttatacattatgatactatctccgtcccataatataaggatttttagaatagtgctaaatcaaacattttttttaactttgactattactagtgaaaacataaaaaaatcaatcatataaaattgataaaattgatgttactagatttatcattgaacaaactagattccgtaattctatttcaaaaaagagtgagactcaatctccttatgccatcccaaaattgatgctactagatttatcattgaacaaactatcataatatgcaactctttttatttaaaacatctcacttttatatatattgttagttaaagtatacctcgaaaatcgtttcaaaatttaaaaatacttatattttgagacgaactaagtacatttcaaatttttacgatcacccggaagatttccctactccaaaatcttacaaaattttaaccatcagattggaatccaacgtcccacatccatccgccgccactcgtctcgtccgtctctctctctctctctacgaaccacgcagctcgactcgcgagctctcgccgccgccgccgcctcttcccccaccgcacgcgcttccactccgccgccgccgccgccgccgccgaggctccagcactgccgttctccgcctccagttcttccctcccccgtcatcttcgtcgtctcgggtgtccggtgccaccgcgccgccctcctgctccatctccggcggctcctgctgcccgccgcctccaccgactaccccctcctccgccctcccgatctccgttccccgcgccaccgcccaccgcggggcctccgccgccccggccgcttccgtctaaccctggatccccaccacgaaacctaactagtaagcgccggagccgccgcctcctccgcctaagttcgctacactcgctggagatggagaatgttactggagaaggaatctcggatcagatagagaggttagcgattattaagattttgccaccattttttttcagtcgaatgttgtgtagcaaaccgattgattttcctcttttttctttcagatttcaaacacagctacaaatggatgggcgagggagaaagcacaggattttgatggtgtcagatttcttctttccaaactttggcggcgtggaaagccacatctattatctgtcgcagtgtctccttaagcttggccataaggtccctaatctcctgaatggtctatttactgccttgttcttttcatgcataattttagggactatattagggtctagatcaactcatggatatgcttttgattctgccccagctcacttgttatatgtagtttaaatattggatttaatatctttctgctataatgagttgatgccaataatggttagaggatttttgttacatatcttatccaatcgttaaatgataggcagagccacacaacggactaaattagtgctactgattttgttgcgaatgtttagacaacttttttgtttgattcccaggtgattgtcatgacgcatgcatatgggaatcgttctggagtacgatatgttacaggtggcttgaaggtttattatgttccatggaagccattcctgatgcagaatacattgcctacattattcttgacatttccgattgtgaggaccattcttattcgtgagaagatctctgtggtgcatggacatcaggctttctcaacattgtgccatgaagcactgatgcatgctaggacgatggggtacaaagttgtcttcacagatcactcgctttacggttttgctgatgctggaagcattcacatgaataaggtgctgcagtttactcttgcagatattgatcaggccatatgtgtctctcacacaagcaaagagaatactgtcttgagatcagggatatctccagagaaggttttcatggttcctaatgcagttgatactgcaatgtttactccctctccagatcgcttgagctgtgatgaaattgttattgttgtgataagtagattagtgtatcgaaagggtgcagaccttcttgtggaagttattccagaagtatgccgtctttttcctaaggtgagtcacaaccatagcactctttggagtcatgcatgaaataaaaagggtgaactatgggtatggtagaatcatttcgttatatgacatatcaacataaagcaaaatgcatacacaatagttgaactctccttatattccatcataactttcccatcctttttaatgttcacaatgttttggatttagtaaatggtcatatttgatcaagtaagcaactgtacgaactgtcaggttcgctttattgttggaggtgatggtccaaaacgtgtgcgaattgaagaaatgagggagaagttttcccttcaggatagagttgagatgttaggagctgtgcctcatgctcaagtgcgatctgttctgatatctggtcatatttttttgaacaggtagctatttaatattttcattgctttatgttgaaacttttttatttccttagttcctttttttcatcagggattgttgatacacgtaagactgctttctgtctatccctttaaattaaatatcatctttcataatacataatgttaactagaccctaatatcattacaaacatagaagaggacatatccggtgaaaatgagctaagtgttgaaaactcgtgaaaatcatacctaaaagtttcgtaaatttatgaaaaaaatactagagat

SEQ ID NO: 58542 - DNA, 626 bp, Oryza sativa
tacaacttttgcaacttgaaccacattaaactgagttacaatgaattagttatgaatttttaaagattaaaccggattaaagcatttatatagattttaattgaattatgacgcaataatgaattatttttgaaaagcaaaagggatttattgcgtcatcaaagatggtccacggtagaccgggtgcatagaggcggtctacgaaaccaacggccgagatctaatctaaacaaaatggacggccaagatcgatctaatccaccacgggtctacggctgacgtcgacgatgacgtcatcgccggtggcggctcggcacctcgtgctcgccggcaatcgatggcgcggcgacgcaaacggagggcaccaacgggtagagggcgacgcggcgaactcaccgagctcttggatgacggcaaacgacgacggatgacgacggcggcgaggtcgaagcggcggcgatgattgggtcaacgacgacggcggtgttccagcgatcttcggcggaaacggaggggtggacgaggtgctgctcctcctcgcgatcccgacggtggcgacgacgaccgaaggtggtggctggaccaacggcgcggcgtggctggaccaacggcagcggtggagagct

SEQ ID NO: 58543 - DNA, 21240 bp, Oryza sativa
ttgagtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccattttagttcgcttacagaggccttttgtatagccattttggaagcagcaagttgtggattgttgacagtaagtactagagtcggtggtgttccagaggtatgtgcatatatgtttatacatttctcttgtagaaaaccctgtactgtagttaattaggaaatttggagttgctgtcaaataactttttcctttttcaggttttaccagatgatatggtagtacttgcagaaccagctcctgaagatatggtacgagctgtcaggaaggctatcgatatgcttcctggcatagatccccaagttatgcatcttcgagtgagtctcaactcttgcatgttgcatgaacttgctgtgcatctgcagtttaccgtttcagctatgggctctgtgcattacatttcctttttttttctttagtttttagtggaaaagtgatttgcaagttcatttatattgatttggttgtttctaatatgtatctagatgaaaaagctttatagttgggacgatgtggcgaaaagaacagagattgtgtatgatcgtgcaatgcagtcaccacaaacagatttgctagaacgccttccacggtgagtatattgcttttgaaacattaacctatttttgtttacaatttttatgcactggggcatcaaatatatagggatgcagtccatctgatttttctacaatggtgtagatacctcagatgtggagcttgggcaggcaaactgttttgtcttgttatgatcatcaactacctactatggtgcctcctagaatatctgcaggtgaatttctgcccatacttttatcatcttctggagatctggaggaaatctaactagttcttttcccctcagcccactgaaggtattgaagaggtcccagatatcaggccagtacatgctcgtttagaatcagtagatgatacatgtgaaactcaaggaaaaggaatttagaatttgccattatcgaatcattgaccagcaccctttcctggtctgtagaatttaccttctctttttaattttacttgccctgaagcccaggaaacattttcgacagtagagtacccatgacctagtcaccccacatttggggaaatcctttgacatgcttttgaaagctatgttgtttgtaaatatcagtggtaacaccactattttgttatgtaagtggatgatccatgctcttgaaaactatgctgttaacgatcaatcgacaacatcctttggatttggaatacatgtactaatatttgttctttgtatgacgccaaaagcaccaaaaaaacaatttggagcgacctcaaaaaacttatcattaagaaagtcccattttgtagacactatgcataatgtcattaggaaaaaattctccagctttgatgaaggctgattgtctaagcacccaattctatgataatcaagattgtaccaacttcaatgatccttccctacgcctgccaattcgaagggaaacgaaccaaacagggtgttcaaaggcaggcaaatgaccggttggaagtgaacaattcctcagtctatatgccccagctagaacggaacaagctataataatcagattccaattccagtggaaaccatccaatgatcattttaaaccagagagtttgatcaaatgttgctgcaaaacattaagaaaattactgcttttggtggacgtagcggttacaaacagattgtttgtgacgttggaactgttaagatctgtgtaacgcaaaacacccgcttgcctaagagccaaattggatggcttatccgtcgatggataagttgatacaaacaaccctaaacaactgcctcaggccagagtgagcatcttcctgtaaagtgcttgctgcaaaataatgttacacttatcttgcaatttgaacgctaaacctaatagtttgccaacatataaatataatgttctatgccacaactcatcttgatttctcagcaactaagtctaagccaatctcaggtacaaccaaaactgacagcacagcaccccgtggcatatgcaattgaagccagtgctcgcacaactcacattcgcgtccttcgtctgatacccatgtcatcatctcgttccacctgttccatacaaaaaaaggagtgtaaataaagcacgtagtatgcccacttatcactaccaattagttttaacataatggaataacaaaatctcaagggctgatgctactatcaatagtagaggcaggtctaacgcaggagacaatatgtataatgtcctcaagaaacagtattgagattgtggtggttgctagctctttacctcagtgataagcttcttggattttttccctatatttgatctcaaatcagaacctcgccctttaggtttctttgctaccggttcatccaaaagatcatcttcatccgtctcacctgcaatcatattttagattctttttcttagtgaaggtcaaattggaaatgacaggctattaaccattttggctggtaaaaatccaacagatgtaacatattagcttgccaaggcatatcaaaatttccttcacatcatcacagtactctgaaatatgttgaagttgaatcggaacaaagggaagtaattaccatcattatcatcatcttcatcatcatcaggaaggcctccaaaatcttcaatgtcttccatgtcatccatttcatcatcaccttcaacatactccacctcttcctgtgttaacaagtgaatccatgataaatggatagttcatgcaaggtgagatgagcaagtctgcactcagtaacaatgcttacttcttcctcttcctcagtaggagctacatcatctttttccatttcaagaatagtgtcaaattctttgaagggatagttatagatgtcaccatagacacctttcttcaaccgttccttcaattcactttcaatattctgcatgacaacaggtacatgttcaataaggcaaaccatcaaagggcgtggatagcatcagaaataataaccttttccaactgagcggccttttcagctttatccattcttctgagatggcgctgagtctccttcctgggcattgtcatcaccttctctctgataaggggagaggaatatgattaatctttccattgcatcagagagaacagcagaaagttcacaaaaagagtatacatcaacaagcaaatcagattataatgaaactattacactaaattataccaccaaagtagaaacttgtgagatattgctaccattattattttttccattagttttaaaaagttctgcaacaatgtgaacacagtgcatctaatacaatcttaagaccatagaacaagtcaacaaaatgtgcaacttcaaaattctgtaattgaatataaccaaacactgagccagttcttattcttaaatcctagtacacaatttggcactgacagtagcgctggttgtggcagtatgaaatacatagaatgcctataagacaatcaaccaaaatcggatccccacccccatctaaaagcaaacctataaatcaatagagttcaatctacagaaatctgttactttatactactatgtttcttttttaatgacaccctacaatccgcatcttcaacctttcaaaagttttactgctaatatatttggaactactgaaaatcacatcattaaatttgtaattaggaatactttcataataatataattttattattatacttaatgcaaaagtataaaaataaatggtcaaagtcacatcttgaagacagaaaagtaaaacaacaaacaagtaaaaaggaacaatgccctttgcaaccaaaacatgctaaacaggtaagtacttcagcaaccatcttcccacatggcatgtatctcagaacagttgtcccagatttaagattttcaacctgatgagttcagcactctaatagaattttatcgtgttcagcttaagaccataatgaaaacactatggaaataaacctaagagcctacctcactttcagttgaagcttcctcattcttatccgatactgagtcatttttgtcaggcgctgcttaattttgtgcacaagtaacttgggccaaaattcctacataatgaaagaaagacaagctatgagacttaaaataaaagttcacatccagatcgaatgacaaagctcgaagtgcatacaagatgcttattgatgacttccattgctttctcataatttctgggtagtttgaccctctcccataatttgttcggaagatgggctctttcagctgttttcatgtataggtagaaaatacctgcaaggccagaaaaaagagagagaaatgaaacagaatgtaacaaaaaaaatattaagatggtatacataagttgggaaagaaccgggagcaaaacaatgtgcttaacaagtatgcttagactgcaatctgtatccttggacgaaaggattctgaagccctcatgtttcatccagagagcaccacataatacagcgattcactcgtaaaaatgtaactttctgcagtaccgagttcttgactttaaaattaactaatgaaataagcttccatggtagaccgcattatcttaaaacagtcattggttgtgtttgaactgagggtttatcccatccatagactcacaatatcatcttgatggcagttaataataacgatcacagtcacgactaaataatttccctcgaataaagaccaatcgtctcccaataacaactgtaaatgtaacccaatgtttccaatagcaactgtaaacataacccaatgcttcctaaagctattgccacaaagggcgacacagtgcatcatcgaaacggttgagctaaaaagatatttcgccccgaaaaatggaggaaagtgcggggtagtagtactcaccgtcatggtcccggatggtggcgtagcggctgttggcgagagggcaggagctccggttgcatattccggtggcgttgtacgggttccggcagaatatccccgtcgtgatcctgccgcaaaaccaaaaccaatttatcgtcagaaatcaaagaacaccacagcgacgagagaaagaagataggattgctgctcgcatacgtacttggccatgaagctccagtggttgtgccggatgcagtgccatatcacgtcgtcgctcatcttggccgccgccgccgccgcgggctcccctccttcctaagatgctgctattggtactagaggctggttaggcgagagagaaaagcttccagatctacaagggaggagtgagcaagaggatgggcgtgggtacgggtggtcacctcaccggcggctggcggcgcggcgcgggatgcagtgggaaggcggcgcggcgcggcgggcgaacgagacggggagtcgagggcgcggccgaggagaaggggacatgacatcatcatcatcggctagggcaaattaatactgacaggtaatgggctttggcccactcaaggcccatttattcttagagcggcccaaatccaaccctaggccactatatgaaggaataagtccactttgaccataatctactctgtgatcatgcaccacaaaactagatatcttgacccctatatggtgctgacatggctaacacatgacacctgctttgcttctttctgtctcttgctcactcctccattgtactacctccgtcccaaaaaaaattgcatttctagctctaaggctttgtcccaacaaattgattcatctagataagtttccttaagttctctcagcttgtaatttaggtatgctaattatatgggttaattctctaaacttacttttaatcatttgtatatatgaaatatgtgcatgcaatgggttcattaaataaggtcattgtggtcatttttcaatcctactgttttgtcctaaattagctagaaatgtaatttttatgagacggagggagtattataataggaaaaagtacaaattaattaccccctcccgaactatcacggtcgattaaattacccccttaaaacataaaaccagacatctcaccccaactatacaaaccggacaaataaccctcctaagtactgttttgagttgttttcgacttaaacttgcacacgtggcgctaacgtggcaatccagtcagcaaataaaattaaaagaactcgtggacccagctgtcatccctctcctctccctaatccctgttctctctctctccctctcgctcactcgagtggccgacagcggaggcaaagcttaggcggcgggcggtggaggcagaggcagagagaactcgggtggccagcggtcgaggcggggtgagctcaggcggctggcggcatcacgggagggcgctctgcggtgggcgaagggtgcaccgaggaggacgttgaaggcggtggcgtccaacaccttgctgtcggcgacgggagggcttctccacactgatgtgcttcacaataactatgtgcttcagattagtcattgaccacctgatgtggttgacattgttttagtgctagaaaaggattttcttttatttttaaccttatttttaatttaaaaaaatgaaccctttcaaaacttatttctaaaatttgaaacttttcgtcacaccaatcgacatggcgtgtgaaaataatactgacactccacctgaccatctgagatggatgtgtatcaaggataggggtggatatcgagctgggtcggctcggctcgttatcctaacgagctaaagtgttggctcggctcggctcgtgtgtcagctcgagctagctcgtttagctcgtgagacagaagaaggaaaagagtagcggcatatgccatgggatggggaggaggaagagggcaaacgctcacaaacaaacagattggaaaagaaaatgaatatgatgatacatcacgagcttgcactgatcgatcactacaaagcaaatgtaattgagtggccggattaaaccagtactgcaacataaatcaggggcattccagatctaaaaatgcaaatgaggaatcaataaagacaaaaattgctataagacatcaaaagattacggtctttgctgtgagacatccaaagatcgtgaatcttttcgtggacaccgtaaaaaagtgataactagctgttggacacttctcacattattttattattttcagttaaatggagaaagaaagagttgtgtaagtaccaaaatactccagatctctcttcttttcttttcccttcttcctcgcgcttgctactgccgagcagaggtgcaacgcacgcggccaacgcggccggcccgacccgagaggtgtgacgcgcgtggccaacgcggccgggccgagccgggacggctcggccacggcggggcggcggcgcatcgccgggttcaccgccgacagcgacgacgcacctgaagctgccgaggagctcgttgatggcgagcacgatgtcgttgccatcattcgccatcacgccaatttccggcaatccattacatcctaaattttttccctacccatagaggcactgcacccaatcaattttaaaaattagacgaagatgccttgccagtccaaactcaattgggctgccgtcaagctcatcatgggcacacaaccccgacattgctttgtcctgcaatcgttggaaatcgacttcccaaagttcctagacaccccgtcgtacttactgcttggtcaaattgaagctgcgctatatttcccctttgcaacccagtctcccgcaccgacaccctagctgtgcggctctctcgtggcgccgctgacgggtggccaagctccaggcctacctcctccaaccagctgccgcatgctctgccccagccagcaactgcacatgctctccattgccgctgctgtgcacacgcatgagagagaaggtagcagcaggaagaagaacatgaacagagaaagctagatatgtgtgattgacaagtgggcctatgggtaaacttgtctttaataaatatttctctagatataataaaataataccgtaggtgtccagcagctaattaccagtgtcatctaacaaaaacgtattctttcagtgtcctctagcaaagagcacagtctttggatgtcctagcaaattttgccatcaataaaacatgcaagagataatcatcttggaagagatgtacaaatgttggtttggctggtctcattgactcgttcaccttcctagctccttcttcatcgatggtgtagatgcactggtgccgacgaagccacagaggcaagggccggcagcggggccgacaaaggtgatgccgcgagggccggcggtcggggccgactgaggcgagggcctaccaaggcgagggtgccactaccgcctacgagcaatcgacggcgcgacctcgtcggtgcgtgagaagtggagagcgagcgatgctagagtagaaaggggatcgggaattcaaagtgcgagagacaggtcatgtacgtgtctctccatctagggttagtatttttctttccttcatgggctttttcttgatgggccagcttggtcgcttcatattgctgctggccaactaggtacttgagctgttgtgcttggctcgtttggctcgcgaacagctcacgggccagcttgatctggctcgttataacaaacgagctaaaaccctggcttgggttgttaataaatccaaatgagccaagctagataagagctgagtgagtcaatgagacacgagcttttcgtccagccctaatcgatggtgttttctcttaaaccgttttgtaatttgcaaatccctgtggtggagttgttccttggtttgtctagtttattctgtaaagtttgcaactcaatccaacggttggtttaagagaaagcgtgtttttaccgaacctctatcgtgctgtttttaggctgacggtcagatcgcgagaggacctgcggtcaaaccggccaggctttggttagacctaccatagtaggtcggatagaccaccgaatgtatattccattggtttttaatgttggggtgtgttttgatctatcaagattcgattatttgactttcgctggcgtaatctaccactcacccttttctagtagacttggttacttatgtttgatcctatataagaggaccttgcttcatcttgttttgagtttgcaacataagagtgtgtggacgtacctgcactcacccaccaaatgtaatcttggtgagcagcgatctgctcatgctcgactaagaatctcatattttcgcttatgcttatacttttcaactaaaatttgatttttcaacattaaatttgaagttgattttaaggtttttttatcgaagtttatttttcagtttttttcttttaaatcgctaagaacacgtatataaaaattttatccataaattaattacttttcattagaataagcgaaatgatggggccgtttcgcttaccattgcaattttggatacttcggcaaatataagttcatcgtcactctttagttgcatccgatactactttgtaataaaaaaaaaagttgaggttaaggtagataatgttcgatatggtggaagcgcgcagaataaactagattccccgttcctctcaggcctacaattggcgggtctttcttgcagttattggcgaagccaaacgttgacatgtaaaaatgtaccctgtgtcttctgctccatatatatgtgctctagcctcccactttgctccatatatcttcagctccataatagtaagaatgtctccagttggacctttcttttagtgttcctaactcatggaattccatttctgtcattacatgtcacataatgtaattctcttatgagtaaattgaaacactgataaaagaacttggaatgtgggtgcggtttaatacagcaacttgaaaagttcctctcagttaatgaactcatgatgatcgatgacattacttggtatgtctcaaacgagaaatcccactcaataaaatattgcgagctttgcaattgttgttaaattcagttttcaaagcagcagtattaatttgatcaggaatcacataaggctgagcaaccttttgccaaacatcataatcttcagccatcatgtaagattacatcttgtcacaccaataagaaagtttcaatccatcgaaaacatgtggcttagttgtaaacttgttaaccatggctaaaactttagatcggttaaaatccaaagaagaaaacaaggctctaatacccacttgtaagatcgaacaacaagaactagcccaaccaggagggtgatcggctgtagtactaaaaaaccaaaatttttaacggaattaaaagttaccctcaattttgatgacatgcggtctaaccagagtatatgcacccatctgatcgtctagaaatctccggtctgaccgaggtagtttctccggtctaaccgccgaaacctgtcaccgccaccggtctaaccgccgtgtccccgccggtctaaccgttgcaatgccgtcggtctaaccactagtgtcccaccgcttggagtgctgaacccgagaaaacacaaatagaagatctctcaaagtagattgaaactttattacttctctatgtgtttacaaagggcaacaacatcactcgtcacgaaaattttgactaaactcgaaacgctaacttttctcttggctcaactctctctaaagcgataccaggaggccacaccctccctctctatttataccctagtagacagcctaaagctacgaagtaaacttgtacaagaagtcctaatcccctaggaaaccttcccatacaagaaacaaattttacaaactccaattgtactaaacttggactctctccaaattcgactcctcatcccatatgcacacaatatctccatcttataccatatggaatcttcaccaaccacttgcattgatctttagcctaagcatcccgcatgatatccagattgttcggatgtcatcttctcccaagttgactcccgatccatcaccggcaacgctctcccgagacatcaagaccacctacacaagcatcaaccaagaaaccatatccgagcataagttctcactaacttgtctcattgttagcaaacaacagtattacatacgcatagtattcatctcgaagtcataaacacgaattatccacggatatcgaacaaatcaacccgaaacctaaaccgacacagagtcggccggtcagaccgtgggctagccagtctgaccgctcacatagctccggattgaccggcagcacctgcccggtctgaccggtccaaataaccagcagtccctgttcatcacttgtaaaatccaatcatctctaaaaccacatcgccaataatctccaaatatctaaaccaataatctcatatgccaattgtttatcatagaataataatcaaacacacgttgatttgcataccatggccacactctttttcagatgtacgctatgactcaccttagaatagagcattttaagatcaatgattcatcataaatcatatcatttattactataaagttataacccactaatactatagctctacatgcaaacataccacctcatcatccattagtaataattacatacaaaacttatgtaagcatgaaacatcatctataattcattgaattctataaatcaacatccaatcatcttgcttcatattttttttcacaatatttttaacatatatacatccatcatttttataataattaacatatattcatccatataatcaaagcgtgggatatcatattttatctacaatcacatacatactactaaatttatttctctcctaacatatagtttgacaaaccagttttatttgttaataactaatatcatttttagttttagctcaaatattaaaaaatattaaaatttacttagtaatttccgcagcaaagcgcggagattcacctagtaggctagtactattagaagatatgcgcgcgcgcgcacaagcttctctcccttaaaaaacgctcatacaactttaagaagaaaaacatactggcattaagacttaacattgtggtagtgtaattagtaagcattcacatgaaaaatcagttgcatgacactggtaatattaaatcgcaagaaaagctgaaacacacatgcaggagcaaaacaaaaaaaaaaagagcaacaaacaggaactaagtgatcttgtaagtatcacgtcacacattttcatccccagccaaggtaaagccatcctcagagaatggagcaacaacatgttgatcaccgttgtctccgttagcataagaagtcgatggtccagcaacctgctcttcaccagaggactctctaacatggaatgtccgcaaattacctgagtgtcctctgttttggaggtctcctcttgccagcttctctgccaaggtctccatccccatgtaatgcaagagtagccaaacatagctcaggaactccacgcctgtaccgaggcccttagcatgcaagtaccctcggcatctggcagcagaaaagcaaagcatctccacccatacgccttcaatcactctccacatcttctcgtcatcttctaacttcaggagctcttcagcaatggaccaagcatcttcaatgagccctcttttactggatggtgacttatcttccccagttatctcctcgagttgttgctgcacctcggcgattattctctctgcaagttctctttcatccagtggtggattcttttccttgacgacacccttcagttcgttgtaggcgtctgtgaataggtttcgccttgtgcctggcatcaacatctcaggattgacaaacagtaggtacgtcatgtaattcgacatttctcggcactgaacagcatttttatggtgaatagatttttcgcaccaagtagggcaccgattattgaggccagaggatcgctctatgcacattgttgtggcatgttcacggccatgagatggactgatatggtagaagcacaaatccgtggcgagatgccagagaaggacactctcatcgaaagctccctctaagctccagcctaatccctgaaagcaaccctcaactttgagactccattgacccctaatatcattgaacatcctgtaggtgaaaacatcagttatgtgatccttccaccaacgcttcacatgcccaagaactacgtttgtaatgctgcgcgatgaaaagcaggacttcattcgccaacgtcggtcaagatagtttctgcacccaaagaatcccacaaagttcattatcgtagaatgttttttgttgcgaacaaagtatcctaataggttgtattgggaaaccatgtcatcttgatgttggtaaaggtagcgttgccttggcctttgactgagcttggaaactgagcttgatcgttggtttagtgtcacacttgtgaatacctttacaaaagggttgtaaaactctatgacagcagtacagcagagcaatgcataagtaaccttgacatctttatcattataagattttctgttactctggtgaaataggccgatggccgtaaatggtagaaacattgctaattcacgtattacagtaccaaaaaattcactgagagagctaaatagggtataattcaactgtttgtataattcaacaaaatgatgaaggccagtctcaagttcttcggtagggggagttttaagggacatcttttcttttgtatagagtagatcaaaggtgtcggacaggttgttctgtaacaaataatatgcttcgtctccacaaagtgctgagaatgacattagttttcttacgcgattatcagtacaaggagatgcaaggtctacaaataactcatcaggtgtaaagtccgctgatctacttggtttctccagatgatcatttccacaaaaaaatccccttgcacttcgcacaaaatcttcgatcgaatcaatctgcttgccttgcctgttaatcgtcctacggactttctcgtcaaaactcaccaggctattgatgctagctctattgagagcccagggcttctccaagcatttgagaatcccaggcacgaagagcaagattgccgactgcaacaatctcctgtcccctcctggccatgatttgcaaaagacatagatggctacggtgatctgggacagtgccgtgagaacatgtcgcatccacagctcattgtcttcaatattgtaggcagttatgctatcctgtccaccaaggtgaatcagtaggataggagcccaaagaatctctaagacatcgttgttgtgtgtgtgaccaacatcctgtttcttgtgacggttaaatagggttgcaagggcatatattgctagggcatcgctaccgaggtatacaaaccagataaaggatctgaggtaggatcggataggaaacttatgccgggaggctgtaatgaaaaggaagtactggaaagcgaggctgcccaagagaagaacccggagctgccactcctcccaccattgcagagcatttgagatacccattctctctccctgtccctccctctgtctatttatatatttatatatagtggcatccggagcacactctcaatgtcaatgaatttaatactgcgtccttagctaaaaaatcatataatatgatgagtattccctccgttaaaaaaaaacaacctaaatctagacatatacactatgtccgtattcgttgtactagaatgtatcacatctcagtacttagattgtgttttctttttttttacggagggagtatatatactattccatattcgttgtactagaatgtatgatacttccttcgtttcacaatgtaagtcattctagcatttcctatattcatattgatgttaatgaatctagatagatataaataaaacagagggagtatcttggtacttaggttgtgttttctttcttttttttttttcggagggactacatgacctataaacagtaactgaaagtctgcggtcatcacatgcccgctggattccttatatcattgtttatgtcaataccttgcacgactacttatgtcattgttcaagtccgtactcaatagcatggccaggtcactaaccgtggttgagtctatttattttcttgattcaaccaaatatttccattgacttctgttaatttatctctttcctgtaaacgcataaaatcttagcgtgtcatactttacaaatgaaatgatttcaagaagcaatcactgccaacaaggcaatatggcacacagaaagacaagaaccatgatctcaacactcaagcggccaagttgtgtctattttttttttacttcttctagacaaattctctccatcccatgataactttatttttcactcatctaatttgtaccataaatactccagggatgtttgattgccagccacacttaaccatagtttgctacattgatctaaaattaggctagtttgatcaacttgacagatatttggttacagcaaccgttgtggcaatattatattccaataaattaaatccctacatgtcaatgacttaaaaagaaaatcaagattcccttgcacttagcgcggtgtggcaaaaaacaattgattgcaccatgggatgtttgtttgtatcaaaggaattggtgggataactcctaactaaatattaaaatttagtaagtacacacaaagcttaaatatacgctataggaaatttcatgatattgtacaaaaatccattataaaaaattcaaaatattgcactgaaaatccaaaatattcaacgaatgtgatcaagtgctccacatttaaagcaacgagtttgacctcctcttttcctgtacctgacattgttcatagcttgagaaatcttgttagcagccaaagcccagtcctcctcctcgaattgttcgagttgctcatcggacatgtcattaattaaagcaagagcggtagaatttgacgatgaagcaccaatatccaaacaagtcgagggagaaaccaaagcatgcactagacttagaatcaactttgtgagaaagaatattcatctcatgtgttttgagttttgtataaagtgaatccaaagtcaaagtggacatatcaacagactcttgaatagatgtaaccttcatctcccaaacagacatatcaagaccattcaaaaagtggcgaggaatcttagattgtgaataattagtgtcataagcagaatcaatggatctttttaaatgtactccttttttaaaagatctcgatgaagttatttaatgtttgtagttccttgatgaaagtttttcaaagcattccaaatctcattggcggtttgaagatgtgaaacaggatcaaaatccgaacgagaaatcccactcaataaaatattgcgagctttgcaatttttgttaaattcagttttcaaagcaacattattaatttgattaggaatcacataagtctgagcaaccttttgccaaacatcataatcttcaaccatcatgtaagattgcatcttgtcacaccaataagaaaaatccaagccatcgaaaacacgtggctacttgtaaacttgttagccatggcaaaactctagatcgattaaaatccaaagaagaaaatgtaggatcgaacaacaagaactaagccaacaagagaggggtgaatggttggagtacccaaaaactaaaacttttagcggaattaaaagttactctcaattcgatgatacgcggtctgaccggagtagatgcaccggtctaaccgcctggaaaccgttggtctaaccgcagtagtcgctccggtctgactgccgaaatcacttgtcgtcacctgtagccgccaccggtctaaccgccgttactccaccggtctaactggtccgatgccatcgatctgaccggtggtgtctcgacggttagactgccgaacacgagcaaacacaaatcgaagaactctcaaagtagatgacaactttattacttctctctgtgtttacaaagtgcaacaacagcactcctcacgaaaatctcgattaaactcgaaaccctaactattctctcaactcaatgctctctaaagcgataccaggaggccacactctccctttctatatatacccgaggtagttagcgtaaagccatgagccaaacttgtacaagaagttctaatcctctaggaaacattcccgtacaagaaactaactttacaaactccaatcgttccaaatttggacttcctccaaattcgactccgcatcccatacgcacacaatacctccatcgtatgccatatggaatctggactaaccatgtgcattgatctttagcctaagtatcccacataatatctgaccgtccggacgtctccttatctccaagttgactcccaatccgctatactatctcgaggcgtcaagatcacctacacatgaatcaaacaagaaaccatatctcgagcacaagctatctccaacttgactcattgttagcaaacaacagtattacgtacacatagtatccatctagaagtcataaacacaaattatccacaaatatccaatgaaataacccgaaactaaaaccgacacatagtcgaatggtcagaccgcgggctggttggtctgaccacacgtatacctctggtgtgaccggcaaaccttgaccggtctaaacggtccaattatccagtagtccctgtttatcatctgcaaatccaatcatctctaaacccacttcgccaataatctctaaataccaaaaccaataatctcatatgccaattattcatcatagaataacaatcaaacacactttgatttaacaaagtatataaaagtttttttcacaaattacttttcgtttgcaaatatgatgtttcgcttattccgcgaataggcaaaacgaagaaagtgttatcatttgagtatttttcagtccttcgcaagataccttcttagcataaaggaactgcaagtacgttaggatggaccttgtgctacgtaccttcagctcttcaagtaacttttgggctatgaacatgaaaaggcttgtcgactagaacatgttgtaaacatttgttaattaacaacctcatttagttagtttgtttgcaatatgttatttctcgaagtattagagaagtatacctatcagcatatgttcgaatcacacgacagtgaaacttgactagagaggagtgtaaagttcacttgtagggctagtttgtttctttctctagtcccgtagctgaagccttgtggacatggtgagcaataccttcgtaagtgtagacaatactgaacatcacaaccagctcccacttagatctctctgagcctacgccaaccaaaatttcagataattaatgagcagccaaatggaatcttggtgagcagcgatctacccaaacggcaaagcctgatatcgacgtgccttatcatctatttctgcaaagaaagggtcacaatgtagttgcatcctacttgcaatgctaatctgttgactgatgtagcttatgttgcagcagttgcaattaactagattcccagtcaccttcaagcctaaaattagcagaacaatggtgttttcagcccaccctatcatatagtacactatgctctcatgggactcgattttgttcattatgccatatatatagttatatacgtcttcaatcgaactagtcgtttattacaccatgacatttcacacagatgacactagaaatgtagtgcctttatatcactgcacgtctgcacacgctataccattttctgtccatggttctctttataaacccagatggcaggagttctgcctacaattaagaaggagaatactacaattagtaggtctttcttgcaactgttgaagaaaccaaatgttcatgttgctatgtaagcaccttttttgtagtcagctccatttgtgtgcattctagcttcctgtatttctcgaatttatacatctaaaagcaataatgtctctctatccaaacctttcatttagtgaacctaactcatgggattccatttaatgtcattatatgtgtagttctcatttgagtaaattgcaccttggatacaagaagttgccaagtgggtgcagtttaatacaagtatataacagctagcttgaaaagtttctcttgtagttgtgaacttggcaagctcttattactgaaacatattataatttagtagtgaatcggttgtgttcattctgctggagaccaatctgttggctgttgctatccaatctctacttctctagctatttctcattacccaattggttgtgttaatgaggcaccacgcatattaaggtagaggaacagctaattaacactagctagcaactgtggaacaacatgtaacttccacataaggtcagagaagaccctcaataagacaataactagctagaactcaccatgaccaatttacagattaagagaaactgatctggagaggaatgtaaagtgaaatttgtatggctaatttgtttgttttctggttaagcgtggtgcgcatggtcggcaaatgactattagcttcacaagtgtactaaacaaaagaaaacatcacaatcagttccgaggtcatggagggtcactgcttaactccattgctccaatcaatttgagaccgtcagaagcaagacttcggatgtgcattgatcacccatcaacacacgggatctgggtgagcagcgatctactgattcgggagaacaagtggattttttgatacttgtgcaaataagttcacggctatgttgcatctagggatgaaaatggtacagcgggcttattttcgaaaacggaatttgtcggtcagaattattttggattttttcggaaattgaaacgaattcggaaatattttctcagaaacgaaatcgaatatgataagggcagtttccgtcggaactcggattcggtcggaaactttccgaaaaatttctcggaatttctggaattataaaggcccataccatagtctataattcctccccagcccaacctaattcagtatcctaattcctaagtcactcaattcagcccaacccaatatactcaattcaaacttgatagttggattttcgtccgttttcgtaccattttcatccctagttgcatcctacttgcaatgcaaatctcttgcctaagctagctaaagttgtagcacactagcagttgcaattaactagattcccagcaccccccccccaaaaaaaaaccctacaatcaatggatctttcttgcagtgtaccttgtgtttttagctccatctaagcgctctagcttccagcttcccacattgctcgaatttatacacctaacctaagaacaataatgtttccggccaacattccattcagtgcaccagccatagggattccaattcagtcatttttcatgtcactgagcaatttccttaattacccaatagatgttttaaattagatgacaccatacacaatttaaattagaccgcataatgtgttattgctgtttttatcgaactgtttcaattctcgcatgccacattcactactgcagaaaccttttattggtgccagtcgggagctggttaaaactaccggtttccagtcagaaccaatttaagagtagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcgaaaacaacgaactgtggtatcatcccgcatttaactatgtatgaagatgaccttataatttcacccttgcatcattacgctgccacacaaccccgttatatgatgattaataagttgacaataagattgataaataatataaataaagttcaatgatacttcaacatcaatgtggctaaagcatacaatgtggcttacatgataggattacagcataactaatat

SEQ ID NO: 58544 - DNA, 9122 bp, Oryza sativa
cggcggtggcggcggcggccgtggaaggaggcgaagggggaagagagcgaaaaataccaaaggaggaagagatcgccatggtcatcccgtcccgtggcgcacgcactgcaagtgttcgtctctatgcgctacccaagctgctcgcttcgcctcgcctcgcctgctttcaatctggtcgggtcgggtcgggtcggagacaagtctgtccgttttctttcttccggaaaaggaaaaccccatcctttaatatttaataggtgcgtgggccggcccatgcttattatttttattcagattttcttttcgttctaaaaaaaattataagcgtgttgagaattaaacatgggaccttatggttaaaaccacacatcttttatcactgcactatcaagtgcatgagccacattttcattttgtttcagacatatataagagcttctttgtccatttagatttttgatagagccagatttcatagacaagtttttgttctttcaccttaacttctatactgtcataactatataaaaatattgaaatgtacccatcatcacccatctgaagtagattctctcattctcatcactgtgtgcatttccagaaatgtggtcttatgatgactactagactccattctataccaccgagtctttcaagttaaacgatttgctatcgacattatctctttctataatataccggtggctttatcaattcttctacaatacgtcgttgggctagatcttcttttcaaaaatatcaaaaatacacctaagagacatacaagattaacaattaatttatctcatcagaagtttcaaaaaaatatgaaaatttttatgtggcctccttacacaacatgtaagtttgtatacaagtttcaagttttttctggtaaatttagatttttttaaaaaaatatttttatgtgctatatgagagagaatttgcttatacaagacataatagcacaaaaatattttatgtagtgtatgaaagatgatttatattaaaaacaacaataaaaaatattttatatagcatatagcagataaattatatttttttaaaaaatagaaatgtaaaaaacttaaaacttctatacaaacgtccatgttgtgtaaggaggccacataaaagtttttatttttttaaaacttcaaattagataatcaattgttaaccttgtatgtccataaggatatttttgaaaataaggcctagcccaatggcgcatagaaagacaatgtcaaggcaaatcgttgaattcaaacaaactcggcggtataaaatagattctttcctaatataactatcttgctatctgtcaacgagtgatactcgcggaccgaaagaatagggtattagggtacgttggaacagggatctacgtagtacgacatcaaaacagacaaaagacaaggattatactggttcaggccccttatcaggtaatagccctagtccagtttatatgggattgatgatgatgagaacagattacaaagagagtaaccgaattggcgatgccaatgagaccgtagtcgaggaattcgacgagatctcccagcgagttggctccggggactccggcttcgtaaactttggtgggtgtgttggcgatgagatacgatatcctttgcctttccctaggggtcccttttatatcgtgggataccttgaccctcaagtaagacttgaagatatgtaaaccgacacgatatactggagattttaccctttccgagtaggacttctgcaattccttaacttcgtggagatattttccataatttgaggcgaattcctaatgacgtatatggaaaccaaccgtatacatgaaggtataccttattggtgtattccataagtcgtaggatagagggtatgccttatccgtaaccctgacagtagcccccgactttaacttaaatgaattcatgttctcgcacgcgacttctcctgatatagcgttgtcatactcgttagatcaacctcggttatataaccgtagagatgtagagttgtcgataacgctttcagggagcctatctgtgcaggttttgaatttaaattgaagtctgaacaacggtccccagaaattttcggcggcaatctctcccctttcctcgaaatacgaaccgtcaggtagtgcgcctatataataggattttgagattcatttcgggtccgtttgccaaaaaactctcactgttcctcaacttcttcggactcttcgttccccaatcttcaacaccctccaccggcaatcttcttccgatggcggacctcgagcagtcttcctccgatgccgccacgctgaagaagctgtacaacgaaggagccatccctccgaagcaaaccatggtgagggaggcaggaggtactgttccttctcccattttaggtcgcatgatagcggtagaggatttcatcaaatgtggctttctacctcctccttccgaatttctcttgctgatcttaaacttctacggtctttctcctgcacctaaaccccaactccattgccttcctgagcatttttgctcatctctgcgagccctacattggggtagtgcctttccttgatctttttcgctttttctacgaactccggtggatggaacccaattgggtttcaggatgttgcggattccgccttcgtgatggcatgaaggcaagatacatcccactccaatgccactcatctcggagccagtggaggacgagatggttatacctggggataaaataactcgacccggttcttatcgttcccgaggttcaaccagatcgttccgaggactggaactccaaacccccgatgacgccctccctccaggcttttgtcgacatcgtgagtggtcttcgcgagcgaggactgactggctatgaaattgttgaggatttcgttagtcgtcggatccaaccgctgcaagctcacgctcaccccgcattcgactacgccggaaccgaggacataactcagatttcttcgcggggtattcgtccttgcgttgcactttcttttcgctcctgatgttgaaaccgtggacgagatctaaccatgcttccttccatctttgtttgtttcagatcttcctgacgatacggtggcgcagcgagtcgaggaggtcctgatcagcgcgccctccacggcggaaggggtgccggccccgctttgcgacaagtcggcagccgagaaggctaccgccatcaatgtaagcgagaaccaggacaccttatatcttttattcctttgaagggccaaagtgacttcaactcttgcagattctgccgttgacggatgtaatcggtcctcttgtcgatcaccgggctccgcttcgctaaaggagaaggtcgacgacgaagtcgccaagatctcctccgctcccaccatcgctgggggcagcgggacaaagcgtaagccgtgggcgagatcgagtgcccccaatggttctcggtagaagtctgctggttccgaggtaggcgtgctgccttcgccctttaacttcttttacgaggatgtcaaaaatggggtcatgatttactgtcttacgtgggacacgggcagtctggctcctcccccgaagaggaggacattgaagctgcccgccgggaggtaagcgaaattcttgatcgaccttgttgtcgcattcccgatcttcaatgacgtctgttagccttcgtaggaaagcgtcggtggtctcctcgcagagtgggagtgaggcggcgatgagtgggtcccctgtcgctgtcgctcctcatgtagaggttgctcccatcgtcgcggagtccgtgggatgtgccgctgctcctgtggccgcgccaccacctaagatgaccacttggtctgacatggtggccgagtgccaccgccttctcgagaggggttctcgggtggtggtggcccaaatggaccgtgtggaggctcgcgcgacggcggcggacggaagggtggcacagctggaggcgcaactcgtggttgcccacgaggaccttcagaagatgaaggaaatcgtggccagcaacgagatgcagcgccaaggtttggagaagaggatgaatgatacgtaggacatcctcttttccctccacgattccctccagttagcgttgttgtgcggggcgaagtcctctattccaacgcaccccaatgagacgtcactgacgtcggcattgtcggaactcgcggatgagatggagaccatcccgtcacggcacgccgctcacgttgccgaggagatctctaacgggatccacacgggggcgtgtcacgtcctcgcgtgcgtgaagctggctctccctaacgtcgacctcaaggagatcttggcgaagggggcagctaacactacgcgggagagcgtgatggcgagcgtatcggatctcggggagagtgtcctccccctttttgaggagtaaatttctctgtcttgtattatggtctttgtataaacacttccattgttctatggatgcagcagcttcctttcatgaattatgtgttgatttgtcgcgttcctttgccttccgtagctgtgtagatcccgaggacgtccagcaaggcggacatcctcatgtcgagatggttggactgccttcctcggacgacgccgtcaaggatgggggattggacgcgacttgctgcctgcttgaggccggtgaagtcgggttcccacgtgcgagctcaggtgtgatgttttatagaagtctctctcctaaacttgtgattttgtttaggaggtagcatccgtcacatcttctgccctctgtagacctcgatagtgtcgtcgctgagcgagataggcgtatcgactactggaagacaaagtttgaagtcgccaagcttgagcgatcactcatggttgtgaaaaaagaccaagccgtggaggtgcttcgtggtcgcgaggtctgggtgaactcatacctcaagagctgctgtagtgccatggctgatgtctgtcgtcagttgaaggtcaaccgcccgaagcccgaggagagtacggcaggctacttgtcttagatgacgggggcgtgtgcccaactcgaggacataggacagcgcatcgacatcagcctcaaggaggagtgtcgtcgtgcgaggcgctgcgctaggggccacgtccttgcttgcgtccaagatcatcgtccgcaaatggatctcgggttcctgcgtgggggttttcgacgttctcggttgtcggcgcatgaggtcgaccggtcggcgcgatcgcttgcgcccctagccgaggaggtgtttgcttccatgaactggcaatggccgtcgtggtagatttttagtccttgtaaaaaacatctgacagaaattttgtaatatattattgttaggggttttgtaatcataaagaacctatctactgaaggtgtaaataggtcgtgtcatatgcgagtactactctttttacaggctgtctttagcccgttgtcgagtaaggtaccctccctagcccccagccttgtcctcggagaagtctgttctcataggggaaggctcgatggcccgtaacttgcctatctgaaattgcaatttacctagccccccagccgtgaagttggaaaaaccaatttccgattacacggcttagttaatacaccttttgagcactcttacatgaccaggtcttacatggttcgttcggctcttcgaatccgacaagcccttatctgctctgggcgtccccagccgaaattcccgtaggtttctcggaggtcttgtcgaaatggcgtaaagggtcaataggttcgttttcaagagtaggtgttatcgtggtaagggatctctggaaaaaggacactggtgtataaggagatcaaaatacctttggatatttgatttgtacatgtctgggatacattgactttatacataaaatttacgtaatttatcaatgttccatgagttggataactcgctgccatcgccatctacaattttgaacttgcccgatcgcagtactcgaaccaccgtgtatggtccttcctacttaggcgagagtttgttacgccctgcctagttttgaactcgtcggaggacgtagtcgccgatggagagtgtgcgagctctgatgcgcttctcatgatatcggcgaagagcctgttggaatgcggctgctcggacggcaactcgttcgcgatgttcctcgagaagattcacatcgtcgcttcgcctttcgtcctgttcctcatcggtatacttctgtacgcgtgtgctttgatgttgtaactccatagggagcatggcttcagatccgtatacgagaaagaagggtgtttccttgttggatgtagtcggcgtggttcgtacggcccatagtactaagggaagttcttcgacccactttttatcataggccatgagcctattgtggacgcgagttttaatcccttgtagtactattccgttggcccgctcgacttgtccattgctctgagaatgtgacactgaggcgaagcagattttgaccccgagttcaatgctgtaatcttggaaatcactgctggtgaactgggatccattgtttgtaaggatgtggtgaggcaacccatatctgcagaatatccccttgatgaatttaatggcgttgtcggctttaatttctcttgtcggctctacttcaatccacttggtgaatttgtcgattgccacgaacaaaaatttgtagcccccttgtcctcgtgggaacggctcgagtatgtcgagcccccagcacgagaatggccatgtcaaagggatagtctagagcgcttgtgctggcaacttggtgtgtttgctgaagaattggcaagcttcacatcattgcactatttcacatgcgtctttaagagcggttggccagaaaaaaccttgcctgaaagcttttccgaccagagtacgtgcaccgacgtgagatccgcaaatgccttcatggatgtcgaggagaagagcttgtccgtcgtcggatgatatgcacttgaggagaactctgttcagggcctttttgtatagatcgttgccgatcatacaatatatcttagcctgacgggacagtttctcagcctccgtgtcgtcatccggcagctcgtctgactccaagaatttgattagcggagtacaccagtcgtctgtcgtctctatgattgcagcgacatcaggtacctctgcagcccctgcgagttgctggtatcagccgtggtactatcgtcgtgcgtgtccttgacggatggcttcgtcaggacatccaagaacgttctgggctcgagaggttctcgtctggaagcacgtcgtgcaaggtcgtctggttcgacattgtcttttcgataaacgtgtcgaacttcgattccgtcgaacttgcgttccagttttctgacttcggtgagatatttggctaattcggggctagagcatttatagtctttgtgtaattggttcgcgaccaactcggagtctcccttcacgactagtcgcttgacaccaagtactactgctgctcttatctctacgagtagtccttcgtactcggccgtgttgtttgttgcctggaagtttagatggattgcatgcttgaactgatctcctgtgggcgatgtcaagatgaatccagcgcctgctccttggctgttcagtgctccgttgaatgccatggtccaggtctcgttgatcgtttgggcggctggtctgtcctctgggatagtccagacggctacgaagtcagcgaagacctgtgacttgatggctgttcttggcacaaagtggacgtcaaattggcttagctcgactacccatttagcgattcggccgaccacatctttattcctgacaacttcacccaaagggaaggaggagatgacggtgaccttatgagcctggaagtagtggcgtagctttctcgatgtcatgacaacggtgtagagcagtttttggatctgtgggtatctagtttttgcgtcgtggagggcctcgcttacgtagtacgcgggatgttgtactttttccctttctacgatgataactgtacccacagaataaggcgtggcagcaatatacaggaataattcttcattgatttgaggagcaacgagtacgggaggatttgacaagtagcgcttgagcgcgataaatgcgttcttggcttcttggttccactcgaacttgtcttgcttcttgagcagggcgaagaagggttgtcctcattctcccatctttgcgacgaatcggctcaattaagccatacatcctgttagccgctagacctccttaagccttgtagcgacttcatgttctcgattgccttgatcttctcggggtttgcctcgattcctcgacctgaaaccaagaaaccgagcagcttccctgacggtactccgaacgtgcacttctccgggttcagcttcatttgatatcttcagaggttgtttaacgtttccctgaggtcgtcgatcaatgagtcgcttttcttggttttgatgacgatgtcggccacgtacaccttgacttttgtccaagctgagtaccaagtgctccctagatgccgcgctgatatgtgttgcaccgaaaggcgtgatgaacgctgtcttctcttcgtcctcttttgccatgctgatttggtggtagccggagtaagcgtcaaggaaacttaacaactcacagccagccattgagtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaagaaaaaccctaaaaagttccctttccctccccctctccctcttgggccggtccggcccagctccctccccctccctctcctctccccgtggcccatccggcctctccccgcgcgcgcgccgctgacgggcgggcccgcccgcctccctcgctgacgggtggggcccacacgtcatccccttcctcccgccgctcccgccgcctcgcccgtgccctagcgccaccgccgc

SEQ ID NO: 58545 - DNA, 12175 bp, Oryza sativa
cccttccctcccctctgtcggccgccgctccgccgtgcctatggccgccgccggcgaccataggggcgcgggcgcgccgcctcccgccgcagcgccggcgtggtcgccttcgggcgcaccgagcggctgccgcgtggggcccggctgtcagccgcccgcgcccttaggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtctagacgctgcagcttcggaagatccactcttcgtggaagttgaagccggcgtttgggaaagcgagcaaggcaagtcacatcatccttgaacatattgaatcccagtttataaaattatgttgctttaaattattgcattatctctttatttaaattcccgcgttatcaccgttttatctagccatgcctatttacctttgttatgaccttattattattgttattgttattattaccttgttcaccctagactaaacaaaaccccaactagtggacactctactcatggtaccactagtatgattttaggtagatgcttcgctgtttaattaggtaacattaggtgattttacaactctagactttgggaatgttctcatcacccggacactatggaattgatgaattattgtggaattggattcacaccgccccctctattcaaaatccccaaaaatggttttaggctgggctcggggtgcatggttttgatagtagcacctcagccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcctggtagtcgagatgtcatggcacagggccggtgtcctgctgctaggggctcagtcctgcctacctgtctcgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagctgagcaatgtacccaagttagtgttttaatccttaaaacctgcttaacaactaaaatgtggaatggttggcctgggttggcttgggacgagctgggacccagggtcgggttgccagttcggtctgaatcatcgtaggccttggggtaaggcaggttcgtgtgggttcacggccttgataaataatactgtatagttctagaatcgtgtttacaaaatagctttgagcaactaagtgtcttttaatgctgtttactgcaaaccctaaccctttatattataactcccttgtactccctcgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgtctgtggtcgtcgccctagtcttccgctgtttcccgtttgtctttatgtgtgctaggccttcgccgcccatgtaataaattatctatttacgcttccgcttgttaaactctgaactgtatcaacttttggtgtaccttgcctcctgggacaaggaataatgcacgcacgtaaggaacgcccgttgggttatttccggtcgtgacattgagtccgctaattggtctatttgaggaagagggaagtggtccttggggcacgccttgttgaggtcggtgaagtcgacgcacaacctccacttcctgttggctttgcgtaccattactggatttgcgagccactctggatggatgacttctcttatgaagccagctttgagaagtttgtccagctcttctcatatggcttgttttcgatcgggtgcgaatcaccgcagtttctgcttaactggcttggcgttgggtcacaccattagtttgtgctcaatcacctccctgggtactcccggcatgtctgacggttgccaagcgaacatgtccgcattgtctcggaggaaggtgatgagcgcgagttcctatttgtcatccagtgatgccccgatcttgacggttttgtcggggttggcgctggacaacgtgatgatcttgatggtgccatctggttttggtgtcttcttgattttgctcactttcttggggttctcggttgtggcgggtgggttgggagtatgctcgactatgtcgaggctccgcttgtcgcactgcaccaccaacttggcgttccccaggatattgattgtccctttcggtcctggcagtccctttcggtcctggcattttgagcacttagtatgcataatccgaggctgccataaacatcgcgagtgctgttctcccaatgatggcattgtacgcggtgtcgaattccgcgacatcaaaggtgatctgctctattcagaagttctcggcgtgtccgaaggtaacatgcagcgtgatctttcccaacggtttagacgatgattccagggtaattccgtgtaagggttgatctgtgggcgtcaggttgcttcgaggtattcccatcgcatctaaagtgctggcgaagagtagactgatcgagctcccgccgtcgatgagaactcttgccaccttaatgttccgaatagtgggctccaacacaatcggatatctgccaggtgtagttgtgtcacgccctgaaaatcgcctaatttaataattcattctttaatgcatttttagaaattattttaaaagcctacaagttaaactctaataatctaggaaaaatttcaacataaaattgagctagataaaatttcattaaatactttgcttgtttatctattttctagatttttctaggaattatttgagcaaggaaagtatttttaataaatgaaacatcatttcacgaattattttaattgaaaaagtctttaaaaccctcccctaggccgttgggccgtttccggcccaactctcctcccagccacgcgcggcccacgccggcccaagccgagccgccgcccctctcctctcaatccgccgacatgtggggcccacatgtcggggtcatcttccacctccggctggccaagccgagcccgagcgccgccgcctcccctccaaatccgctgcctccggccatctccaagtccgattggttgaggtgtttttatccctttgttgtcctccatcatttcccccaagaatcggagctaattgctttgtatttcatcagaatcaaattcgttttcgagtttatctctccaaactaaccctaggatagtccgatctctctaatccaagcctatataaagcatcccctagttgtcctctacgtttcccctcaagtcccgaactctaccgttgcccgtagcgccgccgccgtgtagccctagtcgccgccgtcgccgacgcccttccagccgcgccgcgccgctgctgtagctgtcgccgccgccttccattgccgccgttgggttcgcgcggaggaggagcacctcggccgcccctttgcagccactggagaccgccggagcgctgccgtcgacgtcgagccaagccgtgccgtcgtcggagctcatcgccggccgccgtacgtcgtcgtccgtcgtagtttcttgcaccggtgagttcgcgtcgtcgtcctcttcgcgtaggtgttctcggatagcccggccgagccctctatcaccggtggtcgcgtcgtcccgtgccatggcctgtgatgatgtcatcgtgacatcataaatcatttatttaattcgtgataattttctgtattagatgaaaatcaattaaacttagaaaattcataactaaatcatcgtaactcggattcgagtggttcaagttgctaaattcatctagaatcaagatctacatgttaaaaatatccacatgtactgtttatgcttgtttttgtactgttttgttgattttgttcatttgttttagtttccgacgttccagaggagagcgtttacgttgaggaaggttcagaagggtttgaagaagctcaaggcaagtcacacagatcccaaacaactctttgagcatgttgaacccgtttaaagctaatgttttatttcaacttatgcattattttcgagtgtcatcgagtggtgagcctttcccgattaattaatggccgaagatgactttattttcctatgggtaataaattgatttagcttggaccttatatattggtttagttcagctaagtgctatataggcataattgcttagccatgcttagaaacattagctcattaatgggatgaatcatattacattattacttatggttataattaatggtagctcacgatggttaatcgtgttatgataattaattgataaataaaacctgattaaaggtgggttgtgagcacatggttgtgatggtcatgctcatgacaattaaggaccggttcacgagctactgttgtgaaacatttactgtgccaaccacaagccagcgtgggcaacggctttatcttttgtatagcatgattcattacggggtgccagactgtgaagcggcgagaagtccgtgggggtcgctggggagtccatgcctctggttttgagggggagattatgatccaggaatggtgcactgtggtgagttgtgttgtttgagaggtattgtcacagttcctttgcaaggtattgtggtggtactgaggcgcatggtgacgtgttgtggaactgtgtcttgtgggtacagtggtacatctctggccagagtaaaactattcgaatagtcgtgcccgcggttatggctgggtttaacaatgtttttcgtgattagtctcacattactcattattaatgataatattgtgataattaaattgactcctggtttggaatggtatattcctggtatggaggtttgatttgtacaaccggggttggttgttcagttgtggttgggcctacgcaacacgggtgtgttgtatagtgtttatttaatattgcttaattgcttaactattttactattttctcaaatgtttattaaatgttgtttatgcaaataagctttattatgccatcctttgttatcctgtgcacttgcatatttgctgtgtggcttgttgagtatgtcatatgctcattcttgcaatattcattcatcagaggaggagtacttccgtgaaggtgatgatcaggaggattaggctttgttcgggtcaagttgcttgtggagtggagtcgccatagctgtttagtcttttgtttttatttccgctgcgtagaattttattcttctgagaggaactatccacctctgtaataattattcattttgcgaatattaattagttgtttgatagtactctattatcaatttgttattgtgtgcctcggctgattcctggacgaggatttaacgcacatgtaagcgtttggaattttggatagaaattccgggcgtgacaagtcacggtcttggggtggtcggcttccgagaactcgatcttgtgctgcgaccacttcatcttggtggtagtcgcctgtgaagtggagcaaacttcgcgttccgctttcttgtactccctcttagaggtgtacaaagtggatccaccgaagatgtgggaaacatgcaaatcatactccgggaaggcggagttagagttgtcggtggtggcttcttttgcagtctccgtactcgctttcctctttcgattgctagttgtttcgtgagctcctttttgatgacgtagcaatcttccaaggcgtgattgcttgtcatgtggattgggcaccatggcttgcgagagtcgtcgccctgagggttggagcgcctggacggttctacttgctctgcggcaaggacctctccagaagacttgcgcttcccgcttttgcgacttctcttcttgcttgactctggtgcgtctttatcagtcgacttcttcttctcgtctcccgctttgctctttccctccttgcgtctcagagtgtcgtctgcgtggatgtgatccggcgcgttgccaactcttgggtggtgtaccgatctcggacgccagacttgaatgctcgaatgacagaagcgtcggtgatctcgaggatcgtatttctgcactcattgaagcgcagaatatagtcccgcaatgattcgcctgggttctgggttagtgcatgtaggtcgtcctcgatcgcgtggcgcttgtaagtcccttggaagttggcgacgaattgctgccataaatcttcccatgaacagattgagtttggcgggagatggacgaaccatgtaatgccctgattttcgttcgggattaaaaatcatttaataatgcttttctagaaattaaataaaagttaaagcaatttaatcaagtgaaattattgagggaattaaaaatttcctttaaaaatcatggccgggaatattttgtaatattctttgcgccctaaaatattctctgaaattttcccgtgaattttcggagctcaagaagtaattataataatacaaagttcattaaaccaattaaataaaaaagaaaacgaattaaaatcctcattctttgctttgggccgtttccggcccaagtttcctccccctcaggccggcctccctcctctctcctcccttcttggcccccaaggcccgtccccttgcaaagttcacttcgcctccctcaaccatcacctcctccctccctcgccgacaggtgggcctggcgaccccacctgtcagctcctccttctatcttcggcgtccagaaccaaagccgccatgacgcgcctttgtactcccgctcgcgtcctcgcgcccaaactgcatgaaattggttcccctccacctcctctgcactctccccacatttcccccaaaaatcgtgtcgggttcgagctccacttcgcccatgatgtcgcccatgtcgccggccgttgccacccgattccgccctctcggccacaatttccctcccccacgcccatataaagcatcgtccggctctcctctaccgtttcctctccacccccgagcttcccatcgcctccctcgctcttcccacaccgtcccccacttctgctactttccggcgaactctagccgcgcgctaccgccgccatagccaccgccgcaccgcgccactgccaccactggctcctctgcgccgagccaaagcccggccaccacttcccctccccaaaccaccgccaaaaccccgtcgccaccaccaacccgagccactgccgcctcccgccggcgagcgtcgccttgcccggccatgccgccgccacccacagcgctgccacgccccaccgcacctcggctgccgttccaagccaccgaaatcacaccgaagctcggcatctctcggtcgccggtgagctccaccattcctctcctatccggcgtggtattctcaccgctccgatcacctatgttcctccctaacccttctatcttcttccccagggaatcccggccgccgtccgccgcttcgtgctcatgggtcgccgtcggacctccgctaccacctttcccgagggagcgccgccgccgcccgttgcccccgccgccccgacgcatggtgagcagtcccctccatctcccctttctctccttcggcggcagcctcccatgcccgccaccgcgtcgcgtcatgtcgccggtgttgtcgccagaggccacatccggtcgtgagccgccgccgcccctggccgctctgtgtcgccgcccgtggaccactcccgtggtccgggtccacggtgccgcccaggccgcggtggaccgagtccaccgtgtgtcctccctttggagccgctgacgtgtggggcccgcgtgtcggcgccagcctcccccctttgatgacatcagcgatgatcttatcccttgagaaaacaattaataattgcgcaataaatcattaataattctagaaattcatttaatggctcaaaacttataaaattcatatctaactcattcgaactccaaattgggccattcaacttgcaaaattcatctaaaattgagatctacatatttatttaatttttatgtactgtttctttggttttattagagtttttcctcattttgcgtgccagtgtgtagtttccgccattttggaagatcgcggtcgcaaggaaaagagttcggaagattgtttgaagaagcaaggcgtcacacattccccttgagcatattgagcctattttacaaatgttttaccgtttgcaaataaatatgcatgttttgctaattacatgcgatccgggtattacctatctgctcgcttgtgccatatttacttgatatctgtcctttgtcaaccttgggtgataaatcgactagctcgtgttacttatgtgacctagctagaattatttgcttagccatgcttaattaacgctagctcagttgatgggataattgcagtattagaccttctagtatcttgatgagctgcgtgctcgagacatctggccatgtttcgtggtcataattatccaactaaaatgcgactgaatggtgggctatgggtgcatggttttgcgggtcgcacccatggcaattaaggaccggttcacgagaaaccctgcaagacttatagtgcttaccacaagcgggagtgggtaactgcttgatttgaagtatagctcgaccctttcctaggcaccggtggtgagggtgggcatgatggagttgggtcggtcggggtgtccggttgtccagctgccggactcaccgcggcgcacgaggggactgcccacctccggggtagggggtgggggtgaaagcttagcgtggtgtggatggttaggggagagttatgcggagagtctggtcataatcactcgacatggtgacgtgcctgcacaggcacggtgacatgccggtggattgtgtcttgtgggtacagttgtgcacctatggctagagtaaaactattcgaatagccatggccgcagttatgggcgatcgaccggattcaccgtgattagtctcacacttaataaatcggcccaatgcactgtagttcaggtggattggttgggcctgctcaacgtagtgtagcgttgatcagtggagatttaatattaccttaattactcaacagttctaccgttttgctcaataaaatgttttacaacaacctttctgcaaatagccacaagccattcttgaatccccttgcacatctgcatcgttggtgtggcttgctgagtatggtggttgtactcagccttgctattgttctcccttttcagaagtgtagtgcttctgagctgaagacaaagttagaggatcaaggctcagacaccagttgagttttgcctgtggagtggagctgaagcccctctaggatcgccttttccgctgctgctgctttcttttcagtgtgaggactaagagcctattctgtaagtattttatgctttatttacgtttggaactgtatattacttgtcgttttgtgtaccctggctagtcctggatagggatttaatacacaaaatagtctaaaaatttagggcttaatttctgggcgtgacaaaccatgaccgggcagagcctttcagcgcggccggcaaataatttgccaggacgttgtcgtctgcgccagcggcatagaaaactgtggagtagacttgcagaaattcttctgggtctgtacttccatcatatttcccgatcgatcccggtcagaacttctcgggccaccgcacgttgtgaagtgcgggtgtgaatgccctgcatccattgcctgggacagggcatggcccacgatcgcgatgcctttgtggaggtcgatccgaagaggacgatgaagacgaagatgagggatcgcttggatcaggagcccgacttctcgaacgatgatcacgtccacgatctcgactcggatgaggagatttggagtttcgatctcgtcattcgtcgttattcctttcttgtctccggggacagttgtcccgatcccggtcgttgtcatcgcgtcggtcgtcacgagttcgacgatcacgattcctgttggagatgttccttcggccatcgtcccgctctcgttaagatggggagtgaggacgatgctgtcggtgcggattgccatcctcacgatgaggagaacgatgttggcggcgctcgttctcgttgcgttccctcctgttacgccgacgtccgtttagatgttcgcgaaggtcgccatcttcacagtgcggtggtgtagggtcacgtcttggaggggagcggttgccggtaggccttccgtcggggttttcatcctctgcatctccggtaagtcgctctctatctctgttcggctctgggccacctgcggcttcagcaaacgcggtgttgaggttggtcacggtctcacgtagccactctgcccatctgctggtgtctaggtttgttaccggatcaaaagggccttccctcaatatcgcgtccaggttccgcaactgatgagctggtgttctcgcagcggcggacgagctcgtctcagtgttgtcaaccacgtttacatctctaggcgactgcgaggaggactcgtagccttctaagaggtgtaacacggatggcttgtttgcgtcgacaaatccaacaaaccgatccaggaccggagccgcatctggttccttggcaacacacggagtttgaattcgtggccgctggacgcgatgatgcgctggtttgagggtcctgaggaagaccctgcagttggtgagatcatgcactctagatctgtggatcggacagtaggtggtactcgttggtgaagtgcgttgtatcccccgttcccaacaggcgtagagttcagcttgcacgtggagtatcaccgggcagtcctcgagagcatgcttggttgtcttatgtatgggacaccaagttctcggtttcagggtggttgtccttgtcggcttcgatttttcacacgaggggtgaaactcagccgcttgagggttcctcccaggtgttggggctgtcgatgttccattctccaccggagtgggaggaattgtcggcggggcattgtttctctcagtcgtagccgtacctttctcgttcccgatgacgattgggccagtcgagattggtgtaacgatgtagatcggaacgacaatagatccgacttgagtccacaccagcggtgtcgaggtagaaactccttgattggcgctggtaacgaggctattgtcggggagtcttgaagtcatactggtggatccttgagcaccaagtccccctacctagcgctccactgtcacgagtgatactcgcggaccggaagaatagggtattggggtacgttggaacagggatctacgtagtacgacatcaaaacagacaaaagacaaggattatactggttcaggccccttatcaggtaatagccctagtccagtttatatgggatcaatgatgatgagaacagattacaaagagagtaaccgaattggcgatgccgatgagaccgtagtcgaggaattcgacgagatctcccagcgagttggctccggggactccggcttcataaactttggtgggagtgttggcgatgagatgcgatgccctttgactctccctaggggtcccttttatatcgtgggataccttgaccctcaagtaagacttgaagatatgtaaaccgacacgatatactggagattttaccctttccgagtaggacttctgcaattccttaacttcgtggagatattttccataatttgaggcgaatt

SEQ ID NO: 58546 - DNA, 4969 bp, Oryza sativa
ttacaagcaaaacacccaaaagacagtggtccaaaatatattttggcaattagcacagtacgagatatagttataaagttgagaaattttagagcccttgagaggtacccaaatttttagtgtaaatttggtacctctcagtagtactggaggtagtaagaggtatcaaattttatattagaaaatatatgacacctcctaatacctcctcaacctcatgtactgtaaaatcgctctataaagtttacacaaccactgagatgtgtccgcaaaatattggttttacgggattcaatacacaaataaggcagtacattttcattttagataggaatcaagctttgttataatttccattcaagttgaaaataaaaataaataccacacttcagagcatgtaatcggggtacaatagtgcacatggaatccatgttggcaagaaataaatcattgcaatggagaagaaacaaagcctcattttttttatcggaattaaattccctgagtagaatgacaacaatatatttacaatagatgaataatatatttgctttgttcttaatgaaaatacgtcaatatatattgttgtaacacctggtaggttcaataaataaattaacttaggatcttgtatcatgtgtcactgctatttagcataaaatataacaactgccatttaattcatctattcttcacttgaaggttgatgatgagagaaaatagctatatgcgaaatgatttgtcacactggtggagaaaccatctttggtcggtcggccgaaatccacaatagtcccagttccactaaaaaccgggactaaagatattctttagtcccggttggtaacatcaactgagactaaagatcatttttagtcccggttcaaaagacggcaggtggtgtcagacccctcttttatctttattcccggttggtgacaccaaccgggactaaagatctatttttagtcccggttggtgttatcaaccgggaaaaaagatcgacatgcgccacgcgagatcgagagaactgaggcgcacgggtggatcagttaataagttctgatctttatctcctcctctcctcactcaccccatctcttcctcttcctcctcccatctcttcctctacctcctctggatctgcccccttccctctcctccccacttctcaacctcctttggatctgccccctcccctctcctccccacttcttaggcggcggcggccgggcggcgcggaggcgccctcacgcggcggccgggcggcggcggaggcggcctagcgcgccctcacgcgatggccggacggcgaggcacagcgcgcggcgggtggcggggctgcgcacggggcagcagcgcgccggttctcctctattttttttataatttgtgattgagagatgtataatttcttttttagaatttgtgattcattgcatggatctaagatgtataattgatctgtgatacatttgatttgtgtgtaatttttttaagatttgtgatgtatttgatttgtgtgtaagtaacttaggatttgcatttgtgatgtgaatgatttgtgatgttactttgatttggggatttggggtttgatttaggtatatgcatgacactcgatttagagatttgttgtttgatctgggtatatacatcccacttgatttgggagaaaataaaaagaaaatggactaaccgggactgcccctatcctctctttagtcccggttggtagcagtaaccgggactaaagagagggttggtaacaccaaccgggactaaagatcgatctttactcccggttatttcacccgggactaaagatagcgatctttagtaccggattcgtaatctcggttagaaaactgggactatagaggggttataaaccgggagtaaagatgatttctccactagtgtcatgttctgaccaacctgaaagtgcaacacaaaatgttgttttgcaagataatagatataatgttaaggttgtgatgaaaataaaaatgctcacaatatggcaaattgaaaaggatgcttctcttcttccaccagtccattggcccttccgagtagatcatttcaaacatcttattatcaaatgtatttgtcaaaaataaaaacatatggaaagaccgagctagcaccaacactggattttttacaatttggccctttttgaaaaacttatttcgtaaatagacccctgaaaaaacttatctcagaaatagtcctttttaaggacgccagagtcgctggcgccgtcctcctgccaccgtggccgggggagtgcgccaatgtggctggcgagtgcccccccccccctatttttccctctcctctctagtatagaggagagagaaatgtggaacttatttttttattttttatattctttttacacttaggagcacataagaaccaaccgtagaaaaactaaactcaaatggcgttctctccctgttttggttttggtttttcctatagtccccccaaaagaaagtagattatatttcgaacactcttagcttttttttaatatcttttacatccctataaaaaaagttagggttcatgtttttttacatgcgggtgtcatttcttaaaacaggcgtaactttctcatacggactcggaatcagacaaataatatatctacggacatctacgaaaaaagttacattcaattctccttggctttactgggttcgacaaaattagaatctctaaattccgcgtgcaagattgtgtttcgtccatttgagttttttttctatggttggttcttttatgctcataagtgtgaaaaaatataaaaaagtaaaaaaaaacaaaaagttgcacctctctctctcctctacactagagaggagaggaaaaaatgtggggggcgctagccacattggcgcgctccccctgccacctcagcaccaccattccgttggacgacggcgccagcgactctggcgcccaaaaaggatcattttaggataagtttttcaaaaagactaaattgtaaaaatccagagcaccaacatggccttacacgacagccttccagtgttcatgcaagtccaggcataataacatggggtgtgaaagaaggaaaattatcatggggtgtgcaatatctcagcaccctaaagcaccatagcttgcaggccttgcacactggaaacaattgatcccaataatcccaaaagaacatgagtgatgtgatttcacactaattaacagagttgtattgtataacttaaatcatgtttaccttgaagccagtgcacatggattgaaattcaatatttaagcttgacaaatatattgcccctcaaatattcctacggtgacaaatacaacgtacacataactaaaaacttgatattattcacagtgcctcaaaatttagaaatttcttgtaataatatagaaacctaaagtgattttctttcttggacatttgctcaacaaaattatgaatttaactttggtttatttgtaacttccatatgtctgctgattgcaagaaaagctccaataccaagagcatcgtcccttatggatatggaattggtttttttctcagagcaacacaaaaacaatcaataatacattagtaataggctgcagctaatgcgatttttttcccaacaaaataatctgtctgagtgccttccatgcaatatttctttaaagaaaataggttatcacctatcatatgacaaaggtaaaaatgtattgctaccgattggtaataggctaacaacaaactctagtttgttttgctgcaattgcaatgagtcgatgcaacttgaaaactcccatgacaaagtaatctcggtaataactgaatgcacgagtctgatatttaccgaacataaagaaagttttagccaaggacatactatcagacattggaatgaaaaaaaaaatcaactatgctcatcctggaaatcagtagcagatcctcccaaacactcctagtccggtagtccccttatcctctgatgcacatagggagcagttgctctgatgcggccatcctgtggtctgaaagttatcgaccgtgaaaaatctttctttcaatgccaaccacaagaagaatttgattctagagggggctcttgtatcccacagcagagtagcacagttccatttggtgtgtgtgatgaagaacatctcatatgcgacattgccgaggccactgggaagactcccatcttctgtgaattttcagattatcttgtctttgttttgctgttgcactactagaaacgggcacacacgtcgcctgtaggcaaaggttcacagccatatcatatgtgtaggaggaagggcgagcggcattacaatgcaaggacacattactagtatggctaaaagtgaataaattacccaaacaaaacctgtgcaaaatgatattcaaatagtaccatattccttcccaaaatcttatattcaaaatcaagaaaataacctcctaaaattcctatgaaaagttcggtgctaatcaatccttaagaattcaaagatccaaatatcatacatatttcactccaaaattctttcttgatcaaaatacaaatttgttcaaaaaaaagatatcagcttcaaatctttccacaagttccttcgaatttaccaagtccaagtatccaatttaaatcataacttccattcaaattcataccaaaatccttctcttaagataaaaatatctagtttaaaaggttgattatttacaccaccaagtttagcattagcacaagttctgtaaaacaagggcccaatagagtatattctaattcatctgtaaaaagatgcccagtagagaatttaattaactatatattctaatccatcatcaaggttgaccaaacaactttcacccgcatcttgtaaagaccacagctgatcacctcctcatccaaccctctagtaaatggagtgaacctcaaagtgcgactgg

SEQ ID NO: 58547 - DNA, 750 bp, Oryza sativa
atacagacggaagacgtgacatagtttccaacccatcctagccatagataagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggcagaggtgctactatcaaaaccatgcaccccgagcccagcctaaaaccattttggggattttgaatagaaggagcggtgtgaagccaattccacaagaaccaaaccattctaaaggatccaggtgatatgaatatttcccaaagtctaaagttgtaaaaccacctaatgttacctaattaaattgcgaagcatctacctaaaattaaactagtggtgccatgagtagagtgtccactagttggggttttgtttattctagggtgaacaaggtattaataataacaatacaactattattttgggcataacaaaggaaaataggcatggcttaataaaacaggggtaacccgggaatttaaatgaagcgataatgcctaatttaaatccacataatttataaactgggat

SEQ ID NO: 58548 - DNA, 1101 bp, Oryza sativa
tggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccatattattattgttattgttattattattaccttgttcaccctagattaaacaaaacctcaactagtggacactctactcatggcaccactagtttaattttaggtagatgcttcgcaatttaattaggtaacattaggtggtttttcaactatagactttgggaaatattcatatcacctggatcctttagaatggtttggttcttgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccgggcgtaggcgggattgggtcggtactcttgtctatggctaggatgggttggaaactatgtcacgtcttccgtctgtataccgtggtggtatgtggcacgtggttgcacgtgaggaagatgtgtcttgggggtaaagatgtacacctctgatcagaggaaaatctattccaatagcccgccc

SEQ ID NO: 58549 - DNA, 22886 bp, Oryza sativa
attgatctcgacagtgccctccaaggcttccttaacagaagcagatacaagctccacctcactgagcctactctccaaggtttcactcacaatcatagacttacgagtgtaaaccttcatctcaagcaatcctttactaaattctttgtcattgcactcttcattttccttaatcttcaaatttatctcaaaaaagatttcaccatggaaaacaattcctctagttgggcccgtgagaattatattttcattctacaagaaaaattacacaagaagttagctagtcacactaatgctatatatataaataggtgatgacattatccatagaatataatgttattatttaaatgacatggctcataatattacctagttatatttaagcccactaaaaataagtactggtatttcatatgaaactaggggtactgtggatgcatatagacaacttaaatgtagctagctttggtatgcctttaactgtacagaactgtaaagaaattagttcaatgtatcatgtgaaatagggaaaattggtagtgtttaagagaacttagcaatacctctgactggataacttggcaattgtccctattgcgccggaagatgaagatgcagttaaaatctaatccatctctgactatcacagtcccatatagattgataggataaccaacatctgatgattttaccttcagagaaagtacattcaacgagctagtcaacatgtggtccttgttgataattgaatccgtaaagcgcattggaccatattgcgctgagaaaaacgaaaatggagttagtttgcaacagggaagaatagtatgtcgacagaagtatacactagataatgtctctagactctagagttcaaaagtctctagaggacatacgtctgcatatatatcaaccgtagtgaaaattattttagctgtttcagaaatcaaattattgtagttgagagagtatttggccatttctaatcttaatcaaccattgttgagcaaattccaaccatataactgtccatttgctcaatgagatctatgggctgagagagagagagagagagagaatatgttcaatagcatacagcatgcaagttaaattctgatattggtcaggaaactgaactaaatcctttccaatccctgcttatcttagcaaagcctaaacagtatgagctttctaattcatcatataacagcttaactgtgtttgactttgacctgccctccaatcaagaaaattgatcatttgcatctcatctcatccacctgtggcaaactacaacatctcttcccagtattccccatcatccctgacatagtgtccctagctgtagcatgcgtgggcagacaacagcaccgtgatgttcctcctcatcctccaccctggatcgagcactcaacatttcaggcctctgcacctgcatctagagctcactaccagcgtctaggccctccagtgcaaggtcctcaaggaaaaatacaattcactgcttattcgcaatcactgtgaaaagaaggcccctagaaatgagcaggtggattggtccatggctgctggtggtggtactaccactgactaccgaagccgaaaatggtgaaattgtgccaccgaatcaaattccttcttctcagtcaccattgcagtttaagctcactgtcaccattgctgcatgggaggtgaggtgaaggggaggaagaatggggatagatggccatttcagaccagaagtggcaaatagtcaactgcattgtgggcagagtggcaagtgatcaattgaaatataaggagctggaaacgattaagaaccactgtgaagagtggaacaatcaaatttccccagttagtgaggattccatctagttaatcttaatgccactaacaacagctcccaagcaaacagagacatgatagggtttgaatgataagggtatatttgtctaatctttgattgttgaacaaaatgtttatcacttaatgaatgccactgtttctgtgcttgttgttgcattgttttgtacttaaaattattggcctgccattcactctgcatgtttgattggatttcgcaattacatggttcagagctgcgaacaatttgatggcgacagatcagtagcccacatagggagtaccttttactagaatttgaataaatatagactagaatttgaataaatatagactagaatttgaataaatatagaatgctcatcctcatccacagtcttagaagtaatgtgttattaggtactattgttgaggtgtatacatactctccttgtcgaggtcgaaggtggtgaggtcgcggaagcaggcgcgggtgtagtagctgattcctgtcttggggtcgtgctcccaatacttggccgccaaagcactgctcctcgcccgcctctccttcacctccggcgtgtccagaaacgacggcgcccgaggccgccggggcttctggctctgctcccgccgcctctgcttcgccgccgctcctgcttcatcttcctcctccacaaacaatggaagatcaaagctgtcctcttgctgctccgccatggtacgcgcggattcagtcccaaaccctagtccataaaattgaaatagatcggactgaatcagattggaagaaaggaaggaaggaattagcagatagcaaaagcctcctacctcctctcctcctcctcttcctcgtcctcctcctccgccgccgccgccgtcaccctcgcgttggggtccgccgaccagccagccgccaccgtggagatcgatcgatcgatatagatataggagaggaaggaagggagaggttggatgtatgggccgtagatgggcccaaattcgttctgtttcatgaatcatgagatgagaggaataaggaataagtctattttgcttacctcaactcatgcccctagttgaatcgcatccattaaccacaaaactgggcataacatgtccccccaactcctaaaaccgttgcaaatcgactccccgaacagttttggaggcggttttatccctcgtcaagagccccacttatcaagagcgtcccacctcatcctattctcttcctcacctctccccccccccctcttctcttccgtgatccctctctctctctcacacacacaccttccagccacccgcttgttggttctgccaccaccgcgctcgtcgctttgctgctgctgcggacgaccttcaccttgcccccgccgacctctagtgaaaaaggtttttgattacacaaaatctaaaccgagagcgctctcggtttcgctctatcgcgacgcgttttggagccatccgattgcctgcatcgtcgtggcatctatccgtgcgggcctcccagacctgtctccgtggataaggatagagacgagaccacttaggcctctcacagtgcggtgaactggaccggtgctataccatgccagctgagatttccgcgcacatggcagatggatggtgtaacataccgaaaattagctattttcttatcttgcatcatgccaggtcttatgttcttaataacttcctaaacctaggaaaatataattagcgagacctcccaaagctaacctgcataaaattcctctttgatattcaaaagcccttgtgattttcatttaaaatttatcttgaaatattccttgatttggttttaatctaaaaccttctttcgtctaaaacttcctttatttaaatttagtgtgaaaaaccctttttactattatgaattatggtccaagaaaccttcccatattgtcctagaacctaaaccaaagtaattccaattttattggaattaattgttagcccatcctttgatcttaaacccatcctttgattctatctaaattcctccttttgatctaaccaccaattttatctctgtggcttgatttcctcttcggcacacgaataatattattaaaaatattatgaataattgctcttgtgctaagagaatagactttatccctccgtccaaaatccagaacctcatttagcccatatctaattctctaaatttcataccacatattttgggctaaaattttatttactctactcccaccatattccctccacatactcaaaaatattcaaatctagagccatattatttatggtgttgaatattttgaatttctatttgagtgcattaaataaactccctgtccaaaacattgcactcaaaccaactagagaaatatttcttttggaaattatattcaaatataatttccttctaaactctctctcagtcaattttccttcaaattcaaattattcaaatcctttttcaaaatctagccatccaaattcctcgaaatctattatttgaatctctaggaaaattagacttcctcctttttaactttgggccgaattcttcttctctctcgcgcggcccaagtcggcccatagctgagccgcccctcctcctcccgcaagcgcgcgtgccgtgcacgcgcacgccgccgcaaactcccttccgtcgccgctaaggaaacgaagccggcgccgtctccttctcctccactccatcggcgccgtgacccattcatccttctcctccgaactgcctttcacccctataaatagccggccatttccccccttctctacatacaactcgagctctctttctctctcttttgccatgtccggccattagtgccaccgctcgatctccctcaccagagcttcgcaagccaaaccctcgcgccatcgtgttcgcctcgacgagatgattccatttttcccctttcccctctttcctatccactccatcaagccaccataaccacctcctttgcagccgaagagaagctcttctacttgccgttccggcctcctctcctaactccttcgctgggcgaccacttccccgggtgcgcgttgtccggtaacacacttggccgccgccgtcgaggccgttccaccatcggagcaccggcgccccttctctctttctctctgctgttgcacgggaagaagaagagaaggaagaagaagacgggaggaagaagagaaaaagaaaagaaaagaatctccctgacaggtgggcccatcaacagtagcctttcatatttttcttagttaattcaaatcctatcctttagaagcacatatctcctaaaccgtagatccgattccggtgaaatttggacctaaattcatcttaattcaaaagctatattttgatatcaaatttgctatttgatcattttatttgataccgtttgaatttatatttaccttttcaaatatcttcttttagctcaaattaccctttgccactaaacaaccaccgtttgaaactttacaccttccatggggacgttcgtacggtctactgaccccccgatgtcgaaccgttggttgtaaagtcagacaaaacccaaatctaaagtcgaagtgttgctcctaacaccttacgcctcaatgcgtataacgttcagagcttcactattcagtcgacctcaactgtacaccacacagttagcttttaagctctgtgtaatcctagccgctccgtcgctacccacggttgccggagtaacacttccgccccactaaacctgcacccacctcctatttctctagctgatatattgtccaacgatatcggctagagaagataccaaacttagtcgtcatactacccaattctaatgacgactagcaaatacccaaaacccttgccgatgtttatcctacctcgatatcggcttaatcaaatgaaaccctagccatccagcctgctattcaaactccataccagccatttatcctccaactacccatagcttaaacatgaaatacgagccgatatgctatcctatttcagcatcgactcgagaacaactaaaccctagccactattccaccaaagcctaatcttgattccctcttcaacctagcctccaaccaactagagcctacgcataaaatactatctcaataacccattaaagagatagttataccccaaacctagcttttctcgcctttcatcattttcttgctattttatggcttttattgaatttggttattcctcttctttaatagagtctattttattctggatggcaacctgtggtatttcgagcatcggataatcaggttgcctatcttggatttatttgcgttggagcaaggcaagttattattcctctcctttgagtataattatcctatactctatagctttattctatgcattagccattcatgattttgaatgcataacctgaacatatagcaaaccagatatatgctagattttgcttagccatgcttagttagaatatgcataaaatttaatgaacttcgattgggacagtacgtaagatttggttgatttccgggtggctagtactgtctcgatcgatataattgccaccgaatacttatgtcaaacgaacgagtacgaccgcagcttctagaatggggatagacctagttattaggttaattaacaatgtggtatctctgtacagtggttcttatctaagtcctcgcgaaggaggcaaacttatgccgcgaagggcaaatgtgatatttaccgaggcgcagataaatatcttgattatattacgatcgctgtgtgtgtgattttatggaaacctggttgagatgacgtggggtctctcaactagttctctctaaaaacctcgggaacaccagaactcctctcgctgctgataacgttacgttcagagcgcatggggactagagtttatggaacaggggccactattgttaataacctaaggctgggctacgactaagctaatgaatattggcaagtcgtggactgcgggtaaagcgtacatttactgcagtaaagtgaaaatgaatctattcgaatagccatactcacggattgagtatcaggactcatggtatttggttagaaacttaattcaagattttactaaatactgttgcataaagacatcccaagctttctttctctattctcagctttcagccagtaaacctagatctacttaaatactatttcatgcattcattatttgatataatagcttgctgagtacgttgtactcacccttgcttcaacctcctttttaagagtccatttgatgttcttgccgaagtcaggagttcaatcacataagttagttcccttttaacttaatcttcaagtctaagttatttagatggtttaagtctatagtaaaacagcaaagttgggtcattctaaagcttctgctgtaatagttagccacaatctcgtaaataccatattactttatatatccttcaaagctatgtctaaacatatgcaaagacgatccagattattgaagttgtatcaacctactgatccagggcttgatacagttaaacatgtcggtttccgaatcattagttttgggacccgacagatgcgcgccctagctgagctcctcgccccgaagcagagccgcgtggaacctggtccaagcgagggagcgcgcgttgccgaaagtcacgggcacgcgcgctgtgggcagcgtcgcctcgctctcccgtgacctcgcgcccatacctcctggtgaaatcttcgatttgccctccaaaatcctctcccgccgcacctatttccttctttccgccaccgaaacaccccaagcaagaactcgatccgtcccaagaacacaagaggaatcaccaagaagcaaaagaaacaaagaaatctcgatccgtcccaagaacacaagaggaatccaggccccagatctcatattaaccaatgaacaacacatctcacatgcacaaaaacaacactcaataaccggagttggagccaatccatcattagatcaagcgcagccaagccaagaaccggcggccgcacgccgccaagaaccggccgcccagaaggtgccgccaccgccgcccgagacgcctcccgccgccgacttcatcatagttgccgccgcgccagttgctcccgtcggggacgtctcccgctgccgggccagccaccgcgcgagccggcaaccgtggctgccggagggaggagaagagaagcagagccggcgccggccaccggggacgccgcccgcttccgcccttctccctcgcccgcttcctcctcgccgccatccgctcccgcccttctcccgagcccgcttcctcccacgcgtgagagaagagaggcagagcgtgggacagagagggaggggaaaggctcgccggtgcgcgcgatttcttgcgacgaggcggcaccgtcaacctcaccgttttgtgggaggcgaggaggcgcgcgagcgtggcaggagaggaggaggcggtcgcgccgaggaggggaggcaaaaggctcgcgcgagtagtaggcgagggtagttgagagaaataattgtgtggtaacgcgtctggggtcacgcccactgtgggcttggtaccctttactagtgcctccattcaattaaaccacacaactagatgtgcttgcactatggaatgggtgtctctgggccaattttttaggcgaggggtacgggccccatggcttgcactgtgagaggccttagaacaagtctaatagtacagcccactactagctctaattcatctatagccaatctaatagccaattcatacaatagctgcttactatactattaatatatggtcccacctgtcatacacgcagtgtatcttggagtccgtgctgcagctggctacatatctgtagcccgctgctcttctctctcatcgtttatcttattaaaatatgtttatagctggctaatagcctgctattgtacctgctcttagactgaacgtcgcactcaatcccgcttcactgtttgaaatcgggagtcgcgtctgagagagagagaagcagaggctgcggattctcccccaaatccctcgacggcgacggtgtcggcgactgctggcttctgcggaggcgacagcgactcatccaccgagcggagaggggcgacggtgagcacaaggtcttcctcgttgttgtcaccaggcttgaggcgagatctagcaggggcgacgaccatggcgagcgctaggctgagcagtgaagcgcatcgtgcaaatcaggtagtctcatctctttgagctcttctgttggctactttagttcggtgctctgttgccgtacaaacatgtttaaggtcaaattagtgctcacatatctctccatcccttttacttctaattttgtctaatgcaaatcactgaggttccctttttggtctgtgatttcaattggtttcagcaccacatttggagattttcacacggattttgggattttgtcatatgacctatagataagttttctgtaaatgcattccgtgaatgcctctgtgcaattatgtgtgattttctagtgcaaaaaattaggatgtggatgtcatggtgttggaattcgacccaaattagtactttgctttaaaattagtagggattacctttgtgctatgtattgttggtgttaatttagtatgtgtttacttgctgcatgcacaggattaggtcgaggaaccctgcatggtcaaaattttgtccatgaatttttttattttagtgtcgagaagcctgataccatagcttgtagttagttgtttatagagcaccatggacgaaggcttgctcgggttagagggaatggatgtacttataggtcactggttttagagtagatgtttttatagggcgaatggaattaatgtgcttaacttcagattccatcaggaagatactagaaaactatttttctatgacgtaattttgcttactgtagaagtaactttaggtgtaagtggttgttaacttttaggtgtaaatgatgaggattttttttttgttgcaggctatgagttcagaaaaaatgcttggtattatcatcactgaaatttttacattttggtcctttttgaaaatttattttacaaatagacccctgaaaaaacttaaaccgggaatggtcctttttgggacgccagagaggctggcgccgtcctccaacatagcggcgccagccacaatagcgccgcggccgtgccaccgtggcaccagggcctacgtggacttgctgactcggcagagcggggcgccagccaccctggcgccgcccctcataccacagcgctagcttgtctagcgcacccctcctctgcgggccccaccaactttctcccccccaattttcgccaagtctcttctgtctccgggcaatggctggcgtccccccccagaccgcggtgccagccatcctggcgctgcccccttcccccacccgaggaccttctgcctctgggccgaggctggcggcgccctcacagaccacagcgccagggtggctggcgccgccctcctcccccccgaaacccttctgcctcgcggcactggtgtaacgccctgaaaatcgccctaaatttaaatcgtgctttaatgcatttctagaaattttaaaagcctaaaagagcttccaacaattaaaattcaccaagatttatatcaaattggcttgtgggtatttttaataaattccccatgcttaaaaatgtttaactaatttttacttgaattttcagagcatcctaaatatttttaaggcaacaaaaactattaaagaattttataaaatggaaaatataagagaagtcctcttcctcctcttgggcctcttctggcccatctctccatctctccctctcttggcccagccgccccctctccttccctctctcccctcccctccctctccttgggccagcccagctcctcccctcccgcagaccgaagtccgaagtctgttttgcctcctccgcgcgcccagccagagacagctgtgctccctctcgatgacaggtgggtcccactcgtcatccctaacctccagccatcctctctctctccggccgaattccaagcgacggcaacctccgattcgcctcctccacttgccgtttcatcaaattaattgaggggaattaattcccacctcatcctctccaatttccccataatttcccactcaatcccgcattattcgtggtggattttgatgatgttctttaatggtgagctccaccatggccggcgtcgatctccctacccggcgtctctctccctcccctccggcctataaaagggacccccgactccctcctctctcccctcacaccgccgccctctccctcctctctccgcggcccacgtgccgctctcttcttgtgccgccgccgtcgcaactccggccgcccctcgccggtggtcgggacctcatcggagcccggcgtcgccaccatccgcttcgccgcttcctcctcttccccgtccacccctccgtggagcatgacgaccgcgggaacgacgacgacaccgacgacccgaagttcctcgccgtttcttcctcactgccgacaacaccgtcgacctctcgccgccgtgtctgctcggtgcgaaccgtcgtctcctcccctttccgtttttccccttcccgtactccgtcgcaccgtcgccgcgccgttggctgtcgccggcgtgccgcctggctcgggtgcttctccttcccggccgtgcttgtgcgccgtgagccgccctcatggtgtaccgagcggctgccaagtaggacccgcccgtggacccctctctctcttctctgtgcaataaatcaatttcctttagaaaaataattcacaaaattacaaatttccatttaaacagcacataaacttcaaatggccatatcttgactgtttgaactcggaatcgacccgttcaaatctctaatttctcctaaaaatgagtagaacccatttatgtgtttattgcttctgttcatatggtttttattagcctttttgtatttcttcgcattggtcgtgtagatcctgccgttccggaagatcggctcttcatcgccgtcgacgtcgaagactttgtgagtgatcaaggcaagtcatatctaccttgaacatgttgaatcccatattgtgaaaattatgttgttttacttatattgcattgctttataaattatatcgttcattattaataatgttttattagttattcctatgctcttggttatggccatgatgttgatttgatatccatgatctttgtgaaccctagtaaaattataacttgactagtctagtaccctacatgatggactgactagttgctttaggtaaatgcttagttatgcttagttccaacctagaacttttggttaaactagactatggtggttaacaactaaaactggattagttatggactattgacgggtttgtcaataggtggtgataaaatgctttgtgcaactaaaatatatttttgggttgggctcagggtctaagctagttactttggtagtcgcaccccggctaatataaggaccggtcttcgggcctctattgcaaggcatcttcgtgcaaccacaagtctagtgggtaaggcctgactggaagtttagatcttctcaaaacagagaccattggttggaagggtgtggagccaggattaaggccgttttttcactcggcgcaagggggggcctgtctcatccgggggatccgacaacctttaccttgtcggggaccagcgggcggcgaaaccccagcaggttctcctattttgggtagacctagatggatagtcttgtcacgacctctatccgagtaccgtggtggtacccggcgcgtggcaacgcgtgttgaggttgtgtcttgtgggtaaagttgtacacctctgatcaaagttaaaaactattcgaatagccgcgccctcggttatgggcaagctgagcagtgtacccaaagttagttctgttttacaaaaccttgggtgggtgaaatcatgatggtgtagtcatgtggagattaaggcaggttcgcaggctcatgcgaccttggtgatattataatattggcttagaataggatcgtgttttaaaatgtgctttaacctgattaaaatgtttaaactatggctttatgcaaaataaaccctattaggccatttccttgtttctccctatgcattattgttgcatttctggtgtgacttgctgagtacggtggtggtactcactcttgctcacaaaaataatccagaggatggacctgaggaagatgaaggcttggatctctagttcactccgccgtcgagtgcctgtggctgctgctgttccgtagtcttccgctgttttatttgtttatctttgagtgcgagggcttgagtcgtccatgtaataaagtacttcctttacacttccgcaagtgtggctagttcactccgccgtcgagtgcctgtggctgctgctgttccgtagtcttccgctgttttatttgtttatctttgagtgcgagggcttgagtcgtccatgtaataaagtacttcctttacacttccgcaagtgtggcttgtaataatcaacaatgtctatgtgtaccttgcctcctgggacgaggattaatgcactgagcgtttggaaatggtgtatatttccgggcgtgacaactggctggcgccgccctccccaactgcggcaccagggtggctagcaccgccctctgcctccctgcaaaatgaagatccatattgcacaaatgtaccaattcacagttcgcaattcaaatcacaattcacagtttcatacagactaaaaccagttccaattgcacaaatcacaatgccaaaagtccatcacatagtccatctgtcacaccctgaaaattcaaaatatataaattgttgtttaattggaattttttagaaataattttaaaagtcttgaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaaccgctctctctctcctcggcccaagtcggcccagtccaccgccgcgcgcgcgcgcatccgcccgctgacaggtggggtcgtcgtcaacctccggccgccgccgcccgaaaccctagtttcgcgccgccgccgttcctttccaaaatccggccgttccttttcgtttccggtgaaattgattgaggggaaacaatctttgggatctcctctaccttttctcctttggaaacatcggctaaatcggtttggaatgtgtttgattcgagttcgaatcggatcggtctctttcctccgaaccctaaaccttccttctcgtcgccagccgccgtgggccttcgccgtcgcctcctagcccctttaaaaggacccccgagctcttctctacccgccgccaccttcgccttcgcctctcgtcgtccgtagcgccctagcgccgtgtgccctagcgccgccgtcgccgccgtcgctccagctgtgcgccgccaccgttccagacgtcgccgtcgctcgggaagaccgccgtcgtggtcgtcgtcgcgtcgccgtcctcgtccgccccttcgccgtcgccgaagatcgccggagcaccatcgccgccgtcgacccgaagaccgccgccgtttcttcgtcgtcgccgtcaccgtccgttgatcttccgctgctcctttggtcaccggtgagttcgccgcgtcgcgctctacccgttggtgctctccgttcgtgccgaagcgccgccgttcgccggcgagcatgcaagcccgagccgccgagccgccgccgccggtggtgacgtcatcgctgacgtcatcgtcgccctcttccgtgagccggtcgtagaccgatcgatctcggccgtccgttttggatggatcgatcccggccgtccgttcgcgtgaaccgtcgcccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgttttagttggttcaagtctctaattttttctaaaattgagatctacatgttaaaaatatccacatgtactgttcatgcttgtttatgtgctgttttggtgattttgctcttttttgcttagattccgtcgtttccggagagtccgttttcgcaggagaagagtttgaagagttccaaggccagtaaggcaagtcacacagatcccaaacaaccctttgagcatgttgatcccgtttaaagctactgtttctattcaaatattgcatttattttcgaatgtcattgggtggaattaacctattgtttgttatagcccttttgttcttgattactttattccttgatacctgtgttattataacttgactagttgagctttacatattggttcagctagatattagatgtgattgcttagccatgcttagaaacattagcacattattgggataacttatgactcactattatttaatgatggcttaatgatagttcacgatggccaatcgtgattggttaattaatgaatgtgccaactaaaacttgataattgtgggttgtgagcacatggttttgagagtcgtgctcatgacaattaaggaccggttcacgagtttcggttgtgaaacattaaccgtgccaaccacaagccagcgtgggcaacgactttatcttttgtatagcatggttcattgcggggcaccagactgagaagtggcggagataagcccacgggggtcgctggggagtccatgccttgtttttaagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgcgcccgcggttatgggcaggtctaacaatgtctttcgtgattagtttcacacttctcaccataataaaagatgctataactggtaataatttgtttagctcctggtttggaatggtatattcctggtttggagatagaactgtgcagctgggatggttgttcagaatggttgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagtcttagtcaagctgcttgtggagtggagccgtccgcgccgtttattttattttccgctgcttagatctttattgattgagaggaactatctacctctgtaatgacattttattcgcctattaattggagtaataattgtactctattatcaatttgttattgtgtgcctcggctgattcctggacgagggttcacacacatgtaagcgtttggaattttggatagaaattccgggcgtgacaccatcacgtattccacacatcaaacaatgccaaaagtgagaatgattgtttacaattctttcatctatttgacatgagggctagagggtggtcttggagcaagaaaagttgggcaggattatggtacgactgagactgagttgggcaggagcaagcgggttggattggcctgactcttcaataccaaagatactcggcttcctcttcatcaagtcacgaaattcgacccttagttagctgcaccaaaactagagcaggcccaagacaagcaagaacagtcagtcagcaccgatcaggcaggaagcagacagtaagctaagaatactggaagaaggtggtcgctcagccaaagccctagttcaaccagaacagtggggaaagcggtagaggctgctccgtagctttggtcgtcgcactctaatccgctttagaagaagcagctattctattggactgcttggctataaagcctataagtaagaactctggggaaggaatccgcagatgaagcagaagcaggcaaaaggcgagcgcacagcgaggaattttccatactagatcgactcaacattaccaaatctactctgagactctcttctcttcatggttggctgtcaaaaaagagtctctttagtccccaactctatggattttactttttggctcaacaccctgctcttgacgtttgctcgggacgggaggctatgaaatagttgaaagcagatgcaacattaaagaaagtaaatccagtagccttaagtcgtaccgaacactatgtcctaatagtaagggatttctttcaacccggtggtaccaggagaaaacgttgcccgaaggaagggactaaacccatctgttcaagtagtagccaagtagtaccgaaggagtatctccgagttaaggagtaccgaagggaaggcagaaaaaccaagtgaaagaaagagatcgcaatggtctaagatatagtcagtgaacaataactcagatctgatgtcggatcgaaacataaatgcaaaaagacaacataaatgtaaaagatcgaactctaatttagttactgagtgagatgttttgctacctacaaaaggttggttctgttgatatccttgaggagcatgtgtcattatctgcaccggcaaatgatgacagtgatgaggtagaagatgtgtatggtgagtcgatactaaagcaatcccggaatttttcattggatggcagtaaagagtctccttcgttacctacgtggtacgatgaatctcgccttatgctaccaaggtggtagttttcatttagttggatacagcgatgccgagggatctgctgataaagatggacgaaaaaaggcaagggtatatgtttatccttgaaggaggctcaatatcttggtgcagtaagaaagaagattgtttctctttgtctaccatgaaatcagaatatatagcatgcacggctgcagttcaagaagcaatatggctgagaaattatcttctctgtcttgatgtgactaagcatgcatatgagacaaccgtgatctactgtgataacacggctgccattcttttcttctcgacaaatatcataccatgggctgtacaaagaactgaccatgatctcttgctaggggaaggtatgtatcgggacaagatggttggtgaggtgggcgcaaacacttttcattccaatccctatcgttgtggttggaccagactacatgccaagaccctttattccaacattttctcgctgacagctccttcaacttatttttctattcaattgttgctttcacaatcaatcactaaccacattcttgcaattcatgtgcggttggcatctattttagctttttaaagagttgactcgtcgggcatgcttggccttcttgtcgccttcctttgttcctcttctttctgcgcagatacttttgatccactcctttcctataccgcgccctctgcctattacggtcgatacccagaaagtagtttccttgggagaagaggcagttcacaaaccagtactaaataaggaaaaatgtgctaatctcatcgagaaagaagaatttttctaaatcacttcgggtgagcggggccttcaagcatccgaaatatgccggggttgtaaatgacatagccttcctgatagaaaatgacggcccgacgagtcatctactaaaaaggaccctccccgctgtgcgcccctccttgaattattcggtcatgcaatacttttttaatacaaagaacaaaatgcatttcgaccccgtcgtagttctcaatcatttcgtggcaccgggtgtggctgaaccatctacgatggggggagcgaagggaggaagcttagataagagaatacgctctcgcaacagattcaatagaagaactcacagccaaaacaagcgaaagaggaagggcggaacatggattgcctttttttcctaactatcagaaggtcgttgctgtctttttcgcattggatttctttcacgagactcggaaatcaagaggatgggaacgactactgctcaaacgcatcggactgaaaaggagggagactctcaaccagagccgttatcacatattccacacatcaaacaatgccaaaattttacctcaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaaatggggcgtgctccatttgatatccaactctagtccggacatcatagggattccgcctctcatcggagtcgcggtccttctctatgtcggcttccgtccaagtagggcggaggaatagtctatatgtcctatacagccaactaagctactctgagaaaagatgattttggtgtattgtcttgatgtacctgtcgttccttccggctgtcctccattcatcaatgtatctgttatgctctagcccccagtctttcaccttctttgttctcaccctgtcatacctagacaagtggaaggtgatgaaacaatagtgagcatcgacaagggttaaatggtacaaagttgaacattaacaatgaaagcaaacaaagataacaaatatttacttgtgtaattcaactccagttgagatgtcctcaaccagacagtcttgtttcttcccgaactgtcgcatgacacggtgcggaaagtggtactcaactgctcagaaacaaatcaatgggcactggtacatgaagtagtcagagtctcgattgcacatcgagttcagggtcaggcttgaagcctcatttgtgtggtatggtaaccactcaatctgcaaaagttgaagagatgacgttggttagtatctcaattaaagaagtaaatgtcgaagtacaagtgatattggaagtacttacatgttgaggctgtaagcagtccatctcattgacataatgcttgtatgccacatcccggtgagcatgtgcagtggcagtactctcaaacaggtaggccactgtcttctccatgtctggctcattgtagggccaaggagtgaaggttttgcctccacttaggccttccaaccggtagtgttaaccacatccacaactgaatcgatagcacacaaccactcatgttggatgatggtgcctgacgacaacaggcctcacagagctgtctatatgtccacgccaacactgctgagccccaactgaaatggcccagatcaccaaggttggcgaccaaaggaatccatatcaccgaagcaatgtcacccccagcatcaggaaacagaaccacactcaacaagtgcaagatgtatgcacgagcataacactcaacacgccatggctcagcgtcgtcgtcaagatgtgagaagttctgactcagctaagacaggggtattccattctgcttcttcttgcccccttgcccctacttaatgttgagtggaatgccaaacaggtgctccacttgtgcacgccatccaggattctctgtcctgcccgtcaccgcatgcccccgtaatgggagggccaagatcatagccacatcctatagagtgatggtcatctcaccactgggggggtggaagctgtgtgtctcaggcctccatctgtccacaagtgctgtcaatgcaggagcgttgaacactggcattcctctgctcatgaccaaggccaccccgagcaacccgaccgcccttaggtacgggatgtaccttttgtcaaacactgggggggcatgagttctaactcggagcggttgaagtatctgcattagcaattgtaaatcaattagttaatataatgtcaaacacacgctaccgatacttaggtacaagtgaatcaatgccgattcataccctccccgcctcgatcgcagccccgcgatgacgggcctcatagtactcctccaaggctgggtaagtcggcggttgtccctccttggccatcctacatgaaaaagtaataaattcaccgttagttatcaacatgacataacttaaaaggaaatgaatgcgagaatccaaaataaataaatagacattaaatagacaagaataaaacatgcattgacttaagtaggaaaacaaaatatttacctccctaacacttctattttatttttggacttcttcttttttggacgcttaggacaattaggtttcttgtgaccctcctggttacacaacgagcatctattttgcaccggcgcagcatctagttgaacacatgaaggtggtttccttctagaaccaccaagacccgagtccatttcgttcttgaatcgcttcgatctcctcttccctcttgttttaatcttcaaatttgggtcagcaacaaattcttcaccatcgtatggtggcaactatgtggggttgaggtatggctcaaagcgacttgcctatgtgttcacaacggctcttgaagagaactgatacggcattcggttgggagattcctcatcaattgcatgaatcagataaacgtggatgagatgtgagcaagcatatggtagagcaatggcctttggtaagaacatgagttcccctcaccttcatctttgaaggctcttgcaccgaatctaacaccaccacgcgttataccacccctctctgtgacctcgtatgtctttttctacttatcgaaacaccttgaagtgtgtttgttagccttacttttttgcaccttcatcttactagcaaccttggtggaccaacgctcccataactggactcgcttcattgcttcatcatgtctgttcacaaagtaatcattgaacttcatgaaggtaaatgatactatggccgtcactggatgcttactaacaccaactagcacgctattgaactgtttggccatgttggttgtcaagtaaccccaccggcggccatttctatcaagccatttacgaggaccttcgggaatacgctgccttagtgcctcaacatccctctcaaatatccacttctcgtcaatctgacatatccttaggagctcttttgtctgatgcttatctgcaccggccttgtggaaattagcactgaagtgcctcatgcaccatcggtggtgaaccggtggcaatcctggaacaggagtcctcatggcattcattataccagtatgtcgatctgagataatacaaacctccctgtgctgcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtattttccagttaggaaggttgcatttatagctagtactggcctgcaatgcttaaaagcctcaatggaaggaccaacgcaccagaatgcacgcataaaaattttcttggtcactccatcaacgttgacaaccctatcaggatgagtatcgatgtggtagaccatactgggatttctctgcttaatggcttgtagcaaagtgggcaaacggacgtacgcttcaccccattcaccgtaaatgagcttcatagcctcctctcgtgccctccaagccttgccatacttcgcccatcataaaacgggggatcc

SEQ ID NO: 58550 - DNA, 5093 bp, Oryza sativa
agttctaggatcgcgtttacaaaaaagccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaataatgacgccaaattttcaacgcatgaactactgcagctaactcaatatcatgagtagggtagttcttctcatgcggacgtaactgacgagatgcataggtaaccaccttcccatcttgcatcagaacacaacctaacccaagtttggatgcatcacaatacacctggaaacccttttttggatcaggtaaaatcaagataggagctgatattaagcgattcttcaactcttgaaaactctgctcacattcttccgaccacttatacttcacatctttctgtagcagtcgtgtcatgggcttagtaatcttggaaaaattctctataaacctccggtaatatcctgcgaggcctaagaaactgcgaatctctgaaactgtctttagttgtttgcagttggttacggattccacattactgggatcaacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctcttgttcgagagtagataagaatgtcatcaataaagaccaccacaaacttatctaggtattccataaacaccttattcatcaagttcatgaagaaagcaggggcattggtaagtccaaaagacataacagtacattcgaacaatccatacctagtggtaaaagctgtcttaggtatatcttcctctttgattctcaactggtgataccctgatcgaagatcgatcttagagaaaacagtggcacctttaagctgatcaaacaaatcatcaattctgggtagtggatacttattcttgatagtcacatcatttaatgcacgatagtccacacacatcctctgggtatgatctttcttttccacaaaaataaccggagctccccatggagatgaactcggtctgatgtatcccttctgaagcaaatcatccacttgcctcttgacttctgccaactcattggctgccattctataaggcctcttatgaatcggagttgttccaggtaccaaatctattctgaactctatatcccttttgggcggcataccaggtaaatcatctgggaacacatcgggatactcccggactataggaatctcttccaaagttatctggttcagtcttgaccttaaagactcagaagataatgcatgaacagttacaactcgaccatcactactggtgagagttacttttctgttagcacagtctataacacctttatgtctggttaaccaatccatccctaggatgacatcaaggtctttggattctaacaagataagattggccagaaatggtactcccttaatttctattctgacagaggggctacgttgcaaagagagtgcttgattacttggggtactaaccatcaaaggacgtctaagatcttctacttccatcccatgatttcccgcaaaactcatagatagaaatgaatgtgtagcaccagaatcgaaaagcactgttgcatgaactgagttaacagggaacgtacccaaaatcacatctggagcgtcttgagcttctgcagctgcaacatgattgacacgggcctttgatgctggtatagtagagttgctctaggcagggacaaccttcacgcgtcggggctttggacacttgtcagcataatgtcctgggtctccatagttgaaacacaccacgggcttgctgccttgctccctcttggcaggcggttgttgtgttggagctgcaacaggacgtggagcttgattacggatgttgttgccagcattgttgttgaagaactgacgctgcggacgaacaacagatgaagaacctccatgtggcatggactggggtacaaaagtaagacgcggcttctgattattcccctgttgtatcttgaattgagcaatccggcgtttcttctgctccatgcgattatacttgtcctcctgacgaatagccttatccactaatttctggaaattagaataatctccagtcatgagtgggtaagaaagctcatcattaagtccttccaagaacttctcctgacgctcttcatcattgcgcacatcttctggagcataacgagctagacgattgaactcgtgtagatactccgtaacagagcgagatccctgggtgagcgacctgaactccttcttcttgagagacaccactcccgatggtatatgcgtcttccggaaagcagcggtcaattcaagccaagtgataggttcagcagtagtcctattcaggcggaagtgatcccaccattcagaggcagggccaagcaactggtgtgatgcaaatgagaccttctcctgatcagtgcactgaagcaaatccaacttcttctctatggcatgcagccaatcaccagcttcaacagggttagtggtactagagaaaataggcggcctcacacgaagaaattctgctaacttattctgaggaggtgcatggttatttccttggttctgctgattctgaagttgttgcatcatcatgtgcattagctgagtctgttgagcaagaacttgagcaagggttgggttcccttcattgttattgttgttgttggggttgttgaggttgggaccattcccgttgctgcgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcagaggcaaacaaacgcatgcacttacattccaccactgatgtaaatcacatgcaagacccacacacacaaccaaacttaaaacaagcaaactaacacaacgatctaagacaacggcttaacaagtcactctagttcttccgagcatcggaggtcgattgaaggctcgttcggctcgtcttcatcatcttgagttgctacccactcaatcttggaatggttgcgcttggattcttcttcttcatcatcacttacgttgacgaccggaggatctgctggggcaacttctttctccaccacacggacctttggcgccaattgataacgagggacaaatagagctctcttccttgcggtaagacgaatcctggccttctgcggcggtgcttctcccttcaacgcagctagttccttctccaaacgatccaccttgtcttctagcttgcaaatcttaccacgattccaatcttcacgatcttgggctgctaacacagtctctgcatgactttcatccatagcccatagcatctcaaccaaatgtcttgtggtagcatcattctcaattccttcagtctcaaggtaactgccacggtcacttccctgtggttgacgaggatggtaacgatactcagtgtcggccaattgatcactgtagcgatcgcggagctctcctatggcgatccttgccacttcctgacatgcatggatgtagtttcttcctccagcttcgaacatcactgatagaatgtcttcactattactgttcaaggtgactttgactcggcacctctcttcatgacgatcatgaggaatctgagcataaaaaggggcagtcccaaatccaatgacaaaggacattgtacgcaactcctggacaaaaccctcaacaccaaacaagtactcaggcttgtagcgcggcatctaaacacaagtgaaaggagggagttaagacatctatccaattaatatcacaagtttttggattaatttgaataaagttttagaaattcaaagtaaaaggtaagtaaacaaagtaaaccaagtttgcaagataagttgaaacagttggaaaccaggttacaagttttatacttttgaataacaggttccaaaagaaataaaagaaagttataaaatcaacttgttaaatttattttattgcagcaagattaaatgaaacaacattgtaaaatttttgctggaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttagagggcttctatgggtaaccatttggcataacctagggtcaagggagctctgataccaacttgtcacgcccggaatttctatccaaaattccaaacgcttacatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacggcgcggacgactccactccacaggcagcttgaccagggctacacctaatcctccacaccatcagcttcactgtagaactcttcctctgatgaataattgcaaggtgagtatatgacatactcagcaagccacgcagcaaatatgcaagtgcacaggataacaaaggatggcataatagggtttcatttgcaaaagcagctttta

SEQ ID NO: 58551 - DNA, 1431 bp, Oryza sativa
ggctctgcaactatactcctatacactttgcccgctgcttcttctttttattgtcattgagattttaaaaattgaatatgattatcaatggggtttattttttgtctttctagaagtcccggaggctctgcaactatactcctatacactttgcccgctacttcttctttttattgtcattgagattttaaaaattgattatgattatcaatggggtttatttttttgtctttctagaagtcccagcaaccgccttacccgtttgcttcacggcatgcctgtcgtccctccttttaatcgttattaagattctatttggtgttttattaacggtttttatatgtcgtatcaaccgccaccactctacttctttataggcatgttacttaatttatctcgtcatgtgttttacatgggtttcttttaatagtctttatttttttatcactaattttaattatttataaattatattcctaaatgatttttttctttttctaattaatcgtgtgttaattgtttaatgacgattaattgtatatgtgcagcagtgtaagctttgtttatttgacagcacaactcttatccgtgtaggtttataattgaattagattatacgtgtactgtgtacaccgccaaagaaacagaaaaggaaagactcctagtatgtaacgtacacagtacatatatatggacttatcttttctacaacaaatctatacagttaaaatctataattgaatcaaatgttttaattaatctcgtattgggttcttatgtggactcctcttacaatattgcttatttctaatttcgattttcagttattttttagattgtatttctacgtggactattcttttctttttcttcgattaatgtgtgaatttctagcctccacagagaacgtggtgccttcttttcgagctgtcttaataatataatagatggacaagtatgcaagttcagacgtagaaaaactaacaaaattaattaactgtgaatagttagcgcatactatttacaattaaatttgtttttctcctaaccagtcgtgtaaatcgaatgtgaacttatatatttaccttttttagataatgtaaatggataacatatccgatctctgcccgtaagcacacatcaaaaagtatcggaagtaaaaaaaaaggaattaaaaaaaggcgtgatgggacaaacccccaacttctgtcaataaaataatctaccaaaataacattttcaaaatcacatagattctattacaaaattttataggcactatgctatccaaatagaaataaaagttcattggctatcaatgccgagcgtgtagcatcattgcatatagtatcatgttgtttctgtgaaagcatcatacaccaagactgaagccagtcctcataatgtttaacatttttttatgttcaaaaa

SEQ ID NO: 58552 - DNA, 8287 bp, Oryza sativa
agtagcacagctatgtgccttaccaacccgtgatatcctccacgtgccactagacctcttagttgcatggaccttccatttgcaccatggtttttcacatttaacagtgtacttcctatttgcggcagaattgacaacacggtatggacgatggtgcacgatggcgtactcctggagccatagcttcaatgtgaccatggatgggaactctaaactctttatgagaccatccacctggaatggttctggcaactgatctaggttgatgccgccatctagtattgcaccatgggcatgtgttaggtccctaaactcaggaatatccggcttcctctcaaacaccttctcaaatgcacgccattcctctaatgctaacttgtcattgttagttagtggagggaatggacggtcattgtcacatcctgattttcgtttcaggatttataaattatttaataaattattattagaatttatattaaatgttcattaatttataagtgaagttaaatgtgggaaataaaatttcctaaatataaagcatggatggatttaatttttattaaattctccatggttaattatactctctgaaattttctcggatttttcggagctcaattcctaatacaaagagcatttcagaaattattcacatattaaattaatcattaaatggtctgcttataatttttttaaatacttatagtgttcaagtattttcaagatttttcttgaaattattcgagcattgaaagtatttttaacaattcaaagatcatttcagtgattaatttaattggaaaagtaataataatcctcttcctaatcttgggccctttccagcccatctccctcttttgtgtgcacggctgtgcagcccaagtcggcccagccgagttcccccttctctttctttctttcctttatttttcagccagcccaagacgaaagtctaatttgcctccccgtatactgttcatcttcaagcttggacagaagcccgagctgccgtcctgtgctctagccgacgccgcttcctccaccaaatccgccgcatcccgtgctccgtttgcaaaattagttgaggggaaatattcctcttatcctcctctaccctttcttccaagaatcggactttatcccgaagaaatcaacgcggaatcgaattcgttttcgagcttatctctccaactaaccctcggtttttccgactcaaatcctctcggttggagtccgatctcttcaatccaagcctataaatagcatccccttgacgtcctcttccgtttgccccaagtcccaagccgagccgtcgcccgtagagccgccgccgccgtcgccggcgatcctccggccgcgttgcgctgccacggtagccgtcgccgctgccgtccgtcgccgccgttgggtgcgcacggaggagaggaaccccgtccgccccttcgcagccgccgaagaccgccggagcgccgtcgccattgttgacccaagtcgagccgccgttgaacctcgtcgccggccgtcgttcgtcgtcgtccgtcgttgttctttgcaccggtgagttcgcgtcgtcgtcctcttcgcgttggtgtcctcggttagcccaaccgagctctctagcgccggtggtcgcgtggagcagtgccatggccggcgatgacgtcagcgatgacgtcataattcccttttcttagtttctttattagatgaaaatcgattaaacttcggaaattcataactaattcatcgtaactctgattcgagtggttcaagttgctaaatttttctaaaatcaagatctacatgttaaaaatatccacatgtactgtttttgcttgtttttgtactgttttgttgattttgttctttcgttttagtttccgacgttccggaggagagcgttttcgttgaggaaggttcataagtgtttgcggaagatcaaggcaagtcacacagatcccaaataaccctttgagcatgttgaacctgtttaaagctaatgttttatttcaacttatgcattattttcgaatgtcatcgggtggtgagcctttcccgattaattaatggccgaagatgactttattttcctatgggttataatttgattagcttggaccttatatattggtttggttcagctaaatgctatatatatatatatatataattgcttagccatgcttagaaacattagcatcattaatggggtgaattatactatattattaattatggttatatttaatggtagctcacgatggttaatcgtgtaatgttaattaattgagaattaaaacttgtcaatggtgggttgtgagcacatggttgtgaaggtcgtgctcatggcaattaaggaccggttcgcgagctactattgtgaaacatttaccgtgccaacaagccagcgtgggcaacggctttaccttttgtatagcatgattcattacggggtgccagactgagaagcgacgagaagtccgtgggggtcgctggggagtctatgcgtctggtttttgagggggtgattatgatccaggaatggtgcactgtggtgagttgtgttgtgcagggggtattgtcacagcctctattcgggtactttccagtatcgcgacgcatggtagacatgatgttgaggctgtgtcttgtgggtacagtggtacacctctggtcagagtaaaactattcgaatagccgtgcccgtggttatggacgagttgagcaatgtttttcgtgattagtctcacacctctcacaataattattgatgctataactggtaataatttgtgtagttcctggtttggagttaggtctgtacagccgggtatggttgttcaagatggttgggcctgtgcagcatgagtgtgctgttcagtgttaattaaaatttctgattaattactctactgttttacttctcttaaatctttgctaaatgctgcttttgcaaatgagcctatattatgccatccgttggtatccttgtgcacttgcatatttgctgtgtggcttgttgagtatgtcgtatgctcattcttgcaataatcaatcaatctcagttgaagaaaaaggatccagaaggagaagacgtttggcttataccccagttgagctgcctgtgggagtggagctgaagccatcgctagaccgttatttccgctgctgttgtttttcttttcttttgtaagtatgtaacgttattattatgatggatttgtatattaaattgtcagtttgtgtacctcggctgattcctggacgagggttttatgcacaaattagttcggaaattattagtgaatttccgggcgtgacagtcatcatcagagtcttcagcaaattcaacatcatattgctcaacacttgcctccttgtcaacctcctctctattgacttctactgagacagaatcgtgaccaccactcaattcgacaacaaagtaatcatctggattcacatattggcctgctacttccgtcgggtattcagggttgcctccgtacgacaaccaatgcacactctccgacaaatgttcacttagatcaagcccctcttgtactaactcccttttcatctccctcactgcatgcacatcatcactaccgcaatgtctctttgatggtcctgcctcccctaaatcatttccaagcaaaggtctcttcttctctccttccccctccaagtcttctcgtaccaactcagtcttacttgcatcccctccatgacgagaagaatatgtcacaaaattcttctcaacgtaatgataaggagatttgtttagatccaaattttctacggtacttaccaactttgatgcaaacaccactagagatctaaactgaagactcttttaccaaatcaaagtaaacttcccattccaactgacctatcacatttaatatatacttatgcccttgaccaacattgtatctcccataaaaacgaatctccacattatcctcggtccatccaagaacttctttcactcgtgaccttagttcatctagagctgggtgggtgggaaacaaaatggtcttaatgacatatcctcaaactcaatatgtgcaccaacataagattccaccactctaccactgtagtaaacacgaacaagtctatccatctacaccaaaaaatcaaatgtaactttgcaacaaaaattaaatcttcattcctaaacgtagtccaaaccgacatattataaccaatccataacttaaattgtcccaaagctactactctaaaaaaaatatttaatccacctacaactataaacaagtttactagtgcattacacatcgaaatattataaatactccgtcatacaacccaacctagttctaattaactataatcaatttctataatgcaaccaaaattttctccccttcatataattaatggttaaaagtttaacctataggctatagcatcaagtccatcaaattaaaattactttcatgcctcaaccctaatttttcatccatccatccaaccaaaccatccaaaaattaacattaccacatatatggttaaaaaaatcgtgacaccaatgagtacattgcaaatatgtagcactacaacaagccaatctcaagaacaaatgctaaaaatcacaaatttgggcaaaaggggggttctagggttaccctccgatcaacaaattcaccaataaaaaacgaaaaaaaagagggaggaatggaggagtctacctttctcttcgatttccacaaaaaatcccgcgaaaaacggcttcaaattgagtgagatttgaggtgaagacgtgagggggagagagaggaagagctgctgcgctgactgctcgggatgcagcttgggataaaaatagagagtgaggagaagaaagatagtaagacccacagggacccagggcgcggccaacagagaagaagcgcgccagccaagctggcgccatggtatgaagggcggcgccggtgtggctggcgccccccttctgcccagtcagcaccgccacgacagcccaagtgccacggtggcacgggcacggcgccagtgtggctggcgccgccatgttggaggacggtgccagcctctctggtgcccaaaaaggaccattcccggtttaagttttcccaggagtttatttgtaaaataagttttcaaaaaggaccaaaatataaaaatttcagattatcatgatcttttttttttccagaactatttgtatgctttatccaaggttccaacttctgaagtttttttgtcatgccgatagacacacctaggtgaacatgtagcattatgaggtcaaatgaccgatgctaaactaagtaggagtaagacaacagttaatttatgtgctgacagtagtaattattttgttttttatttaatttgttgattttttttcttttcccaactgtatataaatttaggatacacggaacgaagaacttggcacataaagggacgataggcacctatggtggaggtggaacaagctaaacaatagggaatgaggaaccgcggtcatgaggaaaaccagggacaagaagcaaatgctagaacatgagaagaaaagagattttggagaagatcatctacatttgtacaacaacccactccaagaaaggtctagaaagaaggtattaaacctgtcatttttttctttttttataagcaaaatggtgttgcaaaacaatgtgatcatgtagaaagtaacttatagaagcatttgcgaagcaacttttatatgactaacaagtaaggtttaggaagctacttttacatgctaaagaagtaacttttagagataaaggaagtaacttttaggtgttttaagaagaaaattatgcatgattcaacagttacattctcttgacttactcatccgatctacgatccgattacaccgttgcgttcgtaacaattaaatctttataaaaagatctcacatgattatattttgatgaaaaaatacaaattacttttagattatatctaaattacttttagatttcattaaattacatcttagacataaaaaagtaaattcaataaaacctaaaagtaattacatatattatagaagtaacttaaaacaaagagaaagtaacttgtcacgacattagaagtaaatccatcgtgtagtacccagacttacggttttacccccacaatagatttacttttaatgtcgtagcaagttactttacttttgttttaagttacttctataatatatgtaaattactttcagactttattgaatttacttttataactaagaagtaatttaatgaaatctaaaagtaatttgtatttttcatataaaagtaattacatttgtacagtttcatctccacttatatatcatcttctctggttttctttttcatatactggcagcaagggaatattagtaatctaaaagtaattacatttgtacagtttcatctccacttatatatcatcttctctggttttctttttcatataccggcagcagagaatattagtgtcttttatttttttcgtatattgatagctgaaatattcaaggtgctcgattcgacgagggatgagatcaatgaatttctagtatcgagaagtaatctggtagttgcatccatcaagattatatggaaagagattatgtgggaagtctttgagaatcagtatcatccagtgccctattatctttactaatggatcaaagcaaccaaacatatacacgacagacacttgctgctacatattttttaaaaaacaaattatgtggaattaactttctggaactaagtttaatgtttttggggaagtgactttcatgttgaaggaagtaactttcttgcttgtagaaagtaacttttacttctagagaatgtgtatgcagctgatgcaactttttgttaaagagtccatcaaaatgcataccacatcagtatgctactagatatatattttatgtttttgtcaacctaagaaataaactgcatagaagtacgcaaaatctaaatcgagaggcatctcgttttagtgctaacgagcgacgccagatgttgtccgaatatgtgttaatctatagtacttgtctatcaagtaagtataaaatatattcctaccacctatgcttcaaataaaattttctcttaacttactcatccgatctacaatccgattacaccattgcgttcataataatcaaatctttataaaaagatctcacatgattatattttgatgaaaaaatacaaactacttttagattatatctaaattacttttatattatatctaaattactattagatttcattaaattgcatcttagacattgtaagttcaagtgccttaatttggttttggtgattaatgacaaatctaactatatgagactaataatttttatgagcctttctttgactagtctcatttggatatgaaagtaaaaatgatgagaggtatgtattaaacttcacatattctaatttggtctctcttgtggatccaaaatatagtgtgagcttcctcattgatctttattgattatgtgcatatgcgttccttcatatccatatgtatgcacatcttgaggggggagcttattctatattttgttttttataagatctctaccttgatttgaaattatctttcatctcatctctctatattgtttatatcgggttattatctatcacaaaagagagaaaagattgaaagatcttggattaaacaatttgtgtaattgttgctttggtgatagatgataaaccgatatttatgggattaacctctcttttacataagttgtcaactaggtcatttcccgataatgagatgtggtagatggaccttaatcatgacaaggataaaatgcaatggagataaagcaatatgtaccacttcttatctcctactttttgataggttcatatttatgatttccatgttattgttatataagtgtgagactaatgtttacttgagccttatcttatttagtcttctttacattgagaacatggagatcatgaatgtatgtgtttttgtttgtctttatcattgctacgtgccttctccatgtgtataggataaacccccattggttctttatttatgcatacacttgcctctcttgtatatttctttgtatgcatatatttagggggagcaaatcctatacatttattatgcatgttctagatccatgttgttcacctattatttgtattagatctttacacttgagcttgcatacgagtatatgatgcttgtggtgttaatgaatact

SEQ ID NO: 58553 - DNA, 12878 bp, Oryza sativa
atgtgcaaagaaataggtctaattgtgatgaggcaaatggatgataccattagttgatggtcaccaaaccaaagacatcgccatgttgacaagaatgaaagcttgtgatgagaagaaagtcttgaaaaaggatggacaagacctcggcataaacatagttcaaccggatggtcacaagtgttgatcttggctcaagcattgacctcaagttggatggcgcaaggcaaaggtataatggaggtaagaatgttttcttagacttttcccggtcttggtgtttggtgtagaccggatttgctggatagccgccgtactatcaagaggggtctatgaagcgagcatgtggatgatcttgtgccatattagttcatatgtatgtaggtgtattttgtggccttgtctagccaagtgtggtgagttttctcaagtcctaaacaaaaagagaagtgggcaaatcctataggtttgggtagcctcatgtggttatgtccggtggagtatctttcggagtgtgaaccctttctccctgagaaaagttgtgtttcttggatggattgttcatggattggatagccctttgaataagctttccatagagtccaagaacgccaaatttcgagacccgagtcaagagatatcgccgttttactaacggtcggttgagctgaaaagtgacctgcggtctgaccgcctccattatggcggtctgaccaaagtatgttgtccggtctgaccgcctctcccatggcggtctgaccgctcatcctgattttgaaggaggtctcgtcttggcgatccagagccgccagagccgcagccggtcagaccgagcccatggcggtctgaccgagccgtggacggtctgaccggccgctacactgcggtcagaccgagccgttacaaagtaatccggtctgaccggccacactatggcggtctgaccggtagagcacaaagttggggattttgactccaacggctagtttggtggttgggtgtatatatacccactccccagcagcaagggtaaggttttagcactccattgcattatcttgaacccttgcaagagctctcacacccttgtgcacttagtttatctagtgaggtgttggagagtgagttaagccaatccaagtgcattgcttcattgttagagctagtgtggtacttgatcatcctcggcaagcatcctagacttgttactcttggaggttgccgcctcctagacagcttgtggaggtgttgcccggtgacctctccgaggagattgtggaggaggcccggcgccggttgtaagtggtttggagttcaccaccttcggagtgaaggaacaactaccctagtgatcgaggcttgggtagtcctctccgtgggccggctcctaccttgcccaccccttgacgaagggggcgtgcggtggcttcgtggttgagcggtggagttgggctcgcctcaacggggattaggaaaccggcaagtttccgaacctcggtgaaaaattccttgtctcttcatttatttgttgcatttacatttgagcaagtttacatactagagcttatttgtgctattatcaccctaggcttgcaaaccttaacataggctagcttctttgtgcacttacttgagactagttgatttaggttttgaattgtgcaaaaccgttttgatttacgcttccgcatacaaaacttggttttagccaaaagttttaaaaccgcctattcacccccctctagtcggcctccttgatcctacagacatataaaagtaaattcaatagaacctaaaagtaatttacatacttgtcacgatattataagtaaatccgttgtgtgtgtaactatgatatgtagattaaatctaattactagatagacttatgtttttacccccataatagatttacttttattatcgtaacaagttactttacttttgttttaagttacttctataatacatgtaaattactttcatgctttattgaatttacttttataactaagaagtaatttaatgaaatctaaaagtaatttttatttttttcataaaagatataatcatgtgagatcttgttataaaaatttaattgtttcgaatccaatggtgtaatcggatcgtaaatcggatgattaatttaagagaaaattatataagaagtaactttaaaattcacaccatcaaaataataagtgtctttaattttttgttaaggcaaatgtatttcatatttacataggaagtaactttaactcttcctggaagtaaattttagatgacatataagtaacttttgagacaaatgcatcttggatgtaacttttcttggcacaactgatgttttttttcctctctttttactcttttggtgtattattagaaaataatgagatgaagctcggtaaatacaactgcaagaaataactttttatgatccagacgtaacattttgatacacgcatctcagatgcaagttaacggtactgatattttttttctctttttattcttttgatacagcatcaggaagaagaagatgaaacatgttgaaagtaaaaatgattttattgggtccttggaaataactttatgtgaattgtgattgaatctgctctttttttatatgaaacatcaattcagatatgtgatctttgtgggagatgtaaatttacatgatatctttggtggtttgatgcttgatcctctccagatttgtttttctcactctttctccgttggatcttgttcctccttttatcatccctcttgttcctcgtctttttgtcatgaactttttctgtgttacgttcatggcattacggtagctacgacaatcctaccagttatggccttcgtgggctacaccttggcccaggaacgatcctgccagttgtggccttcgtgggctacatcttggcccacgaagaaacacgcacgaggggcaggcacgagggagagcacgggttgtaatatttcctttcagtaaaatacatggccggtccttaaacttgcgcgcgggtttcacttaggtccataatcttgcaaattgcacagtcaaagccaccaacttgttttaatgattcagggcaggtccaaaccccacttgaccggctctgaccgccaacgtggcacgccacgcaagcaccaattttgcaaacaagcccgtccgcaaacagtagcgccggaataattgcagttaaccccttgtagctacagtagaggcgcgtacagcaccctaaattcccaaatccatcccctctctcccattattccccaatcctcaggtctggagggaggggaagcgacgagtggctcactccggggatcatcggcgtttgctgcgattcgggcggcgcatccatctgcaggagtggcggcgggcgataggctgcgtgggccggccccctcgtcggcgtcggcatcggcgttggtgcagtggtgacgatggacctcagcctgaggggggaagctgaggcggcggcggtgtatcgtaagtaccccgccctttcttgtgatttagcatccgtttggatggtttgtggttgtgaagtatcgttttttctatgcaatgcgagatgatgatgttggagcagttaggattaaacctagggttttagtttgttgttgatggggttggttttttttgccattggtaggctctaattcgaagcagttcacaattgaggttcatcatgggggatttttctatggtatgggagtgaatcgcagttatgtggatggcaaagttagctggttcgattatgtcgattctcgagagtggggtagttctctgcagttggcagatttggttgctatgttgggttatgatgcagggccaaggctgaaagtatattggttgctgcctgggaagaacttggttgatggtttgagaattgtggacagcgaagtagagattaatgtaatgaattcagtgtgcataaagtcaagaactttgttatctatttagaccatactgaccatgtttcaggcagaaatcaagaagatatcgtagtgagcccagtctctgagttgcctatagtaatgagccctgttagaggttgtcagcagaagggagatgggaaccaggggggtagtaatgtaggagtacaagcatgtggggttgtagatgaagtagctgatgaaattgaagatgatgttgaatatgacagtgatggtagtgaagttgatgattcagactttgtggacagtgactatgagttccaagatgatgatgatgatttatttgaggataatgtggatggtgatgtggtggaccagggcccagctcctaagaagttcaatcagaagaaggttgcaggtggcaagctgaagggaaagagagtaattagagaggaaggttcagatgaggagtcaagtgatgaagagtgcttggaactgccagagaatccagatgagatcaatttgaggttcaagtcctttaacccagaagatatgaataaccctgtctttaaagttgggatggtgttcccttctgttgagctgcttagaaaaacaatcactgagtacagcttgaagaatagggtagacatcaagatgccaagaaatgatagaacaaggatcaaggctcattgtgcagaagggtgcccttggaacatgtatgcatctctagatagcagagtgcatggttttattgtgaagacctatgtgcctcaacacaagtgcagaaaagagtgggttcttcagaggtgcactgccaattggcttgcattgaaatacattgagtcatttagggctgattctaggatgacactacctagctttgccaagactgttcagaaagagtggaatttgacaccctcaaggagcaaactagctagggctaggaggttggcactgaaggagatatatggagatgaggttgcacaatacaacatgctgtgggactatgggaatgaactgaggagatctaacccaggcagctcattctatctgaaactggatgatggcaagtttagttgtctctatttctctttagatgcttgcaagaggggttttctaagtggctgcaggcctatcatttgcttggatgggtgccatatcaagacaaaatttggtgggcaattgttgacagcagttggcattgaccctaatgattgtatatttccaatagcaatggctgttgtggaggtagaatcatttagcacatggtcctggttcttgcaaactttgaaggatgatgttggcattgtcaatacttatccttggaccatcatgactgacaaacagaaggtaatattacttgtaatcatttaatgtctgttgtacatcatatgtaatcatgtaattactgattataatcatttaaatcatgtctgttaccttcttgtagggtttgataccagctgttcagcaactattcccagattctgagcacaggttctgtgtgaggcatttgtaccagaattttcagcaatcatttaaaggtgagattcttaaaaatcaactttgggcatgtgctaggtctagttcagtccaagagtggaatactaaatttgaggagatgaaggctttaaatgaagatgcatataactggttagagcaaatggcaccaaatacctgggttagagcatttttcagtgatttccctaaatgtgacatcttactgaacaatagctgtgaggtcttcaacaaatatattttagaagctagagagatgccaatactgaccatgctagagaagataaagggccagttgatgacaaggttcttcaacaaacaaaaagaagcacaaaaatggcagggcccaatctgtcccaagattaggaagaaattgctaaagattgttgagcaggctaacatttgctatgtgttgcctgctggaaagggtgttttccaagtagaagagagagggaccaaatacattgtagatgttgtgaccaagcactgtgattgtaggagatgggacctaactggcatcccttgttgccatgcaatagcatgcattagagaagaccatctgtctgaagaagattttcttccacactgctactctatcaatgcattcaaggcagtgtatgcagagaatatcattccttgcaatgataaagccaattgggagaaaatgaatggaccccaaatattgccacctgtgtatgagaagaaggttggccggccaaagaaaagcagaagaaagcaaccacaggaagtgcaaggtagaaatggtcccaagcttaccaaacatggagtaactattcactgcagctattgtcatgaagctaaccacaacaaaaaagggtgtgagctaaggaagaaaggaataaggcctaagaacaagataagaagaaatgtagttgaagccacataacagccttcagtcatgcctcaggttattaaaactctacatttcagattatgttgtgttaatcccttgaactaaccaatgttgtgttacaggaattaatgggaccacaagcaggtggctcatcactattagctgaggtgaatgacaatatgttggatcatatgctgcaggaggtaattttcttgttaaggtttagatcactttattcagatgtaaacacatgtggcatttgtaccataactgtcctcctttataaacctgtttaacattcagtttgctactttgctctgatttttaattcatgtaggcatcacagcccagtcaactaactcaggaacatggtccactacctgactgtgctttcattcaagaaaaccagccaacagctagaccagtggtattaaccacttcaacaaaagagggaagatcaaagatgaccaagcctaagaagaatgcagctggcacttcaaagaaaaagaaggcaacagatggcttgagtgatggtgctgctgcaaagaagaagaagaaggcttgaaggaatatagtactgctgctgcaatgatccatgcttgttcatagatcataggaatacttttgcttgccaactcatgttcatgacaagaaatagtgcatgtggatgtggatgtggatgtatattttggacatcaatgttgctgccatgtaaatgtgtctgtagtgccatgacagcaaacattctggatgtggatgtgttatggtgatgtgcttttggataaaacattaaactgtcatgcaatgaagtggctagttctcagatcaattgtgcttttcatttatgacatatatgtgtactgatgcaatgttgctgtcaatttcaatctgcaactgtcattttaatcctgcaagaagcaatttcttctctgaacctgtatttgtaaatcctgaaactgtcatttcaaacctgcctttttaaagcctgtcattccacacaaattccaacacatttttcaaactgaaaatgctgtaaatttcagtgcaaatggcaacattcataattattccagcccaaccaaaatacattcatttccaaaagttggcacaaccaaaatacattcagcattcttcattctccattcaattccaccttcatttcatcaagacaacaaccagaacacagactaaaataagaactccaaataaccctacaactaacatgcacttcactgccaacagtatttctctaacaatgggcactatagctatcaatttcttctcaatttcatcttgtctcccaaaagcatcttgattcagatccaaatgctgagcagtcttcccatatgtgccatcttctccagcaatgaagccattcctcttcagataattgatgtaaccttcttcccaataccaaaagttacacccagttccatctttctacagaaataacaagcaaactcaaatcaacactaatcagcgaggttgccagctaacaaattccaaccaaaccaaccaaactaaaactcacctcatggtcaggacaagtgtaaaaaatccggccttcattagcatctgtcttcgctgtgcatctcacgatggtcttcacattgcatgaggggcacacgatcaaaggtacaactaacctattccggcgggtgcttaacgacgatgagcttgcagacgccatggctgcaacctcgccgcctccgaccgccgcacaccgccccctgtcgccgccgcacgccgccctccgtcgccgccgcacacctatccctcctcgcctcaacagcctggctagccgctaaccctagaatgggatggttgcgaaggatttggggatttttgtgtccgccatggtgctactgtttgcggaggggcttctttgcaaaattggtgcttgcgtggcgtgccacgttggcggtcagagccggtcaagtggggtttggacctgccctgaatcattaaaacaagttggtggctttgactgtgcaatttgcaagattatggacctaagtgaaacccgcgcgcaagtttaaggaccggccatgtattttactcatatttcctttttcggaatatcgcgcgttcggcggggaaaacacttttggaaaatctacgtcgcgcattagcgctattacgctaccatgcgcggtgtagtcgcgtccttttgattattccaacttaccctgaaaatttcgagttttaaaatccggaaacaaaagttggaataatcaaaaacctttttcaaacttttcccatgctggtctttattagattttattttccttccctgttgtgctagtgccttaattaaattaatttgaaggattatttgcaaattctaaattcaattattaatttagaataatatttattaaagaaccatgattataaaataaaattaattaaggaattattctcgaatgaaagtaaatactatttatctttcttaaaaactcttttatgtattaatatcccttttgtgagttattttacgaatgaatttaagtgttaattagtttctaaaaatcccttctaaggtttgatcccttaattattttgtaagcaaataataattattttcctcaaacctctttttaggatttcttcctccaaggaaatgttttgcaaaaaaaagggatttaatatttttattttctaaaaacctccttgtgaagctaaggatctaattcaaaggcttttcttaaaagtccagattgcatgcctaggaagcctagctcgggccatttccaccctaacttgctctctggaaagtctaattttgatccctcaagttttcacatatccccttccttttcttcctcccagcctagcccacccggcagcccgcttgcccggcccggcctagcaagccaagtcgaccagagccgccaacacggcctagcaagaagtcccccttcttcctctgcgcgtcgagcgccgccgttcggccgtttttgcctaggccgcagagtccgggctgccctagtagaattttttttatttatacattttttattaaaatatttacaaaaataattttttttcgaaaatttacaaatctaatcgcttgccgccctttaggagggcgatttttaactcccaaagggcggaaagggacctaaatacaaaatttttatttgtgttcaaaccctttccatcggttttaattacttaaaaactaataatgcttattcgatactccaaatgattttaaatggaaaagtgataaactacaaagttatagatctcatcaagatctacaacttttatataaagtttatctccatccaatgtcgtttgaaatgtagatctgagattttttaaaatatgttttatattttgtaacgaatatttggatatctaaaacatcttaaatgaaaaagttgttaactacaaagttgtagatctccttgagctctacaattttgatataaagttttatttcatctgactttatataatataattttaaattataaaatcatagagctaacaagttgtgctggaaaatttgcatttaggtcccttgccgccctctggaagggcgatttttaagggcgggcgatttttaaaaatcgccctcccaaagggcggcaggcgattagatttgtaaattttcaaaacaaaaaattatttttgtaaatattttaataaaaaaatgtataaataaaataaattcgtcgtggacgagcccgccttcgtgcgctgccccttccgccacgccctgccaccgggaaccaccacgtacgccggcaccaaaccctagccgagccatctaaccctaacccttgccgcggagctcgtgtgcacacatggtgctcaacgcagcgccacatcgcaccatgcgccgagccacgctccagtgccgtgtgccgaactgcaccgcacctcccgcctcacatgcgtcggacaagcaacgcgccgagccgcctcccgaccgcgcgctgccctgtccaaccactcagccatgcgccacgcccggtcacaagccgcaccctccctgcgcgtcgcacgcactgccgcctcacaccaagggaacatcgccatgcactgcgtcgtgacaaaccgcggacgcaccctctctgcctccactcgcgatctttgccggacctgcggaccctacctcggcgacttgtgcccttggctctgtgccgtggcccccactcggtgacggctttctcgccgctcggccccacgccgccactgtccctcaaatcagccgccgccacgcgtgccatagcaacggaaatagcctcgccctccgccaatcgctttgaggtctatatatgtaatacttcgtgatgaatacactatcgcgttgagcgaatctctctaacgaggaggcatgcggatggtgagatcaatagacggggcaatcagctggcagcgcaatagtgaagaagaccggtcggcggggccttgcacggggtaatctggtggcggtgcgaggggtaccgaaccgcgacagatcaacgacggcctgttggatcacggcggctaggattgggaaactccatgacctgtggggcagcaacgtcgatgaggccaaattctcgatgggtggcgatggcgacagtggagcaacggtgggcgtcaatgattgtggggtaggcgtggatcgcagatgatttgggggagatctgcaaagagggcgacgtacaatcgcggacatagttactgatgaggagaagggggagccaaatgttctgagtcgttggatgtaacacaaatgaatacatgccggtggatttgatgaatgaagtatgacggatgtaggactgtgttgatgaactatagggtagaatagtgacatatttcaacgtatgtcttcattgtgtttcaaaaaattcatgcaactaactgcacatattctctgtcctctctctctactctatcaatgcaatgcatgcatgcatgcacttagtgattttcaaaatattttttctcctaaattacttgtccgatttatgattcgatcacaccgttatattcattgtaactaaatatattttacaacaagatattgcatgattatattttgatgagaaaaaaaacatatgtttcaatccgttccattgatgttttatacgtgatagcggatcacaaaattttaaatgtttcgttgactaaatgggttgttatagccgatactgatcaaccaacaatcaacaccataactgataaaacgtacgtagtacctgaaactgaaggagacatagaggtaatatagtgatcaaagacacttatttactgatagacctcatttgaatgcaagacaatggtaggcaggcaaccaccatcaattagtagagcgaacaactgcataagagcacatttttggctcctagcttggtgcttccagtatggaaaaaaaaagaaagctaatcacaaacaaataaaccgtcgaaactaaaactgtaatacccgtgtagaattggtagtggtttgccattacaaaatgttggagcagcctgaatcaactgagaaggaaagacgatgagcagtccatgcacggccaattttaacaataacattcaccataaaaatgctataagtatgtttgtttatgttgcaacgaaaaacaaaatggaccttgggccaaggctatggatctacctacagaggaagctgacaagccacaatcactagtaaatacgcattgacgatgctagacggttgtggcgttacgtcatggcgatcgactatgctacttgaaagttgtttttgatagcaacacggtttccaaaacataactttaacttcttatttctataaaaatatttattgaaaagtgatatgcataattttatgaaagtatttttcaagacaaatttattcatataatttttatatttttaaactcaacaactcgagagttattaatgatttatatttctaagatataacttaacattgttataaacgactttctttacgaatatgaagttagtatatataagtagtactagtatgttggctccccgaccccgagacggacgaccgcatggatgagatgcagatggagatggaggcgcaggcgcaggcgcatgtgctcctcttcccgtggccacagcaaggccacatcaaccccatgctccacctcgcctccgccctcctcgacgccggcctccacgtcaccttcctccacaccgaccacaacctccgccaccgcttcgctcgaccccatcacccaacccgtctccgtctgctgtccatccccgatggcctacccgacgaccacccccgcgccgtcggcggcctcatcgagctcctggactccatgcgcacggccagcagcgccgcgtaccgcgccctgctgcttaccgagtcctcccgctcccgccccgactccctcgacgacgctccgccaccggtgacctgcgtcgtcgtcgacggcgtcatgccgttcgccatcacggtggccgaggagatcggcgtcccggccctcgcgttccgtacggaaagcgcgttcgccttcctggcgtatctgtccgtgcccaggctcctcgagctcggcgagacccccgtcccttccgacgagcaggtgcgcggcgtcccagggatggaggggctc

SEQ ID NO: 58554 - DNA, 577 bp, Oryza sativa
catacaccgaaacaagtctagataaacccaatctgaagctacaaaggccgactctagtaatctagagctaccttcaatcttgtcgagttcatattaaaaaaaaaactaccctagtcgactagagctccatgcccccaagctgacaaagactatattaggttgtctcacatattgtaatcgagtaatactaatacataaagtcaatattggttttggtcaacagaggtatggctattacctatcagttaagaggcctgaacctatataaaatttcttatctcatatctttttatctcaatctctcgtataatctagttccatcgatcctcatattatacaaatatcgtagtcagaatatagctaggccctcacatatccatcgcacatatctaaattcgttgtagtcgctctcttgcatggactccattctccccatcgtatagataacggtgtacacaagttagaatttaatttgtaattttctacaacttataaaatttgcattaaaacttatatatttgtgaagtgatatatcttcatctctactattataccaattgaaggggtcccgagctcg

SEQ ID NO: 58555 - DNA, 1783 bp, Oryza sativa
tgcaagggtcgccaccaataccattgcactagaaaaacacgaggacgacgacgaggacgacgacgactacggctgcaaggcgtggctggacggccaggacgaccggtctgtggtgtacgtaaacctagggagcctcacggtcctctccagcgagcagctggccgagttcctccacggcctcgtcgccgccggctacgccttcctgttcgtgctccagccagatatggtggccagctcgtcggcggtgctccaagaggcggtggaggcagccggtgagagggcgctggtggtggagtgggtgccccgtgacgtgcactacgtgctgcggcaccgcgcggtggggtgcttcctgatgcacggcggttggaactcgatgctggaggccgccgtggagggcgtgccggtggtgtgctggcccttcttcgccgaccagccggtggtcagccgcttcgtggccgccgtctggaagacggggctggacatgaaggacgtgtgcgacagggccgtcgtggagaggatggtgagggaggccatggagtcccccgagatcagggcgtcggcacaggccatggcacgccagcttaggctggacgtcgccgccggtggctcgtcgtcctccgagctgcagcgcctcgtcggcttcatcaacgagctcagcgccgtgcatgttcgatctagagacgccgacgagaattcatcgcccgcggtttcacttctcacttgatcagtgtcgaaatatgaattccgcaataataaaatggggtagcgcacgagacctaaaagtgaatggatgcggagacaaaggatttagacaggttcaggccctctcgatgagaggtaataccctactcctgttcggagatttgaatccgccgggtgaattatagatctgacgatctagttgtctcatgccccctaaagggtctcctgcccaccttatataggatgggggcaggattacaagatagaaaccttaaccaatacggtatcggtttcctaaatctactttagaatcttatcaaaccaggactttaggccgttccataatatatagggaaacgtaatacccaagtcatgatccgttacatatttcatagatataagttatcccttataaccagtcggataatcacgccatatgggtatggggtacccataatctccacaatcaatatcagccttgggctcatcttgtgggtggcatggtattctagtagtgcggtctctgaagctaatttggtcttttactgtgtgtgaagttcttcgtatgatcatttactgctttattatatgtgcggtaaactacaagtatactactccctccgtttcacaatgtaaatcattttagcattttccacattaatattgatattaattaatctagatagatataaaatcaatatgaacgtgaaaaatacatctatctagattcattaattaacatcaatataaatatgagaaatgctagaatgacttacattgtgaaacgggggaagtacaatgctataataagtagcaaggcatagcattgcatcacatttatgatgtagaggctgggatttttattctcttttttttaaaaaaaaatgtgtgtgaagatatgctcttctatcaattaaaccatttggattcttgctccctgccctcgcatgcacacatgtgtgttttttttttcagatttgctaaagtatattcaccgaactttcaaaatacagtaacagctaattaaaagcctaaattccaagctatttcctccgtttcacaatgtaaaaacttttagcat

SEQ ID NO: 58556 - DNA, 12144 bp, Oryza sativa
aaaaaccaaatatcgatttatggcttcaattcatctagctagtaatcatctcaattctgtatttagaattggtgatcatgtacgtgttaagctataagcaaattagatcttgagtaaataagttcaataatatatatggtcttttatttgggtgttatatagatcatctttatctttacctattataaaaattaaaggtatttttgccacaattttcatacgtcgctgcgtccgattcctatttacatcgcgcgacgccacatattcatggccgatttgccatgcctgtcctttccatgtcgaccactgcatatggattaaaccgtttcagtccaggggcaagaaacagccatgggcacgcatcggcagtggaaaagcaagcagagaccaatccatcggctcgcacggttcctgagaaggccaagaaaaattaatttgctgcctctgtcacttgtacagtggttaatttttagcgcacccaagcttgtgcaccaggaggttttcagattgtcgcttcgtgcaccttcgtaacagggaacagggaatcaattcatctgcactgctttggttctgtttggtaagttaggttcagtttttgctacgctcacatgccagtttactaggaggtttttatgcagatcaaaatacttcgtttttccacctagagtatcgcgtctcttctaggttcacacatgcttataccaacagattcactattattcctaatagtaagtttgaagtacggttttataatccaagtgactatttggcgcacaatgatttaggcacattatgaggttgtttggagattgaaaatttttatactacaagagaagattcatcttaagatgaagatgaagatcgttaaatatgtgatccgaatttgagcatacaatatattcgggttattagttggctaataggactttgtattacagtttcctaataggactttgagtatttgcatattaggactttgagtatttgcatattaggactcctagattttcctttatatatctcttttatgctgcgcgaaaaatgatgccacagctcaatatatctcttacatttatatctaactcctccatactaattattgccggtcgatgcacatgattttttttcataaggattttcacgtaaaattgatatctctatatccatcataacaagaaagacctatttgtctaactggctttataaatgcattcatacgtataggttgtgaatgcatgcaaaaatcatagcaaggctcctattttcatcgagcaaatgatggttagctccttcttgtcaaccttgagcttactttctagagtaggatatccaacggacttaagtaatatgtaagattaaaatttctttaacccgttgcaacatacgggtatttttctagtaaatttaaaaatacaacttcaaatcagtaaacttgttaaatgtatcaacataggtctaaaatttggcgtacgtgcaggtatggccacacggatactggcgttgtatcatcctaacccaacaccgtctacaccaagccatgattttaaaaaaatttactgctctatttttttttcgcttcttggttcacctctaatttggagaaaatatgtccatttgcacgaaattcaagtggatggccttaaatgccaacttgctcatttttagagaaaatgatgtgggagcgctctatatttttgcactcgttaccagactattatatccgtgatgctttggcgccttgcgataatagacttaacagacatattgaaggcatcaaaagtgaaaggcatccctatggcccatcactgggtttgtcaacagtgacgcgccgcaaatgcccatcacttttagggtgtcactactatgcttcagtttttaggtacgtaggtggtgcttgaatctcctgaagataaagatgaagataaagattaagtgtttcatggaaaacaagatggtaataacgtgcgattaattgagttttaattattacaaacttgaaaaatggattaatctgatattttagagcaactttcatatcgaaagttttcgcacgaaacgcaccgtttagcagttcgaaaagcgtgccacaagtatccaaaatttcatccaagagttgttgtagtgctataagttacattaatcctgtgcttcactcactcctagaaataagatttttgcaggcggcccaaaaccattttcacaggcgggggagaggaccgccactaccatctcgcctgtgaaaacagaccattttcgcaggtggacctgtggcccgcctgcgaaaatcatctcagaaaaataaaaaaaaccacgggacgccgccgccggcctcaccacggccgccgccggctagggctcccctccgtccgctgccgtcggcgccgtcttcgtcgttgtcgtcgcgttgacgaggagagccggcggcgcgcggatctagagccgtcgtcgtcgctcgtcgtggccggcggcgtgcgcacgtgggagaggagggagccggtggcgtcacggtcgtcattgtcgtcgtggccggcgtcggagggagccggcggcgcgcggatctggagcggagggagccgtcggcagcgaggagggagccggcggcgtcgcggtcgtcgtcgtcgtcgaggagggagcccgccgatggcgaggagggaggcttcggcgcgcggacgtcgtcgtggagggagctggcggcgggcggacgtgggaaaggagggagctagccggctatttttctaagtgtgtgtcaaagagagagagataggagggggagggaaatgaatggtagagaggagaggataaggatggtggagaggataaggatgactgattttttttggtaggtactatttttgcaggcggaccacgtaaggtgcgtctgcgaaaatctattttcgcaagcgtcgcttaagtggtccgccagcgaatttcatcccgatttatatttttgtaggcggtcatttggctccaagagtcatatccgcctgcgaaaataagacccctacattggggaaaatgctttttctattagtgaccggaagagacaccccaacaaaaactagcgtttgctgccaatctgtgtgcaaagttagttgaggagtccaggtacagcattacctcaacaacaaaccggtgctgtagacgaattcgtttttcacccgaagtcactaacacaacaaccaagcctatcagagaaagagatcggtagaaacatcgaaaatcaaaatcaatttccaaaataaaaaaaccctcaaacttggatggagattggtctgaccgatgtgtaaacgtcggtttgcctgcactagcaccgacggtctgactggcattgtagctccggtccaaccgctctacactactggagaaaccatctttggtcggtcagccaaatttcacaatagtcccggttgtattaaaaaccgctcagaagtattttttgatctttagtcccggttggtaacatcaactgggactaaatatcatttttagtctgggtttaaaagatggcaggcagtgtcagacccctatattttctttagtcccggttagtgactaaagatccatttgtagttccggttggtaacaccaaccaggaaaaaagatcggcatacgcggagatctaggcgtgcgcgcggatcagatctcctcctccctcccggttctatctctcctcctcctctcctttaactcccatcctcatctcctcactcaccctatctcttcctctccttctcctctcccccctcctccccacaccccacttcagagagttgttaacgaccaaaattggtaatctaagtatcggagatggagatggaatcaaagtagaagtcgagatggaaatcgatcggggaacagagtaagatcggctgaagttcgaatcggctacggctaagatcggcagagttcgagtcggacaaggttagccgattgagctgaatccgacaatatgacatagcaaacgttgtcggtttaagttgatgagcttcatgatgattgccgcacgtggatagagtcctgagaaggcaattgtatctattaattaggatattttatgtaatttccttagagatatgtttgggcaaaagtctgccgcaaagacttatggtatcttagagtttgttagagataagagtcgtgtccgatatggacatgttgtgtaattcttgggtataaatagaccccgaaccccatgtaatcaattaacacacgttcaatacaatcttggcgcatcgccacccttttactttcgttttgtttcaacgagttcttgctttcggattgagctgcatcggttttgatcttcaataagaggtaaaacttgttatggcggcttgcgttctcgggattagtgcttccatctttatgatactctaatcttgtttatgtaattcgtcgagttatcatatatcttacataatctctggcaatatcgctatataatctacaatcggctaacatctatcggtagagggtagccgattaggttagatatcgatgttgacttagattatatagggtatccaccactctatgaaacttccaatggcttgattgtctagatattgtccttcttttcatacttctagctgcatcagttgagtttgatcttataagtcgtgattagaatctcaatctctagcctgcttcttggttgccgattagggtagtatcagggtttcagccgatcttacctgatttaactacatttactctatatgcttcgttgatatgttaaatctgccctttatgttaagatctcattgcatttaagtatattaggcctttgtttgatatattctacttactttaatatcttaatatagagtggtatcggagtattagccgatacatgctagatctatctgatcggctatgctatgaacatatatagtcctattattaatatatatttcgatctaagtgatttatactatcccggcatgacgaccgatctatcccaatcacttgatttaagtatatatcgatataagcagtatatattgttaatatctacagctgatcgagtagatttagttccttcttacttattcatgattgttgatcgatacatatatgacatcgactcaaagataaatgatatgtcatcggcacttagccaatctgctatcgttgatgggtttaaccgcggtttctttgtctttgtttcttgttgattacaagatcaaatcaactggcacactagcatacccgaaggcgagttttggacctgccctggagttaagcagatctcccaggcctcgtgttttacgtcaataagagcacgcggcggtggtggcctcgtgcggcaggcggcctgcgcggcgggcggcgaggcggcggcctacacgtatccagacgtgattcggcctgcgtggcagtttctttccttttttatttagaatttgtgatttggatctgagatgtatttgatatgtgtgtgatgtgaatatgtgatgtatttgtgttgaattttgtagaacttgtgatctaatttttttaaagattttgtgatgtatttggagatgatcgatttgaggattgggaggtgataatcgatttgagacgatttggagatgattgatttgggatctggggatggggatagagtgaaatcaatatattgcaaacaatgaagaaaagaaaaaaaaaggagcaaccggacctagcctggctccatcttgttatccccatatctctaccatggaggcaccccctaggcccaaatagaggaacccccctcccctcgtccaaaccaatttagctaggtccagccgtaaaaataagccgagtgcttccccttgaaatcacgtaagaaagccaagcccaaccgttagagcaagtctaataatacagccaattactagcgatagtagtatccaggtcatctaaagcctgcaatagagccatcaaatacaataacttagctatagtaggatggcccaccaaattgtataagagaataactaattgtgacaaaagcacacgaaaccttctctctctaccttatcactttctctgtcgcaccagccaccatgcgccatccattgctttctgatctcttctatgttctctcccatcttcttcctttgttttttgtatgaacacaagcagcagccggcaggccaagcttgctcttgagcttatcgtagaccgcctcccgagttcttgcatgccacgccatcctgcggcacctcctatcaccgccatggcggcatatccttgagctccttcaatcatcatcaccgacaaccttgagctttacgtgacaagctaggaagcagtcgcaagtgagtccgctggttggaggcctagagcaagctaagcaatggtgagacggtagcgagtaagcaaggatatgatgatgaacccacgacaatcttaagctcctctcctcatcaatgtcttcatatgggaagctatgctgtagctgggcaataggatatgtcacgcccggaaattcactagtaatttccaaactaatttgtgcataaaatcatcgtccaggaatcagccgaggtacacaaactgacaatttaatatacaaatccatcataataataacgttacatacttacaaaagaaaagaaaaacatcaacgaaataacggtctagcgatggcttcagctccactcccacaggcagctcaactagggtataagccaaacgtcagctccttctggatcctttctcttcaactgaggttgattgattattgcaagaatgagcatatgacatactcaacaagccacacagcaaatatgcaagtgcacaaggataccaaaggatggcataatataggctcatttgcaaaagcagcatttagcaaatatttaagagaaataaaacagtagagtaattaatcatcaattttaatcactgaacagcaccccaatgctgcacaggcccaaccatcctgaacaaccatacccggctgtacagatctaactctaaaccaagagctaaacaaattattaccagttattgcatcaataattatttgtgagaggtgtgagactaatcacgaaaaacattgctcaacccgcccataaccgcgggcacggctattcgaatagttttactctggccagaggtgtaccactgtacccacaagacacgattccacacatgttgccatgccccgaagtaccaccacggcactacaaagggggaaatcgtgacaatacccttcgcacaacacaactcaccacagtgcaccattcctggatcataatcaccccctcaaaaatcagaggcatggactcccctgcgacccccacggacttctcgccgcttctcagtctggcaccccgtaatgaaccatgctatacaaaagataaagccgttgcccacgctggcttgtggttggtacggttaatgtttcacaacagtagctcgcgaaccggtccttaattgccatgagcacgacattcaaaaccatatgctcacaacccaccattgccaagttttaattatcaattaattatcataacacgattaaccatcgtgagctacatttaaatctaaccataagtaataatgtaatatgattcaccccattaatgagctaatgtttctaagcatggctaagcaattatatatatatatatatatatatatatagcatttagctgaaccaaactaatatataaggttctagctaatcgaattataacccataagaaaataaagtcatcttcggccaataattaattgggaaaggctcaccacccgatgacattcgaaaataatgcataagttgaaataaaacattagctttaaacgggttcaacatgctcaaagggtcatttgggatctgtgtgacttgccttgagcttcattaaacgcttctgaacctttctcaacgaaaaggctctcctccggaacgtcggaaactaaagcgaaagaacaaaatcaacaaaacagtataaaaacaagcataaacagtatatgtggatatttttaacatgtagatctcgattttagatgaatttagcaacttgaaccactcgaatcggagtaacgatgaattagttatgaatttctgaagttttaatctatttgcatctagaaaaaaaactggaaaaaggaaatatgacgtcatgctgacgtcatcatcgccggcatgacacgggcgacgacctcgccggcgatagagaggtcggcagggctatctaaaggcatctacacgtagaggacgacgacacgaactcaccggtactagcaaacgcgatggatgacgacgaatggtggccggcggcgagctctagcggcggcacggctcgggtcgtcggcggcggcggctctccggtgaccgggaacggcggtgagggggcggccgaggttccccgcctccgtgcgcacctaatggcggcgacgggaagcggcggcgactgctaacgcgacggcgcggcgcggctggacgtcgtccggcggcggcggcggcttggacagcgtggcggcggcgctacgggggacgagaaggctcgggagttggggcaaacgaaagaggacgccaatgggatgctatttatgtcttatattagagagatcggactccaaacgagaggatttgagccggaaaatccgagggttagttggagagataaactcgaaaacgaattcgatttcgcgttgatttcttcgggataaagtccgattcttgggggaaagaatagaagaggataagaggaatatttcccctcaactaattttgcaaacggagcacgggatgcggcggatttggtggaggaagcggcggctgcacaggtacaggacggcagctcgggcttctgtccaagcttgaagatgaacagtaacggggagacaaattagactttcggctgggcttctacttccaaggactgattaaaggagggaaaaaagcagacttcgggaaagagagggaaaggactgcaggctgagaggagactgggccgagagtgagacgacttttcctaattcggcccgaaaaggaaaaggtgaattttaattacttttccaattaaattaatcactgaaatgatccttgaattgttaaaaatacttatattgctcaaataatttcaagaaaaatattgaaaatacttggaccctcaaagtatttaaaaaagttataatcagaccatttaatgattaatttaatatatggataattactgaaatgttctttgtatgattaaaattaagaattgagctccgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatcctgaaacgaaaatcaggacgtgacaggatagtcgtcggctcacccccctctctcttccaactcatcactgtagtcgacatggcctccttatcgccagtccacgatggcttatcatacatgctctaagaaagcggaggcctcttgtccgtggaaccgggagaaggtatagaaggggttaaggaggctcggggtgcataggaacgacgaagaagggcgaccggagggggcagtatgcggcagagctcacctcgagctgggacagctctggcgagctcaatcttcgagtgggcagcaaagccgacgctggcgaagacatgacttgacatggctccccttgccggtggcaagcggctagagcggtgacggacgacggagcatgggtggagcaatggggaggggtttgggggcgcgaagggcttggagatgtgggggacaaggaagagggaggcacgaggggtcttttaatggctcgaggagatggtggggaggctggggaaaggcggtaaatgacggcggataggggcggtgatcttggcgaaggggagctcaattggcgtcgactttttcaagaggattaggtgaaggtggaagtggtggaagagatccggtccaacacatttgactagcaagggcgggagcgggagcacgatgacgtggtgtacgtgccttgcggttcccgggcggaggtaggagactaaggtgataggtgtggtcccatcccacctatcagcgagaggaggaaggaggagctgatccagacctcgcgagataggctacacgcgggggcgggccagcggtggggatgagaggaagtcgagaccgaagagttgggctgtgaaagtggtgcatcgtggggagaacaggatggtggcccgagtaaagtggtagggaggaagaacagacttcgcccaaggagagagtaggttggaagtaggagtggtcggaaatgacccaagggcaatgcggggattttaattggttttccaatcctctcttacaataaagttataacgcactaaatactaaagcttaacatgtaaagatgccacatcatcatccactaacagttattacatttaagcatcatgcaaaattatatataattttataatttattaaattttagagatttaaaatacaagcatgttaaatcatcccacataattcacataaaatttcatccatcatttttataatatcctacatacctaatatttgaatcatcattatatatactatttaaatttaattcacattgttggaacagaacaaacaagtgttacgctagtgtttctgtgaattcttcgattcctcctcccttccgagggttgcatttacatatttatacttagtagcatacaaaggaagttacaatgttatccctataatcctagctgatctatggtggtggactagtgagccagccaatgggttataggtaaaatccacagggacaagggacagctgagcccattaaggaggtggcatggtgccatcactgtgctggcttttacccgggtaatagccagctctagccttcacatcgccaaccgtgtcatgacgtcagcggtggttggcgggtgagtagtgcgctttaacggcaccccatgctcctttttgggattcatcctaggctttggctttggagccctggtgagagctccggagcccttgagttggctccgagacctccagcgccagttgccgtatccatgcgaaccaactctgttgggcttctgatgatggccttacatgcggaggcagactctgcaagcctgtggctggagcctccgaagcggaggccctagtcccctcgggtgaccgcgagcgggggtgggaggggggggagggtaacataagggttggaatccttcccccaacatacatcaatttatgtaagctcatatttatgtaagcatatgttgtttaagctatcttacatattatttttagttattgttttcatagtaaactcccaaagcaacgcgcgtggtttcacctagtttaaataagtgcttcaccaaaaagaatcaaataattactgaaatgaactgtgtgctattaaaattagacattaagttctaaaaattccagggagtaccttaggacatggagaatacaagacaaatattcctagccatgatttattaaacaaactttattgcccacattaacttcacttgtaaattggtttactttttaatatgaattttattaataatagtaaatgatttttaaatccataaaagaaaatcacggtgtgacactgggagatagaggtccgattcctctacttgttcatttgttcactattcggtcattcccttcttttgctctgttcccaatcaatagcaatgacggagtagttcgctgtcgcccatcgatctacgcccgtgtatggccaatcgtcgtccccgtctgcgtacctggccaccctccatcccctatctccctctccatcccttgctcaactcctccagccatgcagcgcctctgtacctttgctatcgaacccccgatgcagctggtgcgtggcggcattggtggacctacatgttggcaacggcgtatctaggattttaggtatgggtggtccaattttatataaacttttcaatatcataaatgtaacattacaaatatattacaaatatacagtacaagtataaaattaacaaaattagatcattatattagtaagtgtctcataaacgttttaaaatcaacaattagtcacaaaatgggccttgagcggatgaatttttgggtg

SEQ ID NO: 58557 - DNA, 1464 bp, Oryza sativa
catttttttataaaatagctaaataccaagttcaatcattttgttttttcaggtgggaatgaagggagaagacatgcttgattcttccaatattttggcacatttgagtggaatgaacccttacggctataagtacaacagcactgtggaatcctggatataattctcataaacacacaaattaaagtgtgttttcctttcaattgtgcaagcattaaacacagttttcccttgctcccagtaaataagactgatgctttagaagctctattcgcaagagaagtgcttaggtcaagttattgtttctgcacactactgatttgtaaatagaattgtttccttgtcataatagagataacaagtttcaagatttgtctcgcaatttttcgatgttacaaattcagacatggtccactagaagtattcatgggaaagtaacacaaaacacaatggtcacaaaccagtaatatcagcataatctcatagcacgattaaacccagctaattcttatcatccttgtgggaagaagacccacaaatccgaagccagcagaagaatgagtaattggaaagtggattgcagttcataacatctgccgtttctactcaagttcataaacatctgtcgtttctacttacacagtatgagtgtacccatattgaagagaaaaggagcagaacttgagctgggcactattgtagtgatacaagcgcacgaccatacggggatagagaaaaaaaaactacaccataagtacgctatctaattaatgacagcactactcgatttaacaaagataactggtccaacgtcaatttcaacactaggaagaaataatctgaataataaaagaaacaggtattgagaacattttggcctctatccaagtaatacagggcatattctacaagcataaaatgaaaaacaatactttcaaaatgtttatgcatggaatcgtggatgaagatcaaaaacaaaaatcagtgacacttgagttacaaaactcaaatgccgaaaaatgcgcattattctattccagactgataattcaaccttttacaggacagatttagtaatgttaaatacttgtaaatactggccactaaaaaggtagacatcttgtttaattaattcttgcttccattttagttatcaaagcataaactagaaatagaaatacaccgttgctttagggtggaaatctatctatctatctattatattattaagccacccttgaaaggaaacaccacgttcgctgtgggggctagaaattcccacattaatcgaagaaaaaaaatagaattcaaataggattataatgactcggcatcctcctacaatttggaaagttcagagagagatttatgaatcgtacacattgcaagttttgaatcgcacattgtatctgctgcatgccatcctgacaccgtgacattggaatcaaagtagacactaaaaaa

SEQ ID NO: 58558 - DNA, 3512 bp, Oryza sativa
  unsure (1)..(3512): unsure at all n locations
ccaccccttgtatacgccagtgcatgttggcgttgttttaatttgtgtctataccttactctccctctattgagaaatataagatgtattttatttcgttagaacaaaaatttaaccaacaattatctatcagaacatacttttttatgataaaaatgattttattatatttgtatttaaaattacttacatgtgattatgcctttatcacataactatttatattaggtggacaattattagtcaaaccttatcctaatgaaataaaatacgcctcataataaaaatggagagagagtattattgatgcttaggataaattttggtcaacgatttaaatttcgaccataaataatttctcaaatgcttagttttttttaaaaaaaaaggtatgcataaattagcctaattaaaaaaactattgtacaatctcataaaaatatatacttactaggttttataaatttctaatatgaaattcatgattggaatcacatgtactaaaattcatgtttctaataatatttgattaaagatttgatcaaatcttatttcaaatgttaatatttatgactgagtatatggatactcatgtgtggatttactttaagattggtttaagctttccagctacttgtgtaacttacctttgcacgtgattgtttttttttttgccttgtcccagctccaagatcacatttttttctggatccactgctgagcaaatctaatagaagggagcagtatgcgtcaaatctggcgagaggttgccgagtcttctttcccctccccttgctacagtagtttcctttctctcctgtttcctggcccctcttcccctgattccggcggttcaccatcggtgagtgttggaggaggggtccggccatctaccctactagtatagtgtagctaggctcgtagtttggttgtcaggtctttcctgtggttcgggtctgtctcgtatgagtgttttgctggtgaggagccatggatgcaggagtggatggcggcggtgatagcaggtggcggtggagctgtgagatcagaagatttgttgaagaaccgaagggtggtgatgtctccttgtggtggcgtcggcggcagcgctggccactgctgcgggctccccatcctgctccgtgcgttgacggtggtggctacttgtggcctttaccgatcagcgcccggctgcattggctggagtaggctggtccctattccgcaggctggtatgctttggacatgtgacttcagtgaattttgaactatttggagttttggacatgttacctattttgttcagttaattgtggttggactatatggatttggtcagtgatgtacggcctcatgtttctatctagtgtttggtagaattgctttaacttaacctagtttgctttttggctggatttggtgaagatgtatgtactaaacttatttattttgctatggtcaatgtactgatgtatatgaacatattgtgatctatgagtgaacctgtgtggtgacgacatgtgctatattggatgttaagtgggcttgtgatgtattgattgttaattgggcaatcaattgagatgcatgggtttgttatatgggttattggtatattgtttcggtctatatgggcttttgaaatgggcttgacccactttttatttggatataatataattgggctgaaaatagtgagtatagtgctacacattagatgggctaggtctaaatttaattgggcttgcaattgggcttaggccataaataggatgtttactacatggatcttgatgtgccataagacattntgtgacttttttagactagataatgacgaanataagcatcataaagttaatgacaaaagtaggatcgtcactagatctatgacgaaagaaatatattttcgtcatagagcatgattagagacgcataataggtgatgaacgaaacttcgtcacgtgaacgccattgatttcaaaacgtgaaatttttttctgtttttgtgacataaatgaaacgttacctatcgtaagatctcatgtagtgagagggggcggcgatcgtaggcgtcggctgcaggtgtcggtggcaggctgctgctatgctatgaaggtgacacagttggcggacgcctcggtgctggtgcatgtagcaaatatcttccatggcgtctccattctccgatctaggcggcacttgtttgacagcagcttgcttctctcaagtggacattcccttggcggtctggattggaggctgtggcctctaaacaatgaagcattgattttgcttttgctggatttgagttttaagtgcttcaagacttcttcagcaatccctggccttctagaaagacagaagttctatcgccaccatctgattaagggtatgtttggttgggctgtggcttttgaaaaagcagctgtgagctgtgactttttgaaaagtagctttggaaaagtagttgcgaggaagccaaaagctcatttggttacacgcaggtggcttttggaaaagcacttagtagaccccacatgtcatgtcatggtgttgctgctcagagcagcatgaagccggcggtggcgctggggagacggtgccgaagagaggtgaggcgcgggggaaacagtgctggagagaggagcaacgacagcggaggtagaggaggagcagcggcgggaggagtgtggccaggaggagcggcagcggaggaggagcagcaccggtggctcggcgaggagaggagcggcgccgggcgaggatgggcggcggccggccggggacgagaagcgtcggcggcggccggggatgagcagtgtcggcgttgggcgactgttaacgaccaaatttggtaacatctgtgtcaggaaagaagattggatcaaagcgaagtcggaggcggagatcgagttcggaaacagcaggaatcggctggagtccagatcggctatgattaggatcggctgggtctgagtcgggctaagtaagccgatacggccgattccgacaatacaacttgtgcgcgacatcgggttcgagttaatgtacttcaagatggttgccacgcacggatggagtcctgggaaggcaattgtatctattaattaggatatcttatgtaaattccttatagataaatgtgggcaaaagtctgccgcaaagacttatggtatcttagagtttgttagagataatagtcgtgtccggtatgggcatatcttgtaattcttgtgtataaatagacccgagccctatgtaatttacaacacacacattcaatacaatctcggcgcatcgccacccttttgctttagttttgtttcgacgagttcttgctttcgggttgagctgcatcgatttcgatcttcaacaagaggtaaaattcgttatgacggattgtgttcttaggattagtgcttccatctttatgatactctaatcttgtttatataattcatcaagttatcatatatcttacataatctatagcaatattgccacctaat

SEQ ID NO: 58559 - DNA, 1454 bp, Oryza sativa
ggacagatcccgagctcacaactgcattacaaaagggaaacggaagccaggacttggaccaaacaacacaggcgcgacttgggaactaggccggaaccctaaaaagcatcgtagccggcttgctcctggaagaactccttaacagcaggatccgcttcatcttcttcagcaactggggggattatttatatagagcaaaggtgagtacgagagtactcagcaagccatgggaaataagtgtttaatgcaggcttcagagaaaggctgttgtttttgcaattgattttatttgaactcttttctaaaaacaactaagtgagtgcttctcaaacgacgcggatgagacagtgcgtctcgtccggtcggagtatgtgcaacacccggccaacagcttttcaaacggccactcgggccaacaactttcaaacggccacctgggcctagctgatcccatcagctgcagatttttcaaacatcgaacccctttccacaacagcaatttcacaagcagtagtcaaccaaaactacgctaggaatcacctcacatccgcccatgaccgtgggcacggctgttcgaacagattgttaacctctgcagagggggcacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttattcagccaggggtgtcccattccacccatgtggtcgtacttgtcttatgtttggatgaaattccaaggaaaggggtccttaagtgcaagagcgggaaaccgtacacccggtacgttccccggtccgcggttttgggaaattcatttagttcgcaagcaccgacccaggtgtcgggttttccaagtcttttgtaaaacccaagttttacccaagaagtttttcagattttaagtttgaaggcggccgtcgatactcgtgcagagtgcacgatttccgaggcacaactgggtggttacaagggaacatggtataacaattaacaaaggaaggatcaaatgcaacaaattaggtaggtccgccaatctgccttgcagacgggacaaacagattaagtgcgatcctatcaatgcataatatttttcaagcaacataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctatta

SEQ ID NO: 58560 - DNA, 19786 bp, Oryza sativa
aagcattgtggtcttataggatggcttgtcatggatcgattcaagttcctccttacaaacttgtttatggacatgaggctgttttgccatgggaggttagaatcggctctcaacgaacggagttgcaaaatgatttaacagccgatgagtattacaaccttatggctgatgagagggaggatttggttcagtcaagattgcgagcccttgcgaaggttactagggataaggaacgtgttgcttggcattataataagaaagtggtacttaaagatttttcggaaggagaacttgtatggaagctgattttgccgattggtactcgtgatagtaaatttggcaagtggtcgccgaattgggaatgaccattccaaattcataaggttgtgtctaagggagcatatatgttgcaagggcttgatggtgaagtttatgggcgagcgctcaatggcaaatatttgaagaaatattacccaagtgtttgggttaacgcatgatcggcttatattgccgtgctgatatctatgagagttggagtcatcggcccttgattaaacaagaaggcattaatggtgtttgaccagaagtaagaagcagctgccatcaggggttcatctttggccgagtttgctatggtaaggtcaagtgcttggccgattccaatttcagtgttggctgatattgttatatcgcccttagttgttttttatggtgtaatcgtttgtggttcgccgatgtacaatggccgatattgttatatcgcccttagttgttttataattttatcaatgctcttgacattgtaaaactaggggggcacatatatatcaaaatcaaaatggaatgcaaaatttttgagcaaatttcaaaaagtatcggaatgtcttagccgatttcaaaagtttctaagttctattacacaaagattattgagataagtatcgctggatagctgatatagccttctgcctaatctgttctacttcctctatggcttgggcatcttgagcatcggttcaagggataactttcagagacttggtcagatcagcaacatgcttgatagccgttttgagtcttgctttctgttcttcaatagactttgggagatcggctaacttcttgtgctctatatccagctcagcgttgcattcttcaagttgtgctaagagttcaatcttgcgagcctcgagtcgatcaatgttagacttgattgggccttcagatagttgatcaagcttggacttctcttcatgcacaagttgtcggttggctttgctcaaggtaaacggctggggtaaggatatcggctaactcatctgggattagagcctaaatctcatgtagccgagccctgattgagccacaatcaaccaccaagctatccagtgatgatgcttctagccgatccaagatattttccagagttttccttacatcatcagataaaggggctaaggctttgcttgtggtatcttcttctccttcatcaagatactctctgatgtcaaaagagaaaagatcggctaatacctgcagcgataatttagaagcagttagaggttaaatagtcatagccgatttgaatgcttgttgagacaaagagaaacttactgggatagcaggagcagctggttgttcttcttcctcgacgtgatgactccccacagctgaaggagtctggtcacttgacgattgctgtacagaaggagaaggaggagggggaggctgaaaggaaacaagtgtcaggcaaaatcggctgaaaattaactaatgaaaattaaaactatcttactggtggagctggtttagatgttattgcaaccgatttcttcttcaccgcagtcttctttttctatagttataaaacttgggagtgatcgactataagacagataattatgaaaggaattaaagaaagttgtctactcttgaaaagtggaccggagcagaaggagttggaggggtttgcttgggcgaagccgatggtgttctttcagtatcgcttacttcggctgtggcctgatcaacttcgtcttcaattatttcttcatccagagcttgttcaatagatggatctagggtaggcagatcatcggctgacttggttttcttcgtcttcttcttcttagttggggctgcgatgtttacagccgacgatctggttttcctctttttgccggcatcagctggttctctgataagcccttgaagaagagctgaggtcttgggggcatcatagccaataatcagaggagatagcccacctccattaggaattaagcctggggcatattggatgtccttgccactgttgctttgatgaggaggggaggattctgttgtctgcaaaccaaaaggaggattagttgagattaatcggccaaacagatatgtaattgaaatcaagcaaagttaaagacttacttgagggacaacatctagaaagaggtctgtcatatacattgaagctggttggtggaatagatgcagcttccattcgccccaccacctgtcaaagtttctgcttctgaatgttgccagttctatgttatcaatactgcccagaggaggtccttgaaggttgagcagccgatccatcatcagggttgatgaaattcctcctcggcattggatcttgtcggcgaagaataagccgattgggagttgtcccattccaagttgtctagctgagctcattggatgatagaattcgtaagaagcttggatgtttcttccttgatgaatgccaacaggaaggatgcatgggctgattgcagctgagaaaatttccctagacgattggtatacttcatggttgacgtcttcgaatctaaagtccaatgggtgctcaagttctgcagaatcttcatagagaaaccaaactggagcatctttttgaaagccttcatagaagctgcagaaccaatctttgagtagttcagccgatagttttgccccagcctcagttggtgtagaagcgtattctccgtatgatgtgcatctccgatgagtacgctcttctccatcatctcctacaatcggctctagtcttggaaactcagcttctgatacggatggccgagtgacaaccttcataactatcaggtttaaccaggtttgtagcagccaccagggcccacctactccaactactgagccgacgactatcttagccgatgcattgtttaacatatggtatagatagccgatgaggattttgtccaagggaaattgtttctttgtttctaaagcttcagctagaaattgccagttggttgtggggccgcaacttgatccacagaacagaaatttttctagccacattaacagaaagccacatgttcccgaggggtgaccgagccctggcccatgtatgccgctacgtagcctgaccaacctcctatgctctttgtcttgaagtcatattggttctttgtgttcaaactcatagggttggccgatgaggtgacatccagacccgtgatcatgctgatatctatgagagttggagtcatcagcccttgattaaacaagaagggattaatggtgtttgaccagaagtaagaagcagctgccatcaggggttcatctttggccgagtttgctatggtaaggtcaagtgcttggccgattccaatttcatcccagtggaccctcttgctggctgatacacgtttgaaccatgtagtccagctcttttctggtggaactttttctagagacggccaggacttgaaagtattctttcattgacctagatctgggttggttaatctgaaggggatcctattggtttcaccaataatgaactcggtggggtcaggattgccgattgggccgagagagtagtggttttcatgcgttagactaggaattgcgacttggtaggaaagatgctacaaatccaaggcaaccaagagaaggaaagcaatatgagataggagaaaatcgatctgctgctaaagaaggggatttagccaataagaacttacctcaacgtattcggttgatggtgcaccagatgggctggcggaagacgacattggtgcgggcggagatctcgtcgaggaggaagtcgcctagaaattgcctttgcgccgggggaatcgccggagaagagaaagaagaggtttcacttgagcggtgaaaacggaagtcacggcatgagatttctcgggggtaacggttagtatttaaggtgctggaataacggtcaaaagcggcggagtgcgaaacttgctcggagtcagtacacggcaaatccggaatattatcaaatatcccagacttggggggcatgtgttaacgaccaaatttggtaacatctgtgtcaggaaagaagattggatcacagcgaagtcagaggcggagatcgagttcggaaacagagcaagaatcggctggagtccagatcggctatgattaggattggctaggtctgggtcaggctaagtaagccgatatggccgattccgacaatacgacttgtacgcgacatcgggttcgagttaatgtacttcaagatgattgccacgcacggatggagtcctgggaaggcaattgtatctattaattaggatatcttatgtaaattcttatagataaatgtgggcaaaagtctgccgcaaagacttatggtatcttagagtttgttagagataatagtcgtgtccggtatgggcatatcttgtaattctcgagtataaatagacccgagccctatgtaatttacaacacacatgttcaatacaatctcggcgcatcgccacccttttgctttagttttgtttcgacgagtttttgctttcgggttgagctgcatcgatttcgatcttcaacaagagataaaattcgttatgacggattgtgttcttaggattagtgcttccatctttatgatactctaatcttgtttatataattcgtcaagttatcatatatcttacataatctatagcaatattgccacctaatctattattgactaacatctgcataaaaaagcagccgattaggttagatcttgatgttgatctagattatatgagatatctaccattctatgaaacttctagcggcttaattgtctagatatcgttctttttttcatacttaatgctgtatcagttgagtttgacctattaagtcgtgcttagaatatcgatctctagcctgccttctagttgccgattagaatagcatcggagtttcagccgatcgtatctgatttaactttatttgttctatgtgcttcattgacatgttaaatctgccctttatatcaagatattgctgtgtctaagtatattaggctcttgctcgatatattattcttgctttaatatcctaatatggagtagtatcggagtattagccgatacatgctagatctatctgatcggctacgctataaacatatatagtcctgttattgatatatatttcgatctaagtgatttatactgtctcggcatgatgaccgatctatcccaatcacttgatttaagtatatatcaatataaggagtatatatcgttaatatctacagcctatcgagtagatttagttcttctttacttattcatgactgccgatcgatacacagatgacatcggctcaaagataaatgatatgtcatcggcatttggccgatcggctatcatttatagatttaaccatgatttctttgcttttatttcttgttgattacaggatcaaatcaattggcacgctaacacatctgaaggcgagctttggacctgcactggagttaagcagatctaccaggccacgtgttttcagtcaacagcgacgccagcatggaagggcgggggcggcgtcgcgcggcatcagttggggaagggtcggagccgcgccggcgtctggatgggcggcttcagttgggaagggcgggggcggcgaccggcggggaagggcggggccggcgccgagcggggccagacgggtggcggccggccggccggagggcagcggcggcggaaacctcgatgcgacgatgctcggggccgtgtgcgacttgcgaggaggagacgggaagagaatagcgaaccatttttttcataatggcagaggtgggtaattttttcccccaaaagcagggggtagaggtgcttttgatttgtactacaccaaaagctgactttgggcaaaagcaactgtggcttttgggccctttggttggcttttggtttttgcaaaagcaaaagcaagttgaaaagcccaaccaaacacaacctaattttgtgatattggctacttgttctttggaatcaagcttctttttgtttcaaaacaacagtatccatgcagggtttatcgttcgggttgagcaatttttgctcctcagatttaatggtgaactctgtggaacctctttgttgagtcgggtgacgcctacaccaaaatctacgactcagcaactaaccttcgaattgtgtcgtttctgtggtgacagccgtaggagccttccagtctgtcaagaggtgtgcatgtcatcgaaggcccaagcattcagttgtcgcagcgacgccgtagagctctgtcaatctgatcctttactgctgtttagtctcatctgaaagtttgcttctttagtttagttaggctccacattgttagagattgttactttccatgatttgtatccttatgcgatgtactagggtgtataccctgaactctgtcttctttaatttaataaagctgtttaagttataaaaaaatgcgtcaaatccggtgtaaaatgaaataagcgccatccacccgatgtaaagtgcaatttatcaaagggagcatgtacatagtatttatcatggcaatacacatggtaaactaattacattcataaagaggcttgctaacccatggtataccgttggaatggcataatcattagtcagacacctcaaccctaatgcgcatggccggtgcgcatctgattgcgtgcatgtgctagtgctggtcgtggatactgtatatttttttttgggaagcaattcacaacactagctaattactactactctgcgcaatctgccatgcatgacatgacaagtgctcctcacttatacacccatagattatgaatgcctatccttttggtcacacattactacaaactcctctgtaattgcgtgcttagctatacatgctgttgttattatagctatactcagtggttgggctggtacctcagtatcttatattatgatactattttttacatgtcaaaatatgactatctataatagtacctcgaaagtatcgtaaagtacctatcataatacatgtgggtagcaaaccaagcacatatcagctggtatacgtgggtctcagttttaacatatacccagtctgatactaaggtatcacttatgatacctgatagctctagaatttgtggtactaagcatgatacatatatgtattaggttgatacctgtaggtagacccgatacttatatgcactagacatgatacctaggtaccggtcgtgatacatatagttaccaagtctgatacttataagtaccatacattatacctaggtatcagtcgtgatacatgtaggtaccagacacgatacatgtaggtaccagatctgatacttatatatgtactagacatgatacccaggtaccggtcgtgatacatttagttaccaagtctgatacttataagtaccgtacattatacccaggtatcagtcgtgatacatgtaggtaccagacatgatacatgtaggtaccagatctgatacttatatatgtactagactagacatgatacctaggtaccggtcgtgatacatgtagttaccaagtctgatacttaccatacatgatacccagatatcagtcgtgatacatgtaggtaccagacatgatacctagatacgactcatatactcacgctattttacccttgaaacaggaccattcatcatcaggtcacataggatcacatatagcaatagagaatcaagtcattttctcttgctcattggcattggcaactttaacttcgatttgatgcatatggcatcatcaaggcaggagtagtattagaccgttagacagcgacaataattgactggtagtgcatgtactcctcttcctatactactagtgcatgcattagtatatggcagacagtagtatagtacggagtacgactgtactagtactgcatgcgcaaagagttaatccgtggggctcgtgggacccatgcgggaggagagatgggtggtttatagcgatgctgggttggacggtttaatgtcgtgcataacttgtaccgtcctgacaatataccgtttcatagctcttctcttcataaaagcgtctaaaagcgtctagcactaatccatgtactatggttgtattcggagtaatctattagcgcatgataaattaagcattagcaaaaataaacttttaaaatagattaatatgattttctaaagtaaatttttctagaaaacaaatcatttagtgatttgagaagcgtgcaagaaaacgagaaagcagaaattgaaagtggtgataaaaacacaagtttgcactaaataaatccaaagttctacgcaagaaagaaaaaaaaggattagcgtttttggttgaggcagtgtgaagcaaggtgcaaaagcaggacaacggaagcacgcaacgcaacgcatcccccacgcctttggtagcactcgcaaaggcggtataccgccgttaagcatcgcatcctccgattcccattctcccctcccaaccatttctcctgggccttgctccgctccacctcccaccaaaccctaaccctaaccctaacgcgcctaccacgcgaggcgcggcggcggcggcgggcaccatgtccgcggcggtgtgcggcaaacgggcctcctccttcttcgaggacctcccccattcgccgtcctccccgccctccaagcgcgcctgcttccgtggaggttcctcgccctcccgcccgctcgccgacccggccctcgtcgcccagatccgcccgcggttcccctccgtcggcctcgaggtgatgccgtctgctcgtctccctcgtaaattagcagtcatgcgtgttatgatttgagatggaagtttaatctttggtcccaaagtagtacctggtgctggtgctgttgctatgtaaggggtgagccaatcaagcacatcctgctcatgattatgcgtggtgctgtctgtgccgcttgctattgctaggtttaaaggttagatggaattgcagcaaagctaccatatgtacatgtaatctaatcatttagcgatctctttgttttgttccaatcttgcaattttctagtttcctgacgaaataaatgtggcttctgtgttcctatattttttcttcaattatggaatgcaggtctcgcagactttgttcctggttagggtttgtgttaggatttatttgagaatggtgacttggtttatgttacagttcattttttccttggagtgatagcaattttttctatgcatggatttgtatttattattttagtttagtcattgttttctttgggaactgtcgattgtcgtttttgagcggaactggtagatattgagaacttacttacattaatggcttttaactgatgggaatctggagtgcatcggagcatttattaatttgttatccttttgtccgttgatgccgatccttgcgatccgcgcacacctcttcccagaaaagtttttgttgcctagaaaaacgtattattcatataagaattatagccagcaattctatgaagcatctatgggccttatatggttgctttcctcttttcttaaaatggccactcgcgggaatggtatgttaccatatttttttgtttgttcagatagtcatttttttctgttcgtttggattctctgaacaatgtgcttgttgttataacaaagcataatatcctacaatatctggtaaaatttccttaacctgaccactaaagattttcacttgtgtttgtcagctttctagatacaattcgtcaacatattcaaagtatgttcacttgttggagctttttaacgatttagtaacttaaaccttatggaaacttttgttcctgcaggttattgagaacgcgttggaggaatgtgaaaacgattttgattcagcaataaagttcttgttcaatttgcatgtaggacccacagaatgtaatgtggatcctatttatcaatctccatcaggaatgtctactgagcttcaagtggctgatgaaggtaaactttggacctctggatgttgtctatcttctatgatgttatgttgataccatctataagacttctatcttctatgatgttatgttgataccatcttaggtgtccaaactcctgagggttttcattatcaaactgtcttgagaattcttgcaaaattcctgtgttgtgaacagaccctatggaatcagtttttcagtgccaatgttagattgtctaatgatgaattgtaatacaatacggatctgttttcttagctttgttattcacaacaacttttccaattggagcatggctttctatgaaattagtgacacagttttatctcattgaacgcatgattgtggtgcaagtgtcaaacttgggcacgagtgtctgatatggtagcctagggaaaataggattcaaggatttgattggtatatttgaattatttgaaatcacaaaagactcatgcactaatgtaggcacaaaagattattcaactatgtagtgtgaataatcatatttactaagcaaaaaaaaggcattggcacaatgagaaaaggctgctcattaattcaatcacccgtatagaaaatatttcaattcctttattctgtgcatctcacaacctctagatcccctctcctccctagacctgactcttgccatctcctttctctgaaatctcatctgatttcaacgtttgatcaagcaagattccaatacaaaatttagtttttaacgtcttccatttaatatgctctgcatgctatcaagcaattttgtaaccatatgttttttctttatttgaggtgctgacttgaatgcttttggatctccaagacttcaactaaagttgcatggctattgctgtacaacttgagataaaatatcgttttattatatgcttttcactttgcatcctttgtaacttcttctgtatagtgcaccaacaaacttatgctttcgaactcagtatttcaaatttagttctaggcatagaatagaactcctgttagcattaaccaatttgaccactttgagaatattgttctgaagaatattattaagtatggcagatgtgttgctttatggtccaggtattttggctggtaatgaagctgctgtacctataggaaatgctccctgcgctgataactttccatcaagcagcacccagtgggttgagattcttgtgaacgagatgactaatgcctctaacatggatgatgcaaaggctcgtgcctctagagtattggaggtgtttgagaagtccatgaccgctcatgttggtgcaatggggagctttcagaaggtaattcaaatcccttccaagagtgcttcagaactttcagggctgcttgctagttatctaggggtgaaaacggatcggattcggacggataatagctataccatatcctaaaccattttttttaaacggatgcggagcgggtgcggatgacgtgcggatgcggatgcggagcggattatttcggacgtcggattcggtgcggagtcggtgcggagtcggttcggaaacggacaaaaagttgtcggatgtcaagtttgtattcaatccatacaacaagaggacgccaatacaattagccgcaatacgatggcaaaataacatctaaacatgatctcagttctctaggaaaaaccaaccaaaacacatcaataatataattttgcttaatataacacatccaacaaaataatccaagatacatccatcactcattagtcactggtcactgcattgcttaaaatttaacaatataacttataagtcatcactcatcagtagttcagtacgacatgcatgctgcatgcagcatatgagccagcaatgttatccacatcaacaacaacaatagtgttgggactttcattgccactgcccacagttgatggcccttcttccccttcagctggagctggcgacgaggcagcaatgctactttcagtagcagtagcagcagctgctgcttttgcccctctttttctaggtgccattttttacgatcctaatgaatgatgaacaattaatcaaattataacttgctattgacgtaatttccgtaagcaaagctcatctctacatttctaaatcagtaaatcccaaatttgatacttcaaattggactgcaagtgtacaagaaaacaatacctaatctatcgtcgacttgtcgttggactggaacagcagctgcagctctaggcctcgagcagttacagcacgacgacgacacggcacggctgacgacagtggtggctggcgagtggcgacgccacgacggggatggctgctggcgacagccaacagggatggcggctgggctggtgacggggatgtgacggtgcactggcggcccggcgctggagacgtgctgatgggcgacagtggacggagtggtggcggcgccgaggagccgaggaggcgaggacgaatggcagcggcgccaccagcctgtactgcagccgaggaggagcggcggcggcgctagcagccaaggaggagcggccggccggcgctgggtcgccgtcgcgctgggtcgactcgccgtcgcgccgccactcgcccactcccctacgactgagagctgacgggagaaagagagagagtcagagagagagagagggatctgccgatctgggggacagggggaggagaggaaggattaggttagggttagaatagatgggttattgggctagaatgctagatgggcctgaaagttgcggattatccgccaaacactatatcggataatccgattaaaaaatcggataatccgaatccgtcggatatcattgataccacatccgcatccgcatccgcatgacaaaatccgcatccgcatccgcatccggccggatatctaacaacccttaccatatcctcacatcggacggattcggatcggatcggataatatccgctccgttttcacccctatagttatctgacctttgatgtggttatgatattgtcgtgttctttcatccttgtccattctaggttaccaaggtatcgttgttcctactgggtaacctagtggtcagcgaaaaactgtttgagtggagaatcattttaaacatatgagcacattttggcaactctgggttttacatacttctccaggacatgatatagatggataaactaaatgtaaaaaaaaagaagcaaaatgatactttggccagcagaaaacttcaaatcttgaggaccgattctaaaatatggacacatttgatcaagcatatagccatataccaactattgttactaggctagttaaataacttttggggatgccaaaacatggattgacttggatgtatgagttgggagtggattttgatacctcaaggggatgtcctattgttgtttgcatgtcacttaaaaagttataaaaaaaattgaaaaaaatttgagaagatgtattgacatgttatcacttcacaaacatacaagttcaaattcaacttctacatctcgcaaagaaaaaaaaacaaatttgactgaatatgtgttaactagctgtagtttaatttttttttcgttgcgagatgtataagttgaatttgaatttgcatgtttgtggagtatatcacatgttaatacatcttctcaatttgttttcataattatttgactgatgcaaacaacgaggtgacatccccttgagggatcaaacatcatgaatatctatgatggattaccacgtagacttttaacatcttttatttggatgctttccagaggattaacttccaatggttatgaactgaattgcactgcagatttgtgctgattataatctattgtttactatggagaacacttgatggtaagttttaaaataaattaacttctctctgatattcttactttcaaacaggaaagctctgtgtataaggaacagtttgaagcaataaccagggaaaatactattctaaagaaagccgttgcaattcagcacgagcgccaaaaggagcatgatgggagaaaccaggagattcagcaactcaagcagctggttgctcagtaccaagagcaaattagaagcctggaggtataacaatcttagttgttttcgctattcttgtttattggccctttttgaagcatcataagtggttctggctaccgatgttttattttattcattttcttgctgtgcaggtaaacaactatgcactgtccatgcatcttaggcaagctcagcaagccaactcgattccagggcacttccatcgggacatcttctgaataacttcatacctaaaccggaggtttccatagaatgagatatcgttcacccaacaattaagggcagagttcttgttcttggcttatatccaatatattgccaagttataaacatagtttaatgtatgttgtagacctgtgtgtacatgcttgtcttgcgttgtgctgttggccccctaagatgggattgtgtgcgagcaagcgcaaagaaagcttagttcattcgaacggcagacagaatatgatcaagttagaaaagaaaaaaagaaaagaaaagaaaagcgaaagagcctttaaaattattctccaacgtcggctatttaatggttgtatgtgagatggtctgacttgaaatcttagtttcctaaacgagaaatctcaccggttaatggaatttggagagagttgtagattgcgcaggtcatatgctgttaatttgcggtagtggcgcacagctttaaatacccgcagctactcataaaatcttcattttatcaaacaatctaggttctcaatttagattctgggatgggattcaagcaccgtaccagctgttccttacgtttcttacctccaaatatgatcaaagacatgtgcgttaggatttgaacatataaaactttatctacatttctaagttataacaacggtaagatggatggagaaaatagtactttcgcaaggtgtacaccctgttgcaccttccactaaaaaacacatacttcctccgtttcacaatggaagtcattctattatttcccacattcatattgatattaatgaatctagacatatatatttgactagattcattccatcaatataaatgtgggagatgctaaaataacttacattgtaaaacagtgggagtaataggttatgcgactaacataaggtggtttgcgacctatctaataaagctcgtgaaaacgggttattaacacaagacggctagcaatctgaaactgagtagaactcgatctcaaggcagcctttcgcacaaagcagcaggtagatctagaactacgaatgcgaatctaaaccagtgaccactaacttgacataggacacaaactcaacactatggactctgaaacaaaattatgcaaaatactaaaagtggttaaaggataggtataaacctaacactactatattttttggttttttcgtgtactactggatgaaagcaaaaataatacaagggtaaagacgaaactgacggtatacctaaagctttgataccacttgatggcaacgggatgctcgaccttccatcaagtgaagtgaagatagttatcgatttagtggaaacttgacacacacgatcaacatgatctaaaccctgcaatcgcagcgccacgtctcctttggttattaatcgtgccgaaacccgattgacctcgttgagaaggctaatccctgcgtgtgaattgaaaaacacaagcaagagcaagaaagacaacaacttaattacagataaatgattaatcaagaactcgaagttgaggttccacaaatcgaactagcagcgaaactgtaatagcaaaaataatctaagcaaaacccaaccctaacacaatgacaactactgaatatataggttatagggtcgaccttggactcatggacacatccctattggactccaacatgatacataacccaacggacccaaaaacggtgacgtagcacctagactgattctgaacgcctttttgttttgacaattctcattgactcggaaagaattttgatgtaggaccatatccatttcgacgtcgaaatcggagtccaaatgcaatctcggtgataattttagtgtggactgctcctggagcctgaggtggacatgaacttgatatgagttggaccttcatctcggcttcaatgtccatgacgactttgtccatctcttagcctctctccaagtactccataatcctctctatagttcctatcataattaaatcattaggtagcaatctatcatcaaaagcacataaataagtacttaggaacgagctcacctataaattcaattgtcgggcgcgagctctagtaattggatcttgcataacaatttgagaggtagtgtgtgtattaaaaggagtgatgtcctcatcagcgggacagtagcaccaggagagagcggcagcggcggcgttgcgtggagggagaataagcggtgatggtgcggtgcattggcagtagcgcgtgaagggagatgcgctggacagtggttggggtggaccgggggagggagtggaggtgtgtggcaacgcaaggaagagcctgattggtggagtcagcgtggggaaggtgggccttgctggtgaggccggcgggtgatgcggaaaggagggcctctgggagagtggtcggggatggggtctcagacggtggcgtggcagatccaaccgccggtgtggtggatgggggcatcgtgggatccgggcataacaaacattactatttccagaaaggtgaaataaaataaacagtatcttcaatctagacagcaagagcaagatacgtgagatggcaagtaaactatatgaggaggatgatatcttgggtgaaattaagggaccaggaagtgaaaatcagttttacatacgtgcctcttaaaggaatcgactataaagttcgattttcacaaacggttatataaccatatagggaaatcgacgatacaatagttagaaatgttggttttattttagaaaaataatgctatatctcttcgttgattcaaaaagctcaatttgaggggattttctaatccgataaatatttgttatcgtattcgttttattttgtattctctcaatatctgtacttgataatattcgattttgtttacgtatccgtattatcgattccgattccgatgaagaaaaataaaaatgaatatagtagagctggtttccatccctttctgattcgttttcatacctactccatagagatgctctaattaatagggaaaatatacgcagatccttacgaagaatatatgtgggcatgtcacctactggcattgtttagtttgtaaacggccaactatgaccaaatttagacaacagtagtcatcatgattaaataatccaagtaaattgctctacccagccgggctgtcgatcttgtgatgaatccaatttgctactttctacgtgagcacaataatactgtacaaacttattatactttcatcttcaaatataactatttctaatacaataaagtaacttactccaaaataaagctaattctccacatgccccttcctctcaatcaaccacaacccttcttttaatttttcacctattttctcttctcaaccaatcacatcattcctccaatcattttcacctactttcttaatatttgtatctaccttaaaaaatacttgagggagtagtaactgatgatgtgcacacagcacgcatatatatgtaacccattaaaaaaaatccatggccacataccaaaacaccaaatgctatatacttgaccggaatgcatttcaattggatccaatttaaatggctgacccaatatatatcaagaagattaattttcctaaaagaaacatgcatgactccatccttttactagctgcatgttaatccaagctaagttgtaattccaccaatatataatcttactgaaagcacgctaaatatatctttacctttttttaagactaattaaatataatgcctgaaccctgcgcccttcgccagtagactatcacacacgcttacacgaggggatggctaggaggagcttaggaacaggtgatgtggtaataaatcacaaaaaaacaacatggcgcaaattgcaactactacctggcaacaatttgaaatagctgaattaatatgcaaatttgaccggaacaacagaacaaaaacattaggaagcttccaaagctgctcatcaatcgagcacttatttcgattagttgttgctctcactgcaattttgggtgatgatatatgcgacgcacgggtataatggtgaactccatatcatcagctgcataaaatgacattaattatcaggatcatagtgtacatgttttatgtgttgatcgaatatacgacactcgtgattggccgagcagaagggatcaatatatgtttaagcctatgattaattgattataatgatcataccgtaattaattgttcctcttaagtgataagctccatatatatgtatatggctcagaaatacgctgcatgacaactgtgttagagataagtgttgtacttatgttttccagtcaaaatagcgtacttattaaaaagtttccgctgcctgcaggtggcaattgagtgctcagtaagtgtatacgtacacagctcattttttggcacaaggtaattaaatggatttattgtactgatgatgagtcttcctcgtttgcaatgactatgtttagaagtatctgagagatacagctcgtagaattaataggggagaatggagagataaggcttcaagtccactgtttaaattaaaacgttacacattgcattgaatttacttaatttattaattttgggccatgttgttttatgttaattttctccctatatattcctgctccctaggcttatagatgcaatccacagttagccattggagcagtaagctcctactaccaacatgtttccttctcccggcggtagcagcaactccgctgcaagtgagactccaagtgagaaggtaaataagagtactccattgaaagaaaatttatatgaaatgcttttaacttcattgctgattatttcgttttactgtaagtgttctttatattctgcttgtttgtgtgtggaggacgtcctgaaaaattgtttcattttaagcggttgtttatctacatgtcctcaaccgaccaacaattttagtctggtcacatgggatctgactgattccttctgatttggtcccttgttgaattcatatagattttaaatctactgttaaattgctaccccgccgtcccaaaatgatttcttttaattgaggctatgcatctggacaagtacctgtaagaaataatgggacgaaggtagtaccgtataatttatgataatctcaatggtcttgcaccttaaatcaaacaaatatattactagtcaactccaagaacatactaataggatgattgaattgaaatcggagaacacttttaccactattttgtatacatgggata

SEQ ID NO: 58561 - DNA, 3552 bp, Oryza sativa
  unsure (1)..(3552): unsure at all n locations
cactgctgaaactgaaagcaagtagcctactgaagcattagatgttggattctagcaaaattagtatcagtacttgaaaaacacaagccgtacaggcacgggaaacctgatcaagactgcacgagatgtacataggaaaaaaggcaataccgaaccaaatgaatttacaagtgttgaattatgcttgagaaaccagaaaactgacctctgggatattctcaactctcagtctctctcacttaattcagaccaagagaagaaagggtgtgagtgccaaaaagatcaaaggaaaaaaaataaccaagaagttcttgctgcatcaactattgtgtatcaagtcaaccggagaaaagagaagttggttagaaataaaaccaaaagttgcagcggcgcccacgctgcaaaaagcactactacactcctagcccaaccaaaaaagatgaccttaaatgcattcatcaacggcttaaagaacgcattcaccagcacaacgctttgttgcaccttttaacacggccaaaatggaagcctaggcacaagaacacgtacaaaggaaacaagaaagttgaaaccatcttttctcaaagactcaagcaagaggcaagcacaaaacaaactttacaacataaacccaaagctgtcaattaaaaccaagtgaacctatgctcgtttcgtttgcatggtcactcgaaggctgaaaagaacaaaagtgaactaaagatgattcatcattgagtagaagtggagagggcatcagattcctcacctcagagctcaccacgcagcatccaacgccggcctgcaagctaagcactgtctcctgacctcccaacacagagcagaacacctcttgttgatgagaagagtgtgcacttgcaacaaaaaccttgggaaacagaaggaaaatggactaatgtgaagtgtacaagaacaggttaaagagcaagaggactggaaggttatataagaccgagcaacacccccccttgggaaagaatagccntatgactcaccaaccgaaggaacaaaagaaaaacaagattaggtgaagaggacttaggacctaaaccaagatatcaaagggaccaaggaagaatcaagccgatggcacaagagtaccacttactagaatggataagaagagacaaaacagtcagctttttgcactagtaacaatcccccaaaactagcaatcagagtatcagacgatcagacaccaccaaaacccaaagggctccaggagaaggaagaagaagaagacgatggagatggagatggctggccgcttgatcgatttccagaacggagaggagcacacggagaggcgttaaggaaaaagctgtcctctttactactcacgctctcttttccatcaattcgacggcaaatgagctgcctctctctcggcaacgcgtgaggcgtaggctacagtttccatccctgcctgcctgcaagccaaggaacaaccggctcgcgaaaggatcgaaacgcctaccaccaccgcatcagatcagcaaaacttccataactgggcagcttataactcccctccaccattaatggctcatcaagaacggcaaggagtaattgcgagaagaagagcagcagagcgcgaggacaaggaaacaggtgcagaattcagggaagctactactactcccacaagcctactacaacttttggcgcagaaaaggcagagacgagacaggggaatggcaagattacccgggattgtagtggagaagaagaagaagaagaagaagaaaaggctcggttcctacgcgcaggccgccatgtgaagaggacgactagactagcgcacaactagctgcaactagactactgcatccaagaaacggttttttcactaaaataactcggattcggctaattcttttttgggttcagttcttgacacgcgtgtgtgtttccttgattacttctaggataggttctaaattctctcgagttgtaaagggtttgtgcggagatttattccccacttcagtcggaagctgaattggttagttttttctatcatcgtgctcctggccgaacgttacggcacggacttcggccactcgccgcagtggagggacggacagggacaagagagcttggtcacgagcggcggccaagtaggaaaagaaaggagcttttctttttgcatgttgcgcctttggaaattctgctgactaaaaaccaatgttccctttggcatttttctgtctcatggttttagtttttctaaattttctttttttcttaaaaaataattgaaatccgacctctacattcacaccggattaccacagtcaattcattttaaaaaccgaaccttttcatccacaccaaaacgaagagaaacacccnttgacaactgatcaatacatngacatcagtaggagtactgatcggtctttttgacagttgaaactgaggcatgaaggtacatgcagtacatttactgtgagtttattctcgatatttttgttggatcagagcaaataattttcttctaaaggaaaagaacgagtcctctactcctctgccgtgttgcctatgccgtatcagtcactgacatgtggggcccaaagcacagtgagggggaagggggtggcatacgtgtacgtctagtaattcattcactcgtaccagtagctcgtctgttcctcggcgcctcgaccggcgcgacgctaacggccatctcctcgtagctgttcaactgttttcaccccaactgctgcgcctacgttctctttcagattttggtactactgtctttccagctctcctcctctgcatcttctgagcacggcgacacgcccagggaggagaatccagagtaaaaagtctcacaccttggattatctcgcagaatctgtccctaatattcttctatccccttgtgatcggtaaaaattatgcacggagagtagttctttaaaaaaaaattcagcagcagggttttttttgggtgaacctgaagaaatgttgggcaggagccaagagagtccgttggacaggtgaacggttcagcgggaaactgtcaacgattttgaactagccctgtctggttgatgacttgtggcactttggctgttcagatttgagactgttgcttgcaagtggcgcggtagaggtactagcatgaccatgtgcaatctctcatttcttcagtttttttctggggaaaacactgttgatgatgggtttcactttgaaattttggtcgggtggatatgattctttaatactcttaacaagaaaaaaaagaacaattgcataaggtgcctaccaccaatccaaaattccaaagtggggcgaggtgaattgtgatgttaggaggagaagacagcccagacaatccatggtgattttgcccatcttttgtcttcgtcacagtgcatctgcatactgcatttccctttcaaacaggaggtgctaatgcaatctcgacatggaaagattcaaaatttcactatgaatcaacgtgaggagttggctccccatttccccaacgttcactgcaaggcatgacgaaggacagtg

SEQ ID NO: 58562 - DNA, 1000 bp, Oryza sativa
aggatcaattggagggattccacccccaaagcccttgtcagtgtgaataccaaaatagtaaattgttctctttgtttttaacttgaacctttgtgaaatacccaatcgcaacaacaaatcattgcacttttgtgtttttgtttgctaccctacagatcttttaactcgcatgatgctcggtttcaaaagaaaaactcgcacatgcttggttgaagcagggatgaaggcccaaattatgaaccctagtccaaagtggtgcaaaaagggtaatgctatgtggtgttaagtgtcctggacagttaggtctgctcttggtctattgtgaaactttggttaataaagataaccaaagtaaaatttactcaaaaaatatatcagatttccaaattaatatgcactaatggaccaatgcaatctttgtgcaagcttggatatttaatctgagcacaaccttgaagtaacagaaagccagaaaatcctcagagaatgtgtaagaaatgtggcaaaactatataaaatttcagaaaagaatactattatgccgagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaac

SEQ ID NO: 58563 - DNA, 668 bp, Oryza sativa
tttttcggccgattactcacagactttatagttgcagaagaagaaaattgctgtgaaaaagaaaccagcagcaacaattctcaaaccggctccaccagtaagttattttaattcttttattagttgattccagccgattttgtctaacacttgtctcttttacaacctcctccttcttctcctcctgtgcaacaatcatcaagtgaccgaactccatcggctgtggggagtcaccatgttgagaaagaaatacaaccagctgctcctgcaatcctggtaagttttgtcttataaaaattttgaatcgaccacataactcatgtcgagtctcaatttttagaattctttcttgcaggccttagccgatctattttccttcgacattaaagactatcttgatgaagaaacagaagaatataccaccagcaaatctttagttcccttgtccgatgatgtaaagaaaacccttgaagacatctctcatcggctagaagcatcatcactggacaacttggtggtaaactgtgggcctattaggactcggctacatgagatccatcctctaatcccagatgagctagccgatatccttactccagctatctatcttgagcagcatcaattcaagctagagaaagccaagctagattagccggacgtcgggagcg

SEQ ID NO: 58564 - DNA, 11766 bp, Oryza sativa
gcacccctaatttagctgttagaccgcagctttcgtgcgtattatttatttgtcatgtttaagttgtactgtgcaacatgtttgtcacattccgactgaacctggcattagttgctttctcatttgctggtcctttgctccttatcaaaataataatccagtttaaactggtgaacattaattattttgtgattgactattgttctatcccttcttttgtttcttattctgaacacaggtgttgcattttctttctgagatttgtgtttgttgatttggtgatttggtctgactttgaaacgataattacctttccctttcaaattattattcgaatattcaatatgtgagttgacatgagtttgctaacttttgttggagtcaattttgtcgtgaattttcattgttatcttgttcagaagtccaaactaacatataaatagtatatggcatccgcattgcaattttttgctttcttattctattgtaacttaaatcgagcaaaactaccaaccgtgatgcaaaatctctatctcagttcacagtctacctaatgagatgactaggagacaaacacaaagaacaagattacacaaacacatgaagttcctcgggtctaggtaattccttcccgccctctgaacacaagttcaagaataaaaacaaacaagaactaagcacacccaacaaccagaagagggggaggaaaactctaggcactcacactacacatggtacaaaaggtgcacaacacaaattgatttatcctcagcctctgtagcgattgaaaaacaccttttcccaattgctagtgcattgatcccgtccccggaaaagccagggtacacttcaacaatcatgatacaaaagacacatatttattgtatcgataatatttacattattacaaaggctcttcaggcctaacaaacaaaaaataaatagcagcagaccagcgggcctacgacaacatcttcataggcgctcaactggggtataagccaagactccacctcggacttcttttctaaagtttcttttactgaaggttggaaagattgagcaagaatgagtacaaccacagtactcagcaagtcaaaccgggagaggcatgattaatgcaaggggtacaaggagtaataacatgggggttaggttaaaaattagtttgactccaaattgaaaaccatgcttctcaacaaatgaaacttttctatggttgacatgtacactctttatttttgctaacacttacttgtgaacatatatctattgtaggaacccttgctaatctaagtaattgatatttgtgatatggagatgacaaaagaaattcctttctaactgtcatgatatttgggattttatctttgcaaaaaaataaatttttgagcaatactccttagtgactatatgattacctaccaaaggccaaatatgattcatcttgcaaaccatatattttggttgcttgacattacattgagccttgtgtgtgacctatgtgagatgcttttcatgctttatgatcaagatcacacacactccacatagattaacatcctgaacttctacactagaagctagtgtccatttcatccatcatccacaaaataaatactcctcgttatttatgtatttttctccaaagttcattcaaaggaaaagggaggcatggctatgcaaaagaaagaaagaaagaaataataaagtcttgctcatacaaatatgaagcatgagaacaaaaagatagccatgccatctctcaagtctcaaaagaaggagaaagatgtgtagaaggagttatcattttccttttccacccacaatcatacacatgcacattcttgatcagaaagtgtgacttgctatctccttggggccccttttttggcctggcaaaatatgtgatgcaggtacaccccgattgatccctaccgagctccacatatatagccttctagaatagggacaattcggcaatacatgccttggtgaggatccaacaatcaaaatgagtgattcaagagagtcatatgaggagtatagctatattttgaaaatatatgaaaaactcaagtgattgacaggaggaacaggaacgacttgagtcacgaccattcgatttatcaattacccaagatggtaagatagacactgcaaagttcataggtataggtgtggcttagaataaattgtatactagtaccataccttgggatgttttattccacaatagtccttaacctttagtcgagatgagtaaagagctaagtgtgggggtttgttgtaatgccccgattttcattcaggattaaaaatcaattaataatgcattttctagaaattaaataaaagtaaagcaatttaatcaagtgaaattattgagggaatttaaaatttcctttaaaaatcatggccgggaatattttgtaatattctttgcgccctaaaatattctctaaaattttcccgtgaattttcagagctcaagaagtaattataataatacaaagttcattaaaccaattaaataaaaacgaaaacgaattaaaatcctccttctttgatttgggccgtttccggcccaagtttcctcctcctcaggccggcctccctcctctctccttccttctcggcgcccaaggcccgtccccttgcaaagttcacttctccttccccaaccgtctcctcctccctccctcgccgacaggtgggcctggtgaccccacttgtaagctcctccttctaccttcggcctccagagccgaagccgccatgcggcgcctttgccgtcccacgtcgcccatgattccggcctctcccgctcgtgccctcgcgcccaaaccgcatgaaatcggtttccctccacctcctctacactctccccatgtttcccccaaaaatcgtgccgggatcgaactccacttggcccatgatgttgcccatgtcgccggccattgccgcccgattctgccttctcgaccacaattttcctcccccgcacccatataatgcatcgcccagctctcctctaccgtttcccctcctcccccgagcttcccatagcctccctcgctctccccatgccatcccccacttctgccgctttccggcgagctacagccacgtgctaccgccgccatagccgccgtcgcaccatgccaccgccaccactggctccgcagcgccgagccaaagcccggccaccacttcccctccccaaaccgccgcggaaaccccgtcgccaccaccaatccgagccaccgccgcctccaggtgcctcccgccatcgagcgtcgcctcgctcagccatgccgccgccacccacagcgccccgtccaccgctcctcttccccaatgcattgccaaaacgccgccgccacgttcaccatctctctccgccaccattgccgcctccagccgtgccgcgtcgcctctctggtccacctcgcgctgcgcagtcgccttccccagcaccgcagccatcgtgcgcagctcggcatccactccatctccctcctccacccccgaagcactactcctaccgcgaacccaagccgccactgccattttgtcacatcctgatttttgtttcaggatttataaattatttaataaattattaatagaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcgtaagtatttatcgttttagttaatttgatgaatctgtatattaaattgtcagtttgtgtacctcggctgattcctggacgaggattttatgcacagataagttcggaaattactagtgaatttccgggcgtgacaagttggtatcagagccatctcgactgtaggataagccaaatggtcaaaccttaaggactaattttccgaaaatatgatttgtgaaaatttctcctttcttccttatctagaattctttgcaaattgtttcgttgtctactcccctctctctttcaacttgagtagttctgagacattgaaacttgaagacgccaatgatgtcaacttatggaggtcagtcaagtggatcgtggaaggaccgaagtgccaagtggtcaagatggaatgaagtttggatcctatcttagaacctatgccaccaaactatcctcgaagaatagttagtagggtagaacgtttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttatctttagtgtaacccctctccttctatcttctctaatatgcaacagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgacgcagaacaagttagctgattttcttcgtgtgaggccgcccaccttttctagcactaccaacccagtggaagcgggtgattggctgcacgctgttgagaagaagttggaactgctccagtgcacggatcaggagaaagttgttttcgcttcacatcagttgcaaggacctgcatcagaatggtgggatcatttccggatgaacagagcagaaggtcaaccaatcaattgggaagagtttaccgaaggattcaagaagacacacatacctgtaggagttgttactttgaagaaacgtgagttcagggcattgaagcaaaaggatcgtaccgtggcagagtatcttcatgagttcaaccgtctggcacgttatgctccagaagatgtgcgtactgacgaggaaaggcaggagaagttcttggaaggcttaaaggatgaactgccagttacgttaatctcccatgactatgttgattttcagcagctggttgacaaagtaattcgacttgaagacaagaagaacaggatggataaccgtaaaaggaaaatgactgtattctaggaggcacaaggtagtagccagagacagcgtatcaagccactccaaattagtgaacctttttccgctggtcaaggacagtcgcaacagttgaacatcggtggtgagatcaaatcagagactaatgaaagcaatgaagttaacatcgagcaagctaatcagccggtgccagttcagcaggaccagtctcaggagaataacagtagtggaagggagcagcaggtatgtttcaattgttacaaggcaggccactttgcaagagagtgtccgaagccgaagcatcagcagccgcaaggtcaggtctacaacattgtcgtcacaggagccaatgcggtgccagttgtgtcttcaagtgttacaactcagccaccagtttcaaagcggcagtagttttctttaaagccttagaataattatcggagttatggaataagatagactgcagtttacctattcccttttctttctagccgttccgaatctcgggacgagattctttgtaaggggggtagatttgtcacatcctgatttttgttttaggatttataaattatttaataaattattaatagaatttatattaaatgttctttaatttacaagtgaagttaaatgtgggaaataaaatttcctaaatctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggatttattagaaatgatcttaaaagcctaaaagagaagatctaattttaatttgctaaatctcaatataaaattgggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctccctcggcccaagtcggcccagtccgcagtcgcagccgcccgcgcgagcgccctcggtcgctgacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcctccaaaccccgatctttccttcgtgtcaccggtcgccgtgggccttcgtcaccgcctccttgcccctttaaaaggacccccggtgtctcctctacccgtcgccacccttgccttcgtctctagccatcggaagcgccctagtgccgtgtgacctcgagccgccgtcgtcgccgccgctccagccgtgcttcgccgtcgctccagtcgtcgccgtcgctcggggaggtcgccatcatggtcgccaagtcgtcgccgtccccgtccaccgcttcaccgccgccgaagaccgccggagcaccgtcgtcaccgtcgacccgaagaccgtcgccgcttcttcctcgtcgccggcgccgtccgttgcttttccgccgttgttttggtcaccggtgagttcgccgcgtcgccctctacccgttggtgccctccgtttgcgtcgtcgtgccgtcgttcgccggcgagcatgcgttgccgagccgccgccggtgctgacgtcatcgctgacgtagtcgctgacgtcatcgtcgccgttccccgtggctcggtcgtggaccgtttgatctcggccgtccgttttggataggatcgacctcggccgtctgttcccgtgaaccgttgccgtgcacccggtccaccgcaaaccctagccgctgacgcaataattcccttttccttttcaaaaataattcaatattgcgtcataattcaattaaaatccatataagtgttttaacccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattatatttaatctagtaaaattcataataaattcatttgaagtcagaatgaggcccttcaagtctcataattcatctaaaattatgatctacatgtttgtttactttttatgtattgtttatttagtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgactactttattccttgataccttgggttattataacttgactagttgggctttatatatattggttcagctagatattagttatgattgcttagccatgcttagaaacattagcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtaccttccagtatcgcgacgcatggtagacatgatgttgaggctgtgtcttgtgggtacagtggtacacctctggccagagtaaaactattcgaatagccgtgcccgcagttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaattcctaattaattactccactgttttacttctcttaaatgttttgctaaaagctgcttttgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttattgttttagttaatttgatgaatctgtatattaaattgtcagtttgtgtacctcggctgattcctggacgaggattttatgcacagataagttcggaaattactagtgaatttccgggcgtgacacatttgccacctccagctgccgctcgtcgccacttccgaccaccccaagtcatgccacgaccaccattagctccaccaccgctccactggctccaatcaccgctccagccttcttctccctgttgacgtcgtcccggtcgctgtccgtcacctcacgcccgcagtacaccgtcagaccgccgccatcgtcctcaccctgaggagctcaccgccacctccctccgtcggccatctccctccgttgccgtgtcgctcggtaagcatccccctctcctcctcccatcccttccatcgcttcccgcgccaccgctcgccgtcgattgctggtggctgtgcgccgccgcctcttagctgtccggccgtgagccaccgccgtcccctttggccgtgcaccgccaccatggactcggtccatggtggagcaactcctttgacccgctgacgagtgggccccccgctttgtggacgtggtccgcgctcctcctcttgctgacgtcagcgagcacctattttcctttgagaaaataattattaattgcgtcataaattggtaataattatagaaatttattaaaatggctcaaaacttctaaaattcatatctaattcatacgaactctaaattgggccattcaagttgcaaaattcatctaaaattgagctctacatgtttgtttactttttatgtactgtttccttggtttttattagggtttttcctcgttttgcatgccaacgtgtagtttccgcagtttcggaagtccgcggtcgcgaggaaaagagttcggaagatcaaagtgaagaagcaaggcaagtcacacattacccttgagcatattgatgctactttataaatgttttgtcgtttgcaaataaatatacatgttttgctaattacatgggatccgggtattacctatgctcgcttgtgccatgtttacttgttacccgacctttgtcaacctcgggtgataatttatctagctcgtgatacttatgttgtcctagctagaattatatatgcttagccatgcttaattaccactagctcacaaaatgggataattacattattagacatctagtattctgacgagctgtgtgctcgatgtcacgcccggaaattcactagtaatttctgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggctagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctgaaaaaccagaggcatggactccccagcgacccccgtggacttctcgccacttctcagtctggcgcactataatgaatcacgctat

SEQ ID NO: 58565 - DNA, 1019 bp, Oryza sativa
ttcaatgtgacacccaaaaaatttctttttgcgaactaaacacacccttaggcttccatcggatggcctaatcagccaaataaaataccaaattttaaatttgcaaacttaattttgagatattttcaacgtagtttctttttcagtattgacttttaagtcaccaaaaacacatatattaaagttttaactacaattttatttttattctctaatgagcagttttggtttattaggaaaaagcaaaaggatagggcctttattctcaaaccatagcagaaaatggacattatgctattttcaaggtggcgcgggggatggatgaccaccaatcgggtgtgtcaggcctgcatcgaggttgcgcggggttgcagcctcgaggtgccggaccggagctgcaggccacggtggagcgcgttgcggtggcactttgtggcgcgaaggcagtgagcagcgaacaaaaatggctcaactaatcgagaccgacctctctatcaataaccggctgcagggacattttcgtcagaatcagatcaccatgaggaggagaaaagaacaattcaaaaatcagtgaaaaagataaaatggtgattcggtgagtaacgcttgcccgagcttcgcatttcatctaatcgaattttatggatagcattccagcgaaaccgattttaaagatagcttgatatccattttctccccccagcaatccccagtcatataagctttgcgcgttacaaagcaaaaacatgttactagtgttgctaaacacatcaattagcgagcgtcacagcaagtctcagctggcccagctactacccaaaccatgattttttttcatttttaattttttattttttaatatttacagaaatattatactgatgaaaatatttacagaagtagacggcagggtgacgtgagggacggacaagttgaaaaaaaatagaaaaatgcattctaaaaaattacattaaccccggcagcaagggacctaagtgcaaaatgcgcacaccttgccg

SEQ ID NO: 58566 - DNA, 649 bp, Oryza sativa
ctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgttcacgttcattcgcgttcgttaacgtttcgttcacgttcgttaagcgttcattcacgttcgttcacgtttcgttcacgttcgttcacgttcgttcacgttacgttcatgtttcaatcacgttcgttcacgttcggcaatgtcggggcgcgcaacaatggcggcagcggagcgctggcgtggcggcgcggcggcggcgtttcgtggcggcgtcggggcgtctcggcggcgtggcgtggtccggccgcgtggggc

SEQ ID NO: 58567 - DNA, 681 bp, Oryza sativa
cgggagaggacgaggagcagccgcacccccaccgctaccccgagcgcggaggtttcggcggcggcgagcgcgtgcggcggcggcgccatcgcggcgagccacaggccataggaagaggcaggtgtccagggcgaaaggccacgaaaatgcctatgaaaaaaaaaagaaaaaaaaaacgtagcgaagccgagacgagagagacgaagtggatggcgaggcgcgtgacgtggcggccgccggcatcgcgcgttgagatttttctcgtgttgacccgcacagcgaccgggccgggagcgacgcatatgccgcgtgccgcgtccgcatatgccggcccaggcccacttcagcgtgggcagttggtccgcttcaccgcgaatccacgcggacgtcgccgcggcgaggcgatcgatcgatcaatcggcgaagacgacgacgacgactgctcgcgagtacgggagccactgaatctgtcgtcgcttcaggacacgcggagttggtgcggagtcagcagcattcagcagcaacacacctctgttccattccatcgctgcaagcctgcatacactcgggtcctctacagtaatgaactgaatcactggttgatgctaaaagcatacagtaatgattacagtatgcattcttcccagtctcaacatcaccaacatacgattgaagatacga

SEQ ID NO: 58568 - DNA, 544 bp, Oryza sativa
tgctggtggtatattcttctgtttcttcatcaagatagtctttaatgtcgaaggaaaatagatcggctaaggcctgcaagaaagaattctaaaaattgagactcgacatgagttatgtggtcgattcaaaatttttataagacaaaacttaccaggattgcaggagcagctggttgtatttctttctcaacatggtgactccccacagccgatggagttcggtcacttgatgattgttgcacaggaggagaagaaggaggaggttgtaaaagagacaagtgttagacaaaatcggctggaatcaactaataaaagaattaaaataacttactggtggagccggtttgagaattgttgctgctggtttctttttcacagcaattttcttcttctgcaactataaagtctgtgagtaatcggccgaaaaaatgaagtgattacaaaaaggatcaaagagagctgcttactcttgaaaaatgagttggggcagaaggagttggaggggtctgcttgggtgaagccgatggtgttctttctgtatcgc

SEQ ID NO: 58569 - DNA, 6513 bp, Oryza sativa
taggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgatccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggaaaaaaagagcaacggggaggcaagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacgaaaatcaggatgtgacactcgagacatctggccatgtttcatggtcgtaattatccaactaaaatatgactgaatggtgggctatgggtgcatggttttgtgagtcgcacccatggcaattaaggaccagttcacgggaaaccctagaagacatacagtgcttgccacaagcgggagtgggtaactgcttgatctgaagtatagctcaaccctttcctaggcatcggtggcaagggtgggcgtgatggagttaggtcggccggggtgtccggttgtctagctgccggattcaccgcagcgcacaaggggactgcccacctccggggtagggggtgggggtgaaaccttagagtggtgtggatggttaggggagggttatatgaagggtcttgtcacaatcactcgacatggtgatgtgtcaggcctggcgcggtgacatgacgatggattgtgtcttgtgggaacaattgtgcacctctggccagagtaaaactattcgaatagccgtccccgcggttatgggcgatcgaccagattcaccgtgattagtcccaccttaataaattgactcaatgcactgtagttcaggtgggttggttggacctgttcaacgtggtgtagcgttgatcagtggagatttaatgttactttaattactcaacagttttaccgttttgctcaataaaatgttttacaaccgcctttatgcaaattgccacaaaccgtccttgtatccccttgcacgtttgcatcgttagtgtggcttgctgagtacggtggttgtactcagccttgctattgttcccccttttcagaagtgtagtgcttctgagctgaagatgaagttagaggatcaaggctcataccccagttgagttttgcctgtggagtggagctaaagcccagctaggatcgcctttttccgctgctactggttttgtttcggtgtgaggactaagtgctcttctgtaagtattttacgctttatttacgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaggaggaaggagtgggccaggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgtgtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggggaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgctaccaatccgggactaaagatcgctatcattagtcccgggtgaaataaccgggactaaagatcgatctttagtcccggttggtaacaccaacgggactaaagatggctcagccacgtggccggatgagccatatttactcccggttggtggagctgaccatttttttttttcatggccctgttgctgcatggtttatatatattttatatatatatataaaccatgcatatatatgtttctatacatatatatgcatatataatatatgcatatatatatatataatattatcattgatatatgttacaaaacatatgtacacgcataaaataaatgtatttataaatatatatgttatgcacatacatatgtatatatatatatatatatatatatatatatatatatatatatatatatatatatatatatatatatatatatatatatatatatatatatatgaccaaaatatatttacattatagaaaatgtgtacacatgcatatagaaacatatgtagtcatgtattaatatatatgtatttatacatatatatgttatgcaaatgcatatgtatatatatatatatatatatatatatatatatatatgaccaaaatatatttacattatagaaaatgtgtacacatgcatatagaaatatatgtagtcataaattccttgtgtgtggtctggttatccctcatgcgaataaaatatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcagtacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagttt

SEQ ID NO: 58570 - DNA, 8297 bp, Oryza sativa
tagaatactcaagctttgatatcattgttgacgcaaaaaacacacactggcctgagagatttgctttactctagtgtagatccaaagattcgctttcgggttcagagcgtgccagttggtttgatcctgcaactaataagaaacagagaatccaaagttaaatccataaacgataaccgatcggctagattgctgatgatgtatcgtctaaatcaagccgatgcaatctgatctagatcatcaatggagtatataacgaataaaggactaaatttaatttatcggctatagatatcaataatatataatctatacttcaaaatatatttaaaccaagtgattgggatagatcggattgctcccgagacagtataaattacttatgtctaaaagtacccccaaagtaaagattatataagctcatgtcatagcaagtagttaaatctagcgtgtatcggctattgctctgatacttctttatactaattaagatatcattgtggattaaatatattaaacaataatcaatctattgttagtttaatctaagcagattgatatcaatcttaacatattttaccttattgagatcttgatataaagggcaaatttagcataccaagtagataaattaagaacgagatagctaaaccaggtaagatcagctgaaactctgatactatctctattgattatcatgaagcaagctagagattatggatctagatgttacttaataggtcaaactcaactgatgcggcattaagcataaggagaaacataatatctaataaacatgccaatgaaaacctttttgagatggtagatatgctatacaatctaactcgacgaacttatataattctatcgggtgatctcgatgttgaaaactagctgacaaaaccagataagaatattggcctagattatataacatatgtgataactcgatgatttatgtaaacaagattagggtgtcataaagatgtaagcactaatcctgagaacgcaagccgccataacaagttttatcttttctgtcggagatcgcaaccgatgcagcctaactcgaaagcaagaacttgtcgaaacaatgaaactagaaaaaagatggcgatacactgaaagtgttattgaactgattttaattgtttacaaggtatcgggtcatatttatatccaaaatacataatatgtccttatcgaacacgactccacttctattacaactctaaaatacgaacaagtcccttaggcggactcttaccaaaaatatctataaggaaactactagaatatcctaattaatagatacaattgccttcctcggactccatccacaattggcaatacttatgcaccaccttaatcgatcctgacaatgattctagaataatcttgccaaaatcggctacatcggtttctccctatctgatttggtatcagctgatgcaaacggtagctgacgcgcattctgtttctgagaataacaaacttcttccaaatctgcttcggctttgactccaaatccaatctataatttaccaaatttcgttgttaataatcatctgtaacacccattgttcaaatccgcaataattcactaaattgactattttcgcataacaatatcctatttctactttcctcctcacattatataaaagggttaacccgaaggtactatggttgaagctaaccaggtgtaaaagctggcccaaatctatctaaattatccaggtgtaaaccggagcaagtacacgcatacgggctgaactaggctatgtacgtgttggggtattacagtttttcctctatgacatagttgttacagatagttagaaatgttttctatggagagaaaaaattttagtagtgtattgtggagagactcttcattaaaaatagtgcaagctaacatgggtgtctgctgcaagagaactggtgatagtggcgctagccaagaggctgtcccaaggaaataactggcaaaattcgctacagaatactcaaaatttgtgtaatttgtttgtacaaattgtaaaaacgtgtcacaactaaaatatacttaaaaaactgataatttgttggaggacactttcagcttaattggagaaagaaattcttcaaaaaaaaagaatacccttagggtcaaaagcttttaagatgagactggagtgaaaatgaaatatgatgtacgctagtgatgtactttgggtgatggcaaatttagagttgtataacttctcaattttattttaatatatcatatttgaagcatgtggttctaagggcattctcgtcttttttaaaaatgtatctctccaattgagccaaagtgtcatttagcaaattatcagttttttaggatgtctttcagtcgtgacatatgttttcaatgtttatcagtaaattacacaaaatttaggtgtcttgcagcaaaataagtaagagaacaggaggttagtaggatggcgagttggtttcactgtaattttcatttgtcggagaattaaactgcatgaatatgtgtaccatgtaggataaaacaacttccaaatatagttttagaaggagtaaaatgcacaacatgtccttaaactcgttcaaccgtgtcattcaatagtgttattcccgtccaaaattgccctgactcggaacctcggtatagtagtccgtgacctggaacctccgtcgttgacagtgatgtgcttaaaaccaaagaaaccctttctgcatgggtagctgtgtacccttatgtatagtgcgtcccacgcaggcgtggtagggtgatgaaatgaaaaagttccccatttgactgtgtcaaaagaaataaaaaggtgtgggcatatatatatatatatatctgcactaaagaacacataaactgctggtggttcacagcagaagcaacggtgtacatcttgggcacacggtttaacgagaggatcaatgcgcacatatcttacttttggagtgttcaaatgattcacccatatttgtttatttttgtttcctcaactcaaatgatctgcatgcaagcgtgcatcatgatcaggttttatttttctccggaagaagtaagaatttttatccaacattttgttttaaattaatgccgacactttggtagttgggatacaattctttttagctcgggattactatatcacatacttcctccgtcccaaaaaaaaatcaacataaagggtagtccaaattcattgtcctagaaggggtcacgtcccctcctagattaaattttttttggaacagagggagtatatttttatagattattaagaactcgcctccgtgagaggtcttatttttatatttctaaaagatgccacatgataagaaataaagaaaattgatgattggaataacttacgcaatacattgttttacttttactgtttcataagcaataaatacaagagacaagcatgtatcttttcaaataaaaagagagacaagcatgtatgtttacaaacaaacagtacgttgtctttgaattgtgactgagatgaactccccttcatcactgttgctcctcagacgttatcggttcagatgagaactacatagaaactctgcattgatctatttatatgaagcaaacatatattacaaatgttagcgtaggatcgaacataataatcaaacctaccagagaggaaacctgtcagagaagggtgaattgtagggaacactaaaaatcaaaatctttagcggaataaaataaatcctagacaaagttgcaatatgactgttgtagttgctccggtgtaacctcctggatgtcctgcgatctgaccgccttgacgttaccagtccaaccgcctgcgtgccaccagtctgaccatcgagaactagaaaacactactgaaaagagctacaaagtagatcaactttattccatcaagacgtgtttacaaagtacatctaaagcactcctatctaaatttacaaattacaatctaaacataaaagcaaaccctaacttttctcttttagaaaatcgatgaactttgagtctcagccctttttctatttattcccaaaatatgactgcccacagccatgaatttaactagaactaggaatcctaatcacatagataatccacacatatccctttataactccaaattaacttcaatcctccgaaagttggacttcaatctatgcatgcaattccctttgtgtgccatatagaagcttcacttccacgtgcattgttctttagcctttatatcttgtgtgatcttcttaccgtctagacctcaatttttccaaagtctaatcccaatccatcactgacaatattcccaaggcctcaagcaacacctatacacatgaacaaccaagaaaccgtatctgagtataagttcttactcaacttgacgcacattagcacacaatagtataatatacatatagaaataatttagaagttataaacatcaacaatcaacatagtctataaaaaaaacaagctaaaatcggctccaaactacacttagggcccctttgaaaagcaggataggaaaaatataggaataggaaaaatgtagaaattgaagttgtatgtttttccaatcctacaggaattgaaaacacagaaaatggagagaagagccctttaattacaccacaggatacactcaacaaaagaaagtttcttaagaggtctaaccttttgcttattttcctatggaattgatcataggaatgcaatcctatggaagtttttctatcctctttctatgaatcaaagggctctatagaaaaaaaaattcttagaaaaatgaatcctctaaaattcctttggtaatcctccatttcaaaggggcccttaactagtctaaccaccggactgctcgaacaccttcatttagatcgcaattacccggtccggtgtgaccacacatacacataacgtctaaccggccttactagttaccatgcgatttgaccgcctgcaccctgacacttctccaatttcattaccacttcataaatattaacataatcactttttttacctttgagagttatttattaccaagactaaattatcacatgattttcatgattttaaagtaggatgctgtatgccattactgaagttaacaacctgacatcctcattaattgttatagtggagaatcctctattttagttctatagaggccatagcaatccatacgcacaccgctaggtggtatgaagtgatgcaagcaaggcatatatgttacgtagcaccaggtcaatcatcatgcgctagttaggacgagtgccgtgcacaaaacgatgaaacatgcatgcattcggactatatattagctagcatatagcatattattgatgcaggatagtttcatgtgtagtggcccaataaatatcgcaacatatatctcatactccctccgtccaaaaaaaataaatatcgcaacatatatctcatactccctccgtccaaaaaaaaaagcaaactctgagtttccgtgtccaactttaactgtctgtcttatatgaaatttttttataatttatatttttattgttgttagataataaagcatgattaatattttatgtgtgacttgtctttttaattttttttataattttttcaagtaagacggacgatcaaatgacatataaagcagggttcgtcttttttattttatttttttttttttgacggagggagtacgagatagtggcgccacgtacatgcagagatcattattccaacacagcaatgcacatttcactccgatccccaatccaatccaatcccatcacagcctatattctataaatcgccagcatgacatatatagcacacacatgcgtagtcatcatccggtttttgcagcgaagagcaaactgtgtgcagttattatagaagcctcatgaatgagtcatagtccatacgaccaagttaatcggcaagaattttgaaaaaagggttaaaagtccacttagagcaagttcgatagtatagagccaactactaattctaaatcatttataaacaatctaatagtttatttatacaatagttacttataagcatatactacaccgttaatatatggtcacacctctcgtacacacagaatatattggagtctatgttgcagctggctacaaatctgtacgttttgcttctctctctttcatatgtacaaatagggtgtgttcggatatccttttcccaacccctcttcctcgttttccacgcgcacgcttttcaaactgctaaacggtgcgttttttgtaaaaaaatttctatacgaaagttgcttaaaaaaatcaaattaatccttttttgaaaaaaaatctagctaatacttaattaatcacacactaatagatcgctctattttccgtgctcactgtgctagcctgctattgtacttgatcttactctcccaaaacttgcgcgatcgatcagcaatccatcagcacactggcgtattatcaataggttatttgacacccctaggccatgcattcttaatgacaaggtatttaattaattattgaaatagctcgtacaatacattgtttaatttttgttattcactacatagaaacgatttttacagacacacttctattttatcataggcaagctaactgtctgtacctaaaaagatttaggtgttgttcggttaaggcccgcctcttaagaagcatgtttgtaaaaataggctattttcacaaacgggtcttttaagaggttagcttgcaaaaatccattcattcctccgcctatagttcgcgcaacggccgcccctccactcattatttcctccagtccacatgtgcatcctcccggctgcctcccctttttaatttatctcctttgtctcccactgccccccatgacttttctctcttctttctgacccacttctctgatcttccacttcccccttctcatctgtcatctcccccaccctcctctctctcccatggcagcagcggccttggactaatcagatctgccgccagcgcctacagcagcagcggatccgcccaatctagggacggcaggagcgatggtggtgaccacagtagcggcggccttagactggccagatttgtcacctgcacccatgagagcggcagatccctccagtccagggatggcgggagcagcggtggcggcatacgggcttaggggtagcggcatgctcgggaagagcggatctgccacctgcgggctctggagtgatgacgatgatgacctcgtcgagggctgcaatgacggagccaacaagctgcccgctgctagctgcgacaatgacgggctgcggcggtgatgatggccactagggttagggtttctacatttgtttttttatttctattttaaaagttcgtatttgggcatcgtaagttgaccgcttacaaaaattgtgtatttgcaagcaacctccttaggaggtctacctgtgaaaatcaattttcgcgtgtggttggaacacctgcatgctaaaatcacgatcttcgcaattacctcgagagaggcggtttacttgttcaactgcaaaaaccacttttgatcgtctgaaaagatgttttctgtagtagtgatttcataggcaacacaaacaagagacgagctatgttagaaacatgtgtagatatagtttcatcttgatgaaacttattttatctctcacttcattaattcattaccacatcataaaaatgcttacatcatattctatttaacgagaatgaaatttctatcgggagcggcctaaccgtatccagatagaccttaaatattgaagggtggctttacctacgtggcaggtacgttgactgaacagtttttcacatcacaagttgatcactggaccataagtgtttctttggggaaagaaagtaaaatgctttcattaattaggccctaatataatatatcagctggcatgggcttgtacacgtcatcatactatctcttcacaacctgtagttgagactaacgaaatgtcatcaacccaccaaaacatttaatttatcgttccttccttccatttcatacaaccttaagtagcaaaattccctcttaattatcttgcgctaacagtcggtgttaaacttaacatgacatttctctatcgtcacgtcgttctctcttgtcaacatcagcagattgatttagttgacagtttttatgggatagctattaattcctgttgtgcatgccagatgggctaggcagaggatagggctactgcaggttccctagttgtacgaaagtc

SEQ ID NO: 58571 - DNA, 1550 bp, Oryza sativa
attcatgcatggaatgggattaattagctgcccttgctacccattgcccataaccacttgcaattaattcttcatagctacccgatcagattatcttcacaaaactacaaataaatacttgtctagataacatgcatcatgtcatgaaattgcgtttgtcggcaccagctgggtgagaatctttcgaactcactatcttgaaaattgaaaaatacatattttttctcttgagaaaaaagacaaattctagatctttcacgttgttccacggagctcccggtgccgtttgtgcttttgcttcgactacccacaagctcgggattttcagcgagttcaacgggcctctcgtgatgtagaagtcaccggccatctacacatttcttttttgtttttacttcacttttgcttctgattgggagggaggccatgtgatacaccgacatgtgggatatgagcttgacacgaatcacgctggatcccacatgtcagtgacctgtagcatttctctcggcaaaaaaaagagagaaaaaacccaacaatcttttttgtggccgtagtatatacgtaatcgtgtgaacttgatccattttggacggtggcgctgcccccggcgtggcgtacgaccagcgctctgcatgtgacccatcacgagatctgtgaccatgtcctcgtgtcaggacctggcatcttgcagctcacttgagcttgctattttatttccggtccatgtgattaactgacgtgatcgttaattaacggaacttcattcacggagtatttattaattatgtagataagatttgctttggccattttaagcttatgctgattgatgtgtgtttgttgcagtataccacttccgaaatgggtgttggaggagatggacaaggaccaggacctggcctacacggatcggagcggccgccgcaactacgaatacctctcgctcggcgccgacgccatgccggtgctcaagggccgcacgccggtgcagtgctacggcgacttcatgcgcgccttccgcgaccactttgccgccttcatgggcaacaccatagtcgtacgtccacgccccccactccgacgaccgattctttcttgattgattacctcgctgttaattaatgccacttctctgacttgatctgcaggagattcaagtcggcatgggtccggccggtgagctccgctacccgtcgtacccggagagcaatggcacctggagattccccggcatcggcgagttccagtgctatgacagggtatgcctggctgcatgctcgtctcccatggcggctagctttcgatcggtttctctttaatttcttgatttggcggcgaactgagtgagagatgatgtttcggcgatcgatgtgcagtacatgctgagcagtctcaaggcggcggcggaggcggtgggcaagccggagtggggcaacgccgggccgggagactccggcgggtacaacgactggccggaggactcgcccttcttccgccgtgaaggtgggtggaacactccctacggtgagttttgggtaccgagctcg

SEQ ID NO: 58572 - DNA, 7586 bp, Oryza sativa
tacccatacatacaactgatgtatacgactttcgtataactagtgcttaactgctgcttgctctggcccacatggagagaaactggcttggcttgtatgaagtgaattgattggcaaatgaggcagggtctgttgtatgctggagtcggacgatgtatagcggtactcacaaataaactagttaatagtacagttcaagctatatatgttggatttactacccgatcaaagttcagaggctttttatacaggcattctccgaagcacatgaaagaatacatacatacccatttgcatctcttcttgaatcctgatcaacttaattaattatacacaatatagcttagctacatgtagttaagctagatcgaaatatactccatctgtcttaaaatatagcaacttaaaattaaatgacatatacgttctagctagtttcacaaatctgaacagatatgatatatttcatacatccgattttaaaattgctatattttaaaacgaagggagaaatctacgcccggtggccgatccctgggctgggtaccgacccctgcggcatccagccgctgctgtccgggcggatgatctcggtcgccggcggcgacggtggcaatggcggcgctacaccttgcagcaaatcatgaggtgaagtagcttccttagaagaagcactagtctccttgccattcacagcatgatcacctggcatcatcatcatcctagctcgtgcaaggcaagaagatgacgatgccaacaagaggagagcagtgaagaagatcaccattgccgccatgtgtggagctggagccatattgcaaattgcaatgcaaatgtgggattaattatatatagggcggtgtgcagtttgtgagtttgtatgcgatcggcttatcttgtgagaatatgtgatcaacaactagctgatagaggcgtatttataggagaggagtgggagatttttcagaatgtggtgacaagaaatagtgagcaagtggatcaagtgtgtggtttttgtggtggtgcattggtggttaatgggttgacgtctgaattggtagggtatgtttgtattaattcgatgtttttttcgatggtatttatagtaaaatcaatctaagcagtttaacttttctattctaatggatcatatctatttatactactgccataaatactgataatagaattatttttcctactgataactagtataacttataaatcaacggttaaaatcaaacctactagctagtaataaagagatgaccataaagagtattcatacgatcgagtatggtcttgttttcaagcttttgttagcttcttaattgcttaatttcattatagaaaaaaaatatcgatcatttttttcatgaattgatgaacacacatgcatgagcgaaattgagttagtcaaagtcaatattgtgtaataacttttctttaaactaaagtttcaaaagaacatgattttcattccatgatttaaatgtaatagattttattaagtatgagtttattaacaaatagctagctagggtggaaaaattcatggttatattctttctctttagttttcaatttattgcaaaaaaaaaagctaaaattgatatatgaaagcttgattcttcaattaattacgtgtctttcaggtgcctcacgtttctttcagttccgtcacatccactacttttgatgcatttttttttgttccactaaaccgaaagcaatcgaataccagtttgacagatagacgaaggaatagaatttggcgtgcgtgcactcctataggtagctcagtagctggtacttttttggtccttttaaacatggtattgtaaataattaaaaccattgcatactcggattagtgcattatgtgtaaagctgtttatcctgatgcaaagaaaagcatgttgacacactccatacttttaacagattgttgattatagataagttatcctgcttggtactgatgattcttgtggtttcgtcaactcaaaaggatgagtattttggtaaatgccaccacaaaagaagcatatggctcagaaatcccatcgtaaaggtaagatcttttgcagcaagtcgtgaatatgaaaaaaaaaaaaggttgccaaatacactgtaggagaaacaatctctttagtaccggttatagcaatcgagaccaatatgcatactaagtcaaacaaagaatatgtggaatgtgggattcgaactcaaaatctctcacctcaatactcacgcgcgctactattacacctactacacatatctacttggatcaaaatgctttctttttaaactaatcctatagatatctttagtatctgatactaaaaatatttttaatacaaattagtgttatcaacttatactaaaatgcatcttcagtaccggttggtaacattaacgggactaaaaatcctccagcatcagtctcacttggtgttaccaactgctactaaagatgtatttttagtattagttgctaacaccaaatgagacaaaaaatttctagggacttagacttttagaaccggtatatttgtgtttttttaatcgagccggcatatttgtgtttttgggcttagtataaaaaatcgtttctgtagtagcgatggtatgttgatatgcatatattctggtgggagaaaaactcaaaaacacagttgtgtcctcgttcctccacccaattaggtatcaactaacaccaaaatatgtgtttcggctctttagaaattaaatccatatattttggaatggtgggaatatatagctaaggcttttttttaaaaaaaaaaccttgtatcgcattgctggaaggaattgacttaaattgttgcatcgatcgaattgatgggtaatatgtactcctttgatttgatttttaacagtaaataagatggagtttcctcagtgcttaatgtaggattgaatcacaataactaagccaaccagagaggggtgaatgattggtatacccaaaaccgaaaacttttagtggaaataaaagttaccctcaaattcgacggatcgcggtctgaccgaaggtattgcaccggtctaaccacctggaacacgtcggtctgaccgagcttaaactccggtcaaaccgccaagatcgcctgccgctccctgtcgccgtcgctggtctgaccgccgtgtgcccgccagtctgaccgccgcgatgccgccggtctgaccgccgatgcgtcgccggctagaccgtcgaaacccagtgaaacacaaatcaaagaactcttaaagtagatgacgactttattgattatctctgtgtttacaaagtgcactaacagcactccttataaaaatctcgactaaactcgaaaccctaactcaactatcaactcaattgctatcaaaagcgataccgggaagcctcacgctccccctctatttatacccgagataggcagcctaaagccacgaaccaaactcatactagaagtcctaaataccttaggaaaccctctagtacaagaaacaaactttacacaaccaatcataccaaatttggactccttacaaattcgactccgcatcccatacgtacacaatacctccatcgtatgccatatggaatcttcaccaactacgtgtattgaactctagccttagtatcccgcatgatctctgaccaccacggatgtcgtcttatccccaagccgactcccggtccatcaccgcaaatactctcctgaggcatcgagtcacctacacatgaaataaacaaagaaaccatattccgagaccaagctatctccaacttaactcattcttagcaaacaacagtattacatacgcatagtatccatcttgaagccataatcatgaaacaatcacggatatccaaacaaacaacccaaaaccgaaaccgatacagagtcggccggtcagaccgcgggctgcgccggtctgaccacacgatacacgccggtctgaccggcagcacatgcccggtctgaccggatccaatccagcagtacctgtagattcacctgtgaaatccaatcatctccaaaaccactttgtgaataaaatctaaatatcaaaaccaataatctccgatgccaattgttcatcacaaaataataatcaaaaacacttttgattttacttaacagtaaatgagatagagtggttttgtgccaacatctaaatacacagcaaagcttaggcatgtacaacagttgatcgagatgtttgcagagtaaatagtactactaaacacaataacgaaacaagtggtcagccgcttatatcgcccccccccccccccccaaaaaaaaaagtcggtacaacctacacttatatatttctttgaaaatttcagataaaaaatatttatggtggaaaaatgtatgcttgagccatgtctcactgaagaaacgactacttccacctcaattagtcaattactttttcaccatcgcctccaacatctcagcgaactaaggctgtgttctttttagctactccctccaggttgataattcttgtcattttgaataaggacatggtctttaaaaaaacaactttgaccattattttttaatatgtatataaatgttaacaaatatatgattttattaaaatattttttaagactaatctataccacaatatttcaaagataaatattttagaaattattcataaccaaagatttaaatgtttgacctcacccttatccaaaacaataagtattatcagcctgaagagagtattgcaacttagctactcctcgatttcctagcacgcttttcaaacttttagcattgcattttacataaaactttttatatataagttgtttaaaaaaatctaataaatttattcatcaaaattttatatattaagtattattcatatgctaatcacatttcttgttttacatgtggctaattagccgttttaagcatccgaaaagaacgcagcataagatgtcaatgtagtcgactttgtatgtatacccgtaattacataagtacgtaataataatactttaatagtctgctgcagattttaaccatattcttaacaataacactccctctgacaagaaaatacaattacagtactcaatagataaattaacagggaaaggaaataacctagctaaatgccccttagtaaaggaattaatggtggtgcgggagaggatggttcatgccaggagagatgctaggaggaaaagtagtactttgcaatttgcattctttttaagttaaaacttttcactacgtgtctgaatatacccttatccaatatataaagccggtagttaattagtatattttgggacaaaggtagctaccttcatcctaaaatatactaacaatctagtattggataatatatcccagcattatgaatttgaataagcatatctagattcgtacttcactctaatttaggttgttgtgttttgagatgaagtagtagttttagctcttgctcagggaaagagctctttgactagactaaggcaaaattgaatatagttgtaagttgtgcaaatggaaatgcatcctccgactttagggcaacaaaggaagagtgggacagtaatttgtattgagtttgacgctacagtaattcacagcagcagcattataaaagtatcattattatcacagtacatcatggtactgtagcaaatcgatcgatctcctccattcaaatgcaaatcggacggctgtaagcgtcccaaattcacaattactatgtatatatatgctcctggattgttgacatcttagcccttttagaaagcatattttgtaaatagatcctcaaaaaagttactgcgtatagggactcatcattggtgtcgagattgaacatcttggcacaaattaatctggcacatgcatgccgaaaagtctatttgacaccaaccctcggtcggtcacctatgaaacaacttctttcccctcccacccctccctgaatcctatagatttcctataaaattttggaaaacccgagaaatggaaatgtactatacataactcattttcgctaatttatttttatttatgaaaaaaattgagtccagaggatgtgggtccctccctcctccaccaccccctaaaccctattaatccactgtcaattttttgggaaaaagttttgacaaatcaatgtattaccattcattttccctaatttgtttttatttaattagtaataagacttgatggaatctaggatgatgagtgggaagtcgggtgactgggtgagggatcgcactaacaagatttgtacttgagatgtcgtgtaatttacctcgaggccaaggactctggcactcagtttcggttcattttcataataagtttttttaagggcctatatgtgaaatatgttttttgaaaagggctacatagaaaaaaatatatccagatatatgctcctctgactttaccatgaaaagtcagatgatcaaatcctttgcaaaatgcaaatgcttgtacataatgcactttgagttaggtcaccatactcgatcatatgcatgcatgcatgtaccctgtatttcgttttacaatagaagaccagcattgacttctgttgcaacttgcaagttataaaacgtgtacttagtggatactatcatatgtaccttgaaaaccttatgcttcagaacatatagctttttttttttgcgaggaatgcatggttcagaacatataggtagaattgtaagttgtcttgcatttttattttcctacaaaattagatcgaagtggcattttttcggggcaatcagaagcaagttaattggatgccctgtcatttctagaacactaacaaacaaatctgacaagactacttcccaatgaagaggtagcatgatgcaaattcagcatattttccagggaaatgttccaactcatcacaagtcaaatctgcaaaagggaactattggggatagctctagctttctgtgatacaatcatccaattaatattctcccttttgactcctggctaggtagtgtgctctccactttggtagacctcgcctgttcatctgacacgcatattatttgtgcacaattgatcttacattttaactacctttttctccacctgtgatttgctagttaatggcctagcttattgtcataaagtgcaatatatatactacatatgttcttttataatatcacaagttcacagcatgtatatatactaatataaaagatagtagtggttgtggtgaatcaccaccacccaagtatcatgcatgcaggacccacgaactatgagttacttgtctcttaacccccacatgccatagatcccgtcgaaagaaaaacataatataatattaatgataatatattagataattagagaaaaaaaccgttgcaacgcacaggcattatgctagtagatgaaaagagagcatgcatgcatgaatctgccgtccaagccccatccgttgtctttacaaaaaatattgtggtcaatgcgttttgacatgaaattacgtggaaagcagatgtgcaaatggccgatcgatctcaattggttgctgtggaa

SEQ ID NO: 58573 - DNA, 6150 bp, Oryza sativa
tcatctattaaaaaatggaggtagtattaatcaagataccaaatcacatacttatgcatatatatgcaaaggatgacagaagcaaagtgtcctagggttagggcaagttgccttttgaacaaagttttgcttacgtacggctgcaagatagcattaattttgcactcatcgatccatgacgagttgttaactacactaaatgaaaatgactttggtacacagctagtacgtttgtagtctaagtacgtactgatggcagtggtaccaaaaatgggaacccctggttttgatggtgctctgcggaaatccattagctgatcctcgcaccaatctctctctgcaatgaaattcttttgttggttgatcccctgcacacctcactttgcacaactattctccattctgctaccacatgaccagatcgaacaattcatcacgaaacaggcatgtatttagttgtgccgtgatgaggaaaaaatgacacaattaggcagagttggattcaacactttcccaacttctactccctcatttttcacgcgcacacttcccgaattgttaaaagttgctttacaaaaatcatattaatttttttaactaatacttaattattcctgtatgctaataaatcgctctattttacatattaggctgtgttagttcggtttgagtggttggaaacaaatctcctacgcacggaaaacggagcggtctattagcgcgtgattaaataagtattagcaaattttttttcaagaatgaatcattataattttttaagcaactttcgtatagaagagttgggaagaggtaacaacgaacacaaccttagttcccaaccacaccttaatcgtacacagccttaaaatggaacaggacgagagagacgaagaaacaataataatatcccagagtaaattagggaagcaacatcgggataaaagggataagaattcacaagaaacacgcaagttgaggaaatggatatgtatgttgtcctttcctctgtacggatcactctcccttctccacccaaaccaaattaaagttatgtcaactttgacggcatacatgtaggcaacagcacatgcgagcatcacccatctgtactatacaaaagaaggcaattcaattcaattaataagcaccatgatgataggtatatacatcttctatcactaggcaaatgatcaactccatattattccgtcgtcactcaccgtcattgtctctattattacctatcaaccgatctagattgttaaaattacatcattttgggaaggaaaacaaaagcattgtacgtagtataactaaacataactatagggcacttatgtaggtccttttgtagcacgtgtaggacgacactaattaagcatgcatatatatatggtcaaacaataccaccgtgcaaagttacagaaaaaagaacatgaaaagaagtttaacctatctctatctctctaaatatatgtactctctccgtttgatattataaatcattgtgaattttcatttaaacttcttggatatttgaccaagtttttataaaatatagtactacctctgttacagattataagtcattttaactttggtcaaagtcaaactacttaaaatgtgaccaagtttgtagataaatatagtaaaatttataacaccaaattagtttcattgatatatttttatagtatatttatattatgttgaatatgttactattttttttaacaaatatatggtccaacttagaaccgtttgtctttgaccaaagtcaaaacgacgtataatctaaactgatggagtgcactaaattagtttcattacatctaacattgaacatatttagtagtttctttattttgtattaaaaatattgttttaattttctataaatttggtcaaacataaagaaatttgacttagaaaaaaaagtcaaaacaatttataatatgaaatagatgtagtactgtgactcataagaaattcccacgagaaaaaaatgaataaattaaatatagcaaggattgttgaattgtaacggttcattaaaagatcgaaaagttctggtatatatataacttggtaactgtcaaactttattcttcgaaaaaatgaataaattttctggccaccaattatggtaagaacaaagattaatgaaccacataaaaattgagtgaatagtatcatatactcggcaattattaatttatacagtttataaattaataaaatacaaaaatgagactcaatttagccttatgtattagttcaaaatttcagaattacttactagatgaaacacatcacattgttgcaggaaagttgtatggcaacaaataaaatggggggcgtagtggatttgctttgtagcttagggcctgtttagattccctggcaaaattttccaccctgtcacatcgaatgtttgggcacatgcatagagtattaaatataaacgaatttttaagcctaattgctacatgatttgacaatgtggtggtacagtgaacatttgctaatgatggattaattaggcttaataaattcatctcgcagtttacaagcggaatctgtaattgattttgttattagtctacgtttaatacttcaaatatgtgtctgtatatctgatgtgacacgctaaaacttttcacccctgatctaaacacagccttacaatatccatacaaatattaagataatataggtttgtaggagaagagaaaccacacatagatcaatcacccaaagtctaaaaaaacaattaggtgtgatatggtaaaaagggataaatccattttactctcctcaattcttcactttgcctaaattttaaaacacaaccccaaatttcaaaaccggcggcagctgcgtggggaaggggaagtgcttgtgtgaatccgggcaggcggcggaattgttagcttggaaactaaactaatggccgtaaattaggtctgtgcaggagattatctttcctttgggccactaggcccatgggccaagaatgtacgcactacatctgcctacgcctccatcaggtatacgggctgcggcccatgaacaagaactgtaagtaaacctggtaacactttaacagtagctattatctttttttttccctgaagcttctcattcatttatgtccatttaatcgctaatcgaggcatggggcatttgggtcacagcaaaaaaaaaaaaaagcaaaacggtggaaaaatttggaaataaaaaagaaaatggtcgaaatgacatttgtagcaagatgttttgtttaaaagtggcattctaaccaagccacattccagagatgccaaaatgtcaattttcttgtgtttgagggaagcataaaggaaacgaaaaactcatctttttcgtgttcacatttccccaactattaagcggtgtgtgtttttttaaaaaaaattatttaaaaagatattttagaaaaatcatattaatcatttttgagtttaaaataactaatcatcaattaatcctatgctaacgtcttacgtatcttatctctcgtttcttctctggtcaaacacacatctaatcatacactgtactacctctatcagaaaatactcgtcattttagctagtttagcctatagtattaaggccgtgtttagttttaaacttttttttttcaaactttcaacttttacatcacatcaaaactttttacacacgtaaacttccaactttttcatcacatcattccaattcaaccaaactccaattttagcgtcaactaaaacacaccctaaggttttaaataaaaagactataatccctactaaatatggttgagggtggattgatactttgaggtataaaatagcttgaagtgataagtttttatgataaattttgaattctaaaatgatacttcacctaggcctaggttgttttttcgtgtgccaaaatttaagtatacggaaacacatttgaaatattaaacatagactaataacaaaacaaattatagattccgcctgtagactacgagacgaatctattaagcctaattaatccatcattaacaaatgtttactgtagcactacattgtcaaatcatggcgtaattaggctcaaaagattcgtctcgcgatttacatgcaaactgtgcaattggttttttcatccacatttaatgctccatgcatgtgtccaaacatttgatgtgacgggagaagttggaagtttgaagaaaaaattttgaatccgtgtttagggtgtgtttagttcacgccaaaattgaaagtttgattgaaattagaacgatgtgacgaaaaagttggaaatttgtgtgtgtacgaaagttttgatgtgatggaaaagttggaaattggaagaaaaagtttgaaactaaaccaggccttagttccacactaaaattgtaagtttgaagaaattgtaacgatgtgacggaaaagttaaaagtttaaagaaaaaaaagttgaaatctataacaaggcctaactacatcatggacgagggagtatgtttggctgttgaaccattaattacaaaccaccgctccaaggcgccaaacccattgaagttgtagcaaaatgcaagcccagctggcgccttggcagcatgagcttccaacctacccgaccgttgcgttgccctcccaaaaccaaaccaaatcaaatcacattcacaccattccacttcccccctttctccctcccgaccgttgcaaattcctccctccactaaaacccaaatcccccacttcccccaccaccgcgcctttccgccatggtgtcgaggacgcccacgaagcagccgctgtccccgctgccgagggcggccagcggcagccccaccaagccgacgccctcgccctcgccctcgccggcctccgccaggcgccgccgcgtgctccgccgcgggagccccgggaggatcaagtcgctcgccgcaacgttcgacacctccctccgcggctgccgccgccgcctcctcaagctcttcgcccgcctcgccgtcctcggctcccccaccaagcgccgcgccgccgccgccggcttccgccgcctccgctccccgccgcggtcgccgtctcctccaacgcccaagccgaatcaggtagcggccgtctcgccgcagctcccgctcccgctcccgccggtgtcgccggggaggaggacgctgttcctggacctcgacgagacgctcatccactcccagaccgacccggcggcgcgggcgcggcacgacttcgccgtgcgccccgtcatcgcgggccaggcggtcaccttctacgtcgtcaagcgccccggggtcgacgcgttcctcgccgcggcggcggccgcgttcgagctcgtcgtcttcaccgcgggcctccccgagtacgcctccctcgttcctcgaccggctcgacccgcgcggcgcgcttttcgcccaccgcctctaccggggcgcctgccgcgacgccggagacgggaggctcgtcaaggacctcgccgccacgggcagggacctccgccgcgccgtcatcgtcgacgacaaccccaacgcctactcgctccagcccgacaacgccgtgcccgtggcgccgttcatcgacgacgccgacgaccacgagctggagagggtgatggggatcctgtccatcgccgccgagttcgacgacgtccgcgacgccatcaagcgctacaaggaaatcgtcgaggcgagctgaagaagaagaagaaggtgtggctactagcctactactaaatattagcttcttaaatcagtttcatggcagaaattttccccctttcttgtaagatccttgaattggttagggatttgggattcatatagtggtggctacctgaacctttcaggatcttcctgaaaggcagattgtgggaatggattatgtggttcagaagcttcagcacaaactgaaactggaattgggaaattctagaatgctgagaatgttatgaaattggagaacaaattttgttttctactcatgtgcatctgatttcagtaaattctaagattgtggaaatatattatgaagtagttcaaaagcttcagcacaaactgaaaatggagttggggattctagaatgctgagaatgttctgaaattggagaaattcgagaacaaattttgtttgcta

SEQ ID NO: 58574 - DNA, 1082 bp, Oryza sativa
ctcaaagcttttgcttttgcagaaaatgaatgtaactattacattttctatcataagaaaatacatgtactcaaaaacccgaaatgccagtactacattcgtgcagtgcaactccagttcccttactgtttacaaagctattagcgaaagtaagatgaggctctgactgacatacgttcgtatcatatgggaatcatcaggcagcagcagcagctgccctcttgttgatcggtttgcttctccttactccgcaggatccgatcaatgcagcagcatggcagcaatgtcgtggatccagtgccgcatcatctgaacctgctactcttatcctcagtgttggcattcgttctggagacgacccagcgaacacgctcgaagggcagcaataccgtgatggtaccggtgtgtcgccgcttcggttcggtaccctgatcgtgcaggttttaccgtcatttgatatgctctcgacgacaccatcgatcttcagaactccattatccatggtgccgaattttctgaggtaatccatgcgatctccgtaaggtggctggcctaccgggccattagcagaaggtacagttgtgtccgatccggtaaatgtggttgccgaagacagtggtgtatcttgttacgccgcgactgagccttggttctattaatcgggtgcccaactgaataaaacaaaaattagaagtcaaccaaccaggataagttacggagttagcaagcaatagccaaagcgaaacgaataaaaaggagcacagaatgagtacgtaccgtatggccgtggatggtgtggcgataggcgagtgcattgatgaggtgttcgaggcaagtgaactggataaacgcgaagccgtggtgccggccggtgtggcgatcgatgggcatgtggacgctggccacgtacccgaacagctggaaatggcggcggaggtcctcatcgccggtgtaagggccaatgccaccgacgaacatcttgcacagcgtgggcagagccatcgtcgttaccggtagcgtcgaaacaagatttcgacaataataaaaggggtggaggaaatggataggttcagagacaagga

SEQ ID NO: 58575 - DNA, 5708 bp, Oryza sativa
tggcaatgtaaactatccctttatgtctgaaacttcgcaggtgtatagcatcggttacaggcttctgcgtttcgattaacttgtatagtagacggatttttttttagcaatttcatttcaaaaatttcccctttgttgtaaaattcttgaattggttaggacttggggtattcacatggtggtcaacctttcaggatcttcctgaaaggcagattgtgaaatactcctacattatgcatatcatcagcttcagtgcaaactaactggaactgggtgttccgagattagttaaattgaagatcaaattttgtttagtggacatgagactctgctttgagtaacttcaagtgcgtattgtattgagcagttcccattcatgttctatagagagttttggaaatgaaacccatcccttttatctctgaaacttcccaacattatagtatagtgttgaacaatttacaggctcctctatattggaatactttagatgaaaagacaagaacaagggacgtgaactagatgacgcagctacttgaaattagttttgttgttgtgcgttgcaaacaaaaaaaagaaggcatactagtacttgttttcttgtgttcaaactgcagagacaacgtattgcgtactcctgaatcaccattatggcattatccctgaaactctgaaaggaaccaaaaatcctaatgagctaagcagaaacggtttttcttctgtgagatttaacacaaatgacttagcattatgaaataaacatgtagaatgtcaaacaactttttagctgaattacttctatataaataacaaattcttttggaactgattgctatgaaagagactagctcccattaaaaatttctgaaagtgactagtgcgaacgttgcagcctaaactatatcatactatattactgacattccgtgcactccaaactcttctttattagtgattgtttcaatgaatacaatcagcaaaattacaacctttttttctcatgaaaagatagaaacttgattgagagtactcttttcttagattgatgcctatattagaaattagccaagaacttcaattccaacaccacaccaaaatactacagtaaaattgatgctgtttttttgtatattgatgcctatattagatagttgccaagaactccgatttttaataccacagtaaaattgacagattacgaaggggaaaaaaagcagtgaacgttttcttttcatgaagctaagagcaaagcttgtaccgtgactgtactggtgaggcatacacggaactagtctactttatgggcaatctgccaatgcattggtcagaaaatctttttgtcaaaacgggtcagcctgacagcgagacgcgcctgctgattaacgtgacacaaataatggtttgaagtaaactttattttattgtttatcttcatatggagatctttcttgcttgctatgcatactaaccaagtgttcagacttcagatactgatgtgtattaactattaaggcaaatcttgactggtaactgacatttgggcaccaccaaccattttatttttctgggagtcccacttgtcagtgacacatatccgcggtttgatgctgaatttctgaggaacctggaggacagattgcaaatttgcaagtagagtagtctttgaacaccttatatccgtgcacaaaacggtggtcaatccaggaaaccgagcaaagagttggacacatgcatgttcacaccgagctggaggccataaatagtagagaccaagctgcatcttcttgttatcttcagttattcagaagttcagagcagtagaggaagaacaggataagatcatagctagagatttcagagagagaatctagagagagagagaagagatggctggaggagagcatggagttaatggccagcatgaagaaaccagagctatggaggaaggcagcagagatcatcaagcaaggtgtgagaattcagagcaagatggaggaagcaagagctctagtaataaccaccccatgttctctgtccaattcgcgcagaaggtatgtgcacatctcagaccaagatggtttcattttgatcaaattcatcttgagtttccctctcatagatatatgtagtatttccctttgatcctggaatgtatagccaagctcaaacaagttctccaatccctatgaccctacaataattctgcagagaacaataaagaattcagtagcataacaacactataacagacaaaggaaagatcaagatcagaatttcccatgtggcttgtttttagaggcgcatgtggtagtagcatccaaaattttcagtaataatatactgttgcggctacggcaaaatcccaaaaaagaattatctgttcttgtttgcgagtcattgtcgccttcatggagccaagtcttcaacatgattgcgtcttggtcatcggcagcaatagtagctttcacagaaattaggattgggttggctactatgacaagcaattgttgtcaatcttgggatcaaacgatgaacacgacattgctgctaatgatagatgatgatgatgaattgctgtttgtaaaatcaaagtgtgtttgattcttattctgcgatgaacaattgtcatctgagattattgtggttttgataaacacaaatgggggggcaggtgatcgcggagatcttggggacgttcttcctcatcttcgcggggtgcgcggcggtggcggtgaacaagaggacgggaggcacggtgacgttcccggggatctgcatcacgtgggggctcgccgtgatggtgatggtgtactccgtcggccacatctccggcgcgcacctcaacccggcggtcaccctcgcgttcgccacctgcggcaggttcccgtggcggcgggtgccggcgtacgcggcggcgcaggtggccggctcggcggcggcgagcgcggcgctgcgggcgctgttcggcggcgcgccggagcacttcttcgggacggcgccggccgggtccgacgtgcagtcgctggcgatggagttcatcatcaccttctacctcatgttcgtcgtctccggcgtcgccaccgacaaccgagctgtgagtttgatccttctccaaaccattcttgttcttgtacgttttccaaactgtgttcaatgttacctcttccgaactgttccctcgtactagtagttttctgcgtgtaagtttttttttaatcgctaaatgatgcgtttgttgcacaaatatttatatttgaaagttgttttcaaagatcgtattaatcctttttcaaaatttaagataatatttatttaatcattcattaattcaccgctccgttttacgtacaaggagataaaaggttcccaaccgctactatcgaacacacattgagttgtgtcggtaagtagtgatgacggagtggattgaacgaataatgctcataccatattaatttttatatatttttttaatttagatatgaaaacaaatacaaagtatctcgaatacatgtatgaacaattatgggtgttattaaacgctataaatagaagtcatcatagtgatgtgatctgctgactagcctaggcggctgcctgtggtcgacgggccttggatcgaccattacctatgcccttgtgccctgtgtgttggggagatgggggtatcagatcatagcaatggcgagattttgatgaggcagaacggaaagatgaggacagtgaatttataatggtttataatcttgttgccatacgattatagctcataggaattgataaatcatttctaataataaaatgagaggttagtactatctccatctaaaaaaagtttatttttaacatatcccacgtacatcaatacaaagttaaaaaaagactaaaatgtccttcactttttcaaactccattacacttacaatacatcattgtttcaaatatgaagtcttcgttgaacggagggagtattcaattagtaatggtacattggtacatagaaaatggtcatttaaagttgtaaacaaaaataataaagtgtaaaaaattgtcttaatgccttgcagttattatatgttgaaaatagcactcgtttatagagaaccatgacttgctcggttggcaatggtttggtgactttcactatgtagacgcatgtttcatatttcagacttgattatatttccctcagattaaatgaaaggttaaaaaatatgtcgcacctctcccatcttaatttcatcagatagccggtaattcttcctagccatctcagcaaaaagaaaaaaaaacatgagagagtagtaattttcaatcagcaaaggtgtaattggagaaagtagtaatatttcatcagctgtgtgtgtgtaaaacgagaaaaatatgaaagaagtgtctcaaaaatcatatagcgactttatgtttacaaaaaatgcagaaaaagggagaaaaagggaggagtataagacgagaaaaatgcgagtatggtgcgcgtacaagtacaaaatcactgtaccatatatgtttacaaaatggtattcatactttattaagacgatcgccatcgttatcctgatgcgccctgatcctatttttctaccaaaatagttgctagtcgctctcaagatttgaagctagtgacttgttgggagttgcaactacaagccactcttctgacattaatttcaacattagtcatacaagcagttgacccaatatataatgcatggaatgagttttctttttcatttctttcaaagtaattttatagactgaatactcatggctcctcctatttgcagattggtgaactagctggccttgccgttggagctaccgtcttagtaaatgtgctctttgctgggtacacgtcttgaaccattgatattactccttccgttcctaattagatgtcattctaacctaattagatgtcattctaacttttcgcttgcaacgtttgaccattcatcttatttaaaaaattagtgcaaatataaaaatgataagtcatacttaaagtacttttgataataaagcaagtcacaaacaaaataaataataattccataatctctttaataagatgaatgatcaaacgttacaaacaaaaactcaaaacgacaagtattttgggacggatattgtacctctttttttttgagaaattcggttttactaatttgtgtttgttaaaaatgcatgttacaattattattttcataatacgtctgctaataacttttaaatataataaaactgaaatgtgaatgaagttgaataggctagccctatccactgtagaaagaagtttgttgatcctcactgtagaaagaagttgatgtctatatttatgcagattcaagtaccaatgtgaaaacattacttgtatgactgagttttcaacttacaaagacacatatctataatatagataaaggggtcctggaacaccaataggcataaataccttatggactaactagaagcatgttttccaaaagaacaattgtagcacatttaataggacatgtacagccgactaacaaagtcgccatctctaatataatcctcattatatatgaacagtatatattaaagatagcagcaatagtatctataaacagtattaacgagaatgtgtacacaagtttcgggtgtgctctcgccgtatacactaacactaacaaggtgttatataaaattct

SEQ ID NO: 58576 - DNA, 713 bp, Oryza sativa
gggacacattcacatcaaaagaatggagccctttcagggttcgcttgcttgcaaggccttttacgcagctttgtattggcaattggacgtttctgattggcatctgatgcttggttccgtgaacgagaaactcgagttgaagcttcagaccctgagaagtcatttggtgatatacctgcctttttctatcagaattggagaagagagatattagaaaaaaaaagttaacaatagctagtagtctagctacgtagggtgaaatctagtaaagcacaacaaacaaccttatccatcaatatatagcacatagcttgcccactaaacaaaatcaattgagtcaacatgatcatgataaataacagtacttgtgcatatatgatgaaaataaccttgcagctaagtgaacaggtgaggctgggtgcattgtggagccagcactggcaagtcgtgcagcgaggtgtcccagccttaggtctgtgatgtttggacctcttcatgggccttaggtgcactactttgtgcccattgcatttgaatgtctgcaaatagaaacataaagggactggtgtaaatacaagtgatgaatgatttttagtgactcggaatataataaaaggtggtagcctgaatagtgctttagaaatcatttgaagcccatatatagctaggaagaaatgtcgaattcttaaacagtattcaatcccatacagtgc

SEQ ID NO: 58577 - DNA, 667 bp, Oryza sativa
ctgaagggaatcctattggtttcaccaatgatgaactcggtaggatcagggttgccgactggaccgagaaagtagtaattttcgtgcgacaagcttggaattgcaactaggttggaaagatgctacaaatccaaaagaactgagaaggggaaaacaggatgaggggctagaagatcgatctaatgtgaagaaaagagatctggccgatgagaacttacctcagcgtactcagccaacggcgtggcagacgggctggcggaagacgacatcgctgcaggcggagatctaattggagatgaagtcgcctagggatcgccttatgcgtcggagaaatcgtcgaagagagagaagacaaagttagcttcggcggtgaaaacgcaagaagacggtatgaggtttctcgggggcaacgattagtatttaaagcgctggagttacggttaggaaacggcaagagcgaattttgctcgaaatcgatatatggcaaatccgaaacattaccaaatattccggacttggggggcatgtgttaacaaccaaatttggcaatatcagcatcggggatgaagattagatcggggtggaatcgaagacgaagatcgattcgggaacagagtaagagtccgagtcagactgggtcaggtggtacagccgattccgacaatac

SEQ ID NO: 58578 - DNA, 680 bp, Oryza sativa
cttgttcaacgtgtatgaaaaataaacaaaccaacagttactgcaaattactactcctactagcaaattagtagcagagaaattaagggtctagtacacatactagcttgtacatgaggttcagtttttcatcgatcgatctgaactttgcacatataagtatcttgattccaacaatcgaatcccacgtctcttttcgtatcacgtcaattagtcgatcgatcggatccatttcaattttattagttgctgtcaaggcataatgcgatcgatagcgagtcggtgtgggcagggagcatgccagttgtgtgaaatgctatcgaccattagggggtgtttagatggggctaaaactttttagcccatgtcacatctgatgtttgaacgctaatttagagtattaaacatagactaataaaaaaactaatttcataaataagagctaatctgcgagacgaattttttaagcctaattaatccataattatgaaaagtttattgtagcctcatattattaaatcatagcgtaattagactcaaaagattcgtctcgcgaattagtctaagattatggaatagattttaaaattagtgtatgtttaatactctaaattaatatccaaactatcatattctctgtttctcagacatgcccttagtcaggtagaaacatgaacgtg

SEQ ID NO: 58579 - DNA, 19986 bp, Oryza sativa
aaatcacgaatcttttctatcttcttaggatcaatctcaactcctctctcatgcaccatgaatcctaaatattttcccgtcgacacaccaaaaacacacttgagtgggttcatctttaaaccataccggcgcattctctcaaaagctaaccttaaaacggccatatgtccctccatgccatccgatttgacaataatatcatcaatatagatttctaagataatacctagtaaatcatggaagatcaaattcattgccatttgatatgttgcaccggcattcttcaatccaaaagtcataaccacccactcaaataagccaataaatcccggacatctaaaaggcgtcttgtacatatcctcctccgctataaagatttgattgtagccggcattaccatccaaaaagctattcaccttattactcgaggcatcattaatcatcatgtcggctataggcataggatattcatcttttggagtagctttatttaaatctctaaagtctatggaaacccttcttctccaccgggactatactagatacccactccgcataacgacatggcctaataaaccccgctttcaacaaccgatcaatctcctcgacccggtcatatagcaaagaattgaaatgtcgaggtggttgtttataaggcctaaaacccggtttaattggaagccgatgttcgacaagatcacggctaagacccagcatctcatgatacttccatgcgaagcaatccacatactccttaagtagctcgattattttaaccttataatcagctttcatgtttttgttacaaaagtcggccttggcttagttccatcacctatgtctacttcctccaaaggatcggccgatgtaaacccttgaccaagcttctctacttcatcaaaatcttcaatggtttcaccaatatcgttctttgtagaccgaaattcttgcaccctcttttgcaaccactctaaattagcttctttactcattacataaagtaatatggcctaaccgtgctacactagccagctttacagagataggtatcaatttgccatcggaaatactaataaaatcatagctataaagatccatccccaataagcattgaatattcccactcaaatgttgctttggccattgcaacctcagccgatgtatccgcttgaacaatttcaatatcatcgccgtcccgttgaattaaacattgatgcaaggtagaaggcacacaaaaattggcatggatccaacaatgacccaaaataacattgtagttaccttgcacatcgacgatgtagaaagcggttggtaatgtcttgtttcccacggtaagctccaccgaaaaaatacctttcgcctccgttggttcaccattaaagccattgagaatcatgttagtcttcttcaactcgtcatctccacgccccaacttcttgaacaacgagtacggcatcaaattcacggcggcacctccatctaatagcatcctagagaccagcttcccatcaacatgacctttgagataaagaggcttcatatgacgatttgattcatcgggctttctcaaaaaccgcatctttaggacctagtgaaaattgagcaactttggcttcatccatagcacaagactccataggcaacatgcacaccatgttgacatccatgtcttcctttggagatgattcgtccttagtaaccgattgttcttccttctctttttgcacaacaaccgattcttctccctctatggatttacgcctccacacctttgtaggcggtggtcgcaactcgttgaaccttctatccctccgctctttggcttctctctgttttaattcttgggcccgaagacgttgcaacctcctcttttggatagtcgtcaaatacttaggcatccaccttggtttcggctccgttccaggaggtaaataatgtcccctgttgattctacccgaagacaatgaagcccccgagctaccctttgtaaacctctcatcaaaccagcgctggagcccggtcagaccggctagaaggcccggtcagacaggcttgagaccggccgtagggctgcggtccgaccggccagagggcctagtcagactggccgactgcgacaagctggtcctggcttcggatttgttactcgaagactccccaacttcatctccagatggtactggcacatcatgagatcccactttaatagttatcacctccaaagtcctcgtctccaccttaacgcgctttccttccctctttccttcattgacccgatttttaacataaaactggccattgtttggtgaagacaaatgctcacaagctggcctccttggtcctccccatcctaggttgtattgcattggaggcatatgattgaacattggcggtgttgtcccccatggcatgtagaaaggaaaaggataacccggtggcggcattggataagaaccccatgatatgtaggtgattccgaccgtcttggtgaatgaccaaatcgctttctaggaggtgatcttggtctttttcctttattgcgagctttctcaccaccttgcttctcatacttactcaaaaacatatcgatggttactttagtcttcttaggagctttagaacttgaagcttcactcctattctctttccaaacaccaacctctggattctttggcaccatcatctttggcctaggctctcaaatgatcactcctttccctttagtagattcggcttgctccggccgaatctacaccttcttatcaatgaaattaattgtgttcaccagaaaaagatcactatcaagcttcatcttggaaccatcggtgaatttcaatcgtccttcatctatggccgattgaacttgtcgtcgaaacacattgcaatcattagtagaatgagaatgagaatcatgccatttacaataagctcaacgtttcaattcctcttgagatggtatgacatggcctttaggtaatctaatttgtttttcttgcaaaagataataaaaaatcttatcacatttggccacgtcaaaactatacttaatctcactttgccgatctttacgaggagtcggcattagattagaacaaacaaaaggcttatttttgttagtccatgaccactcagcaccatacatcccatgatcaccctcatcatcagaatcactagcctcagggtaatcaatcaaattaaaattatgctttttctcatagggtctaacaaatttcttactatccttaacccggttttcctgatccagagccttttgcatgagttgattaacatcaagaaattgttggccttctaatctttctttaataggaacaattaaaccattaaaagcaagatcagccaaatctctatcagttatattcaagctataacatcggtttctaacatccctaaatctcttaatataatcaatgacagattcattgtatttttgcctaaccatgtcaaatcagttagcctaagttcagtttcaccagtatagaaataatcatgaaatatttgttctaattgaggccaagtatgaatataatttgccggtaaagaagtaaaccatgtaaaagcagtaccggacaaagataaagaaaacaagcgcagtttaaaaatatcagaactactagcctcaccacattgcgctaagaattgacctacatactcccatgtggtcctactatcctcaccactaaatttggtaaatttgggaactctataaccacgagggtatgggatgttgtcataataatcaggatacggcttttggtaaaccttagcacgattcctagattcaacccgaatttatccctaataataccactaatcgattcctccatattctcaggcctatgttgatttggtggtgggtttggtggcctaattggttatggttgcggcgcaattaattatattggccatatctagtatcgggaggatatcctctagtaggatcattgtaaacattagggatatgtggggcagcagtagatacatggggatcgtgggctcggacaaggtataaaagcccgttatttgccattggatctaccccctgtattgtgataattgcgctggtctgaccggtccagggcccgatctgaccggcatccagaggcacggtcagaccggtttggggtccggtctgaccgccgggggaaaacccggcctgaccagccatctggccggtctgaccggcggtgaatgcgcggtctggctggccatttggcccggtcagaccgactgattgcgcagccactccctcgccggttgtttgcatattcactccaccggttttgctatatatttgatatacaggaggcttgctagtagtggtagaggctttatctttggatgaaaaatcggctaagaaagaaccgaatttgttcctcaaaaaatcatcaaaacgagatttaatagatgcatctaatttactatttagagtagcaatggatgaatctattgtacttgctatttgttgttggataggaagtgatacctcttcagtacttaccacatcgaaattaggtttaggcaactgtccaggcttgagcaccacaccttgacgagtcctggtgcatgttctcatcaatgcctcctgtgtgatcgtcttaatgtactccttcatggccttgcgcgcttccccatcaagatcctccaatgagattggcaacatattagatggttccacctccgccttggttgatggcggctttgtcatggcggcgtcaacgttgagatgtcgttgagcatatttccccagcggagtcgccaaaaatcgtgttggcaactttttgtgacaaattgacaaccacgatcgcagcacctaaagctttgcggatagtagagtcaccaaccaccccaatctagcaagcactagatcaagatgggtttttataagctaaaccgacgagcggagctgatctagatgaaaccgtagataactatcctctcgtgggcaaaacggaaggttttcaggacaaaccttgaaaagggtatcgcactctcgtagcggcggcggacaatttacggcgcaaatcggcaaagatagacaaactaaactagaactagaatcaaaagtaaaatgacgattcgattgattgattgtagattgattagttacaattgaaccggcgatgtcccttatataggggttggtcttgccctctacaggccctcctccatgtccaacttgggatagaatccaaaagaaacccgaaacatgccttcccgagcaaggaaacctcgagacccgatgaaatagacccggactcggactccgccggtaagaccggccacacaccgccggtctggccgaccaattgtcggcggtcagaccagccaaccaacggcggtcagaccggcccaagcagaggaaaactggcagacttccaaactttggcaattttctctattttatttctaggtgctaaatttgggtgtaaacaggattcctatagtactgtttggggagtcgataagttaattcatatggatgtctacttgctgggctggtgtgttgttcggcctgtggctgagtttagttaccttcaaacttctaacttttctgtcacatcaaatgtttggcatatgcatggagtattaaatgtggacggaaaaaaaccaattgctcagtttgcatgtaaattgcgagacaaatcttttgagcctaattacgccatgatttgacaatatggtgctacagtaaacatttgctaatgatggattaattaggcttaatagatttatctcgcagtttacatgcggaatctgtaatttgttttgttattagtctacgtttaatatatcaaatgtgtgtccgtatacgtcaatttttttttgccaaaacaactaaacacggcctgtattgtcatgatgaggacacaactagctcggatataaccatgactaccttatgtattaatcaaccaaaggtgtatatattttaaattagatttacttgttatatatttgaacaaacgttgctacacaatgagttatgtgtgttatcatttgcagagttacttgcttgggtgaaagaaaagagaccgagcataaggaatgcatggatgattgaagaagtttattggggaccaaaccaagaccttctccaagtcttctttcatctcaccacgtcacttttggtccatagaagacaagagataaaattctatacgttttggattcggattcgggcctcctgacagcatcaacttcaaatggacctagctgctgatttagaaggaattttggggcccatagtacttgatggaaagcttatggagtctactttcagatggttttggtcccacgtcaaaattcctaccgagctgccaggaatctgcaaaacaagccacgtatctcattcagtccgaatctgatttaagttttgggccttgtaattgtgtcgtgggcttagcccaagggggtgtgcgccctagggcaaccctaggacatccctaatcatactaaatcaggtggtgccacggttccacttctacctatttggtaaaatcaggtggcgcggggcatgtttgacacgcatccaaggcgtcatcagcgctaatgactcagtgctggtgtcttgtccacgtcctttcaaccctagactggctagcgctccccataaacctatttcatttatggccatctccttagccggttttgaggtcgcgcgctcacgctttttgccccataaacctatttcatttatggccatctccctagccggttctgaggtcgcgccctcacgctttttgtgatgatagttcatctgttcttaggcgagcttctcgaagatgtctttgatgaattgataatgtatttaatttgtatgttttgacttgcagaagaaagtggaaactacaaggactaaggtgtgcccagatcttaggacggggcagtgtgacttataaggactaaggtaaggtgtgcccggatcttaggactgggcggtgtgcccagatcttaggacggggcagtgtgacttataaggactaaggtaaggtgtgcccagatcttaggactgggcggtgtgacttataaggactaaggtgtgcccgggacccaggataagtgtaacagcactctctctagaaccgaatagctagcacatccgacgggcgggcccacttacacataccactccacttacactttcgtcctcgctttgtgtaaaagggttaacccaggagtgatatggttggagtgaagaggtcttataagttggttccactcgtgctaaactagcaaggttgtactaaacatgcacacacagctcacatgggccacccaggcctcatcctaattgggccaggttatcacatacacccccctcaaaggactcgacgtccccgtatgcccaacttacccatgtagccacacaagcatataggcaaatgttcaggaacacgccacttcttagcgcacgtccgtacatctagtgttggcactatatgccatgccatgtgcctcacacagagtccacatgtgccatgcgccatatgtccgcacgctgacccatacacgcaaccgcgagggtcagctctgatacaatttgtaacagccctccctccagaaccgcatagctagcccatccgacaggcgggcctacttacaaataccaccccacttacactttcgtcaatgcttcatgtaaaagggttaacatgggagtgatatagttggagggaaaatgccttataagttggttccacccgtgctaaactagcaaggtggtactaaacatgcgcatataactcatatgggcgacacatgccggggatcctaatagagtcgatatgcaggcatgctcgggtctgaggcagaccttagtatatttctcttaagatgtagatcttgtatgtctctacgcccctctgaccaagtagcgcaggacttacaagggccaaggtgagcccggaagccaagacaagaccgggtccgaggcagaccttaggttacattcttaagatatagattttataggtctcaacactcctcttcacagagcagtatgtgacctagatgagctaaggtgagcccgagacctagagcaaggtcgagtctgaggcagaccttagtctacattcttatcccgcaaacagataaaggtgtgcccctagccacatcaccctaggggtagctttttatttttagggatggtttaagtatgccatttattttacttctaatcgttttgccgggtgaatgggtaccctggttcccatttcacctacagatgcacaatcccaaacattaaatctataatgaatctaagtaaaagagactcagggcctgtttggtagagctccagctcccagatcatcttaccttgagcttgagcccaaccaaatggtccagattaaaaaaaaatgggagcggtgtggggtagagcgatctgaaaaagtgaattagagtgatggagcggggttagtccagctccactactccactccgaacctaaagatagcgctacacatccattttctcataaattacagcaaattaccatcgaactacccttccatccccccatccaacaccgtttcacatgaacccttccccgaactcgctcgaggagaacaggaggcggagagaggggtgctagggcaggactcaccgacgctggcggaggaaccctccaccccggtttttcccacctatctcggctgtggctgcgcacggcggcagcggagtaggtgccctccctccctgcgtcttcctacccttttcctcccaatcccaatgacccgtggcccaggttgtcatgctgagtgaggagcacacagggcggtggcggcgcttggctgcgaggctggaaatgtttttattttttagacttttttatgttttaattttattaatagaccattcccaaaagtattttcaaactgaaccttttggccacaccagcccgtctggcgtggccaaacaactctatcacgccacacttagctggagtggcagtgctgccctgccacgctagcctcttgtcacaccaccactgctggcttcagttttcggaaatacttttgggaatggtctattaataaaaataaaacataaaaaagtctaaaaaataaaaaaaattcgcgaggatgttcaggacgagcatgacgactaaggttgcgagcataataaaaaaaccggactaggactgggccagcggtccaaccggaaaaaaccgaaccagcactcccaccggttcggtttgctttaagaccgctcatgcaatcgacccggtgtcccggtgtgaaccggacggtttttcgaaaaaccggcgacccgagctatattgaaccgctggttcgcgaagcagatgggctggcttctaaaggcccacttggattgttgtggcccaactaccttttattgtataaaatgagaaaaatggtgcgccacatgggatcgatgcttggctgatgggatagaagagcatcaaccacaccaccaggctaaattggtaaccttgtttaagcaaaataatgtgtaataaatgtactgtccggtttaaaaattgaaccggtcgacccgccggtccaaccggtgacccggtgaaccaagagctcaagcggttcagtgcccggtccggctttttctactatggttgcgagcggcgctcaaaggttggtttttctgatcgaatcactaattttttgtttgacataaatcaaattctaaattttcctcacatgttgagtttcaatcgggctcatttatgtatgaatgattttacattttgatttattgcttggtattatgcaatgaaaacttgggaaactttcatatctgaaaatttgccctttaggtgtgtcaaatttcagatttaagcacttgtgaccatgagcattttgtttcactgaccaagtccaatgtccataatttcagtttgcatttgagaagtgattgagaaatctcagatttagcacatgtttggtagagttccaactctcagatcctagctccgaactccaactccaacggagctagctcctataggagctggaggtggctctaaagtgtttggctatcttgatcaactccaaaattcctgaaagaaaggagaggagaaagatgtacaatattacccttaagtattttgttgtttacttgatatgttattaataatagttgattgtaggacttgctatgtatatgtttaaaatttataaccaataaatcaatgttagttcccgttaagaacatgaacacgacaggtatgtccgtatgtaaggtaaaaaatatatatatatgacaaattgtagtgtacactcatcatttcaattcagtacacgatgaatcatgtacttcaacatcaaggaagtactgacaagcatacaataaagaaaaacttgagctcaaatgcctattgatctgagtaatactggcatcatttaattatgaataagaaaacttggagcagaacttttacacgaacccatagctgcataaagtcaccaaaaattttattttgggatgaatttatcaggacgtgacaatcaacatgtaacataccaggattttcacctaggaaaaattttgaggaaaaatttaaaaccttttgaaagctaaagcatttaagagcataatagttgatcttagagtttaaatcctgtaaataaaattaaaacataaagatttgttgggtcaaggtttaaagctaatccaaaattagattttataaaatcttgggttaacaaatctcaattcaaattaataagatggtttaaactttaaatagaaatttaattattttggctttgcatttcaacctaagcaaaacatttttgagctaaatgaaaacaaatggagatataagatttaaaataataaaaactcaaaatggaaataaatatacttggttgtatgtgcatttattattttaggtttgtttttgatattcttggtgcatctcataataggtttcatatgcatgtcatgtctaaagaaaactcctaaaaataaattatgcaataacaaattgcactaaaattctcatagatattaaacaacatcctaagtctacggtaattttagtttgaattaatcacatcaaatggtatctcaaataattccaacaactcatcttgaaatctggaaaacagcataccatttagcctattttacaccttcaccaaaattcaaccataacctatctagctaaaccacttggtcagaatgctaatcatagtgttctctaccgcctggtgcaatggcttaattaaattcgaaatgtaaccacatgaaataaggccacaagttgcttaaacaatatttagactgcagtcaacatcgtaacttagacctctttactaaatcaccatggtaactcaaaaagtaattaaatcttggaacttggcacattgaaccatcaaatccttgtccaccttgcagcaaccttgtctccccaaaattctaaattaaatggaagagaggagagggattaaaaccacatgatatagtttcaacacttagaaaatttagagctttgtttctccttctacacatctctctcttacatgtggggactatgctcttgtgggacccatgtgtcatacactcacagccaacacatcatctacacacctttcatttaattattcatttgttaatccaaaagtgagagagtgagataaaaatcaatttatacctaaactactactctacctctcacatacacctaggatacatcaacttggacccatttatcatccaatcttcagcaaaccacctggttagacacaccattgaatccaccttgtatttatcaaaagaagaaagagagcaagagagagttaaaaaccaaatttcactcacattcttccccataccccatcttccatctaggtaacatctacaattaaatcccagcttcatgctagaatgggtgaagtacaagtaaatcccagctcctctagcttatcaacaccctaaattcgtgtccttgccaaggtttgacacctagctaacacctagccacctcaaccttcaccatttaccaaaccaactagccactgtaatccccatatcttcctcatcgtgttccactaagaaaaccatcaagaactcctcgaaatctccaagaacatccacttctttctctcatccgaagatgtttgattcgtcataaatcttctctggtgagcttcgccacaatataatcctgagaacgtgatgtacagaccatgcctaattattccttttattttttctccctttgcatggatcgaacaccttgcgtcgagctcgtcggcgtcctcggtgtccagagcgccgccgtcggtcgcttcgccgttcccgatgatccgatgcatctccgaccgagccgctgcgccatgagcgtcgccaatgttccaggagaaggcctgccaagggaatcgagctgaagatccgccgaaaaggagatcctctctttcttcctcaagtccggccgccggccaacgtcgtccgttcctcgctctcgggttagcttcggcgcaattcctcgcatatgaagcatccttaggtgatctttgatccattcccctcctctccttggcagcccgaagaccggaacgaaccgtcgccgtgaagccgacgctatccatcgccaccgagccatctcctccactgtcaccgctgtccagaccttttcaagccgcggtaaagcttcggtgagcttcatagcacttcctaatgccacattcatacatccatttgatcactacatggctataggcgcacatgcagtagcagcccgtgcacagccgtcgctcggactcgccgccggcgttactccgatgtccgcaatccgagaaaagtagaggaatggaatcgcgagagcgttctcttcatttcatattttgacctcaaccccaaacgagccacctattgccgccggtgagctcgagatcgagctcagccatggctctgctcagcctctgcatcgaatgaatgaggtagagaaaagcagggaatttgttttgagaattcgaacaactgtagggaccaatatgtaaacatattaatcactaacaggtgggtcaagaactaaaacgtaaatatgaaagaaaacggagagtctttgtaaactactccctccgttccaaattgatctacatatagttttcttaaggttattcctaaatgatctacatatttgtgttcatttattaactctattcgttatttgtgcatttgagtaaatggacattgatccatgcatccatgcacacaaatatttataacccgcatgcaatatcttgatttgctattggctaggaaatattggaaatggtgcatgcatcaagtttattgttagagtaaatatagtatgagagagttattagctttttttgtctgagtgtacctatgaaatatttagatcaatttggaatggagggagtatgtcacagacacgtttttggactgcgggttgattcccccacactcgagggacttttctttaaaagatctatcactgaccagtgggccctatgtgtttaaaatctggaaaaatataaggaaaatgactagagaagatattttgcaattgaaaacttgcccaaatttgtaaaatgcatataaaatccattttagctcattttgatatgaatcaaaatttctgtgaactcaaaaattatggaatttaatttagaaacataaaaatttgcacttatagtataagaaatagcactaataattcgcataataaacaatgaacatagagcaatctccaacttagaaatttcatataaaattcatcttaacttaatttggagtgaaccatgttccagtatgctcacaaagccatactcttaattatcacaaactaaaacttgacactttctgtaacaaaagtatcaccaaatatttatctagtgaaataactagtgtaatgcaaactagaaactataaaatccataagtaattcattttaactccaaatgggccaaactaaaattttgttagtttcatagaggcatgtacattagtttccaaacaattcttagaagaaaacatatctagaaacatgactaaaatttaaataatgagttaatattaaagaacggtttagaaacttctgaaattcatatcaaaatgaatacaactccaaataaggtgattccagttttgttagattgtcaaaatcatttacttagtttttataaaataaaatatgacacaaacagtacccaaaacatatctaaaattcgaaataactaataaagactatagcatatgacctagtttgtaaaattcataataaagtcatgctaactttaaaagttgtgaaaccaactttgttgaatacctgtgaacattcccttcactgcagtaagccatcagttcacaaatcttgaccctaaaatgcacctaaggacttttagagcttaattaatctagtgctagtattaaactttgaaaattaataactcccaaatgcaaagtgataaaatagaaattccttcaccaaaaatcttatccacacagcacctaaccacactagtaaactcatgcattttaaagcattttagatttttacatgttttagcatttatcgttaccgttattccttttaggcggcgaaaatcgttatcggtgagatgattggtcttatagctgatctcaagaaggtcttataccaatcaaggcaagtgttgcccttcctttgaacacattgaatcccatattttcgggctaagtgttttgattgtaaagttgcacgggtatttctaactataggtactttcaaaactatagattatagttgtaccattaaaagatgcatgaattcccttttgaaaataaccccttgctgttttgaaccttaggattaattagagtactttaattgtgctcatatgagtatgctatgcttttataaagtgcaaatgcttagccttgcttagtaataaataaaaacatggttatggatcacttattatacttttgaaaacccttttgaacaatatggacagaggtgattctctgattatttgtgaaataaaatgagataaaatgtgattttagactttggcggtaagtggtatgcatatggtagtagttgcataccgatagagggagtgttcgcctgagtcgattaaggaccgaacatcatatcacccattgtgtttaccgtacatccacatgtgtctttatgggggggtcttggcctattaagttaaacacttgtctaatcttgcattcgggaggctgttgtagtataggtaggggccacgagtgtactgtgggctacctagaggaactacccatgtgtatgttgaaccttaggacgagtgtactgttcctaaatgtgtgatcgtaggatgataaattccctacgtgtgtgatttccgtgagggacgagtgtactgttccgcctcacagcatgggcgtctaagtgtgtccaatacaacgatattgtgccacatggtgggttcccgttgtgtccgtcaccacggcgttaagtttaaagcgtgggcccgccacttaacggttctaggtcatataacgtgtatggcatatggcctaggatagaggaacacgtatcttgctcatgcaagattagacaatacttaatgttaaagactcgttatgacctctagaccacattcaacatgaagagtgtggtggagtcttgcaaactcaaaacaaactagagtgttcatatcatgtgggtaaagctgtacaaactctgcagagttctaaaaactaatcgattagctgtgctcacagtcatgagcgacataatgatgtgctatgggtataatctcatgattgctaagggtgagtttgaggagaaggagattgggaagatacgtaaaacgaggtgagccattagcatatgattaattgagtattaactattttaaatttcaaaaatagattaatattattttttaaatcaactttcctataaatttttttttgcaaaaagcgcaccatttagtagtttgggaagcgtgcgcgcggaaaacgaggtgctttctcaccctatatcacgcaaacgaacgcagcctaaaagcttttgaaactaaatgttttgagatgatgatgagattgatatatgtgatatgattgccttacttccctttgtgttgtaagggaatgatgtctatctaattattttttttactggaaatactgctaggactttacctcgcagtgtgattttataaatagaaagttatttacaagagatcaaaagggaaacaaaaagatcaaaatattacacagtttgtaaccaatcaaaaactatctgttttaggggatccttcattctgcacaaatgcagaagaacatcggctttgaataaagccctccaagaactgaatgagggaagctcatttcgaaagattttcccattcctttcttccaaatgtgccaagcagcaatgaagaaaatttccaaaaatcccttctgactgaactgaatgcgagccaaaaccaccgtctgaaaaaagtccagatcaggattctatctaattatgttgatatcatgccatgattattatgccttacacattgctaaaatgcgttgcttaaattacgttgcaaatgttttgtgaactaaaatttactttatgctgaaaattgaaaccacatatagcctttctttgacttagagctttcatgtatataggtttgatagtgctcttaccagtacattatgaatgtactgagtctagccatgttttgtctaatttatgttttgtaggaatagacttagtttagtttgagtgatgtgggtttcgactgcttcttttaggatttgtacttaatggggtaaacctctagttggtgtgcttgaggattgggtagtcaagcttctgctgctctctgatatagttatatttggccggtcggcctatgtatctatttagtagttgtaatctgaattttatttgctttagatgtaatttgctatgtatattcatgcttaagatgaaagtgtgaatctagtgcatatcctgggaactagattcacatgagtatgagttaggaatatttcagatgttgtatatctttagctatttttatcaagtctcctgaatgtgtaatacatctggtcgccaccttcgagtggtttgacgggcacatctcaggctgaagttgattggtatgctaaagacccagcaatatctccaatattcctctctcgaggcgtcagatatttcattatgcttgtttgatgacttgaattattcatttcatttctcaattataatggaaggtctgaagagcctacgacaaaaaaaagcggacgacgaaaaaaaaagaaaaatacggtgaaaatagcgaaaaaatacggacgaaaaaaaatatgccagtaaccttcgctacgggtaaaatgaacggagttaacatcgtaataattttccaagatagataaattattcattgggttaatcataattagggtgaatagaaaaaactattgcgcattgatagcataatatcatttacaaaatcgaacacagactcacttggagatgcatcgtgtcacgactcatgcgtggacgatggatgatggatggtgcttggactctaatatgtcgtgtttttctgacgacggtaaaaaaatacgtacttaaaaatatcgattttaaagtttttcgttgttattcgtatattgtccacattatgcaccacacacaatatctgtggacccacatagtggcagcgggtaatcatgggctggtgcggcacggccggatatgggccggaagatgggccgattacacttgctctggatgcgcgaagcgcgcgtcccacgctagtattttaaaggtgccggtttaatacaactcctcgttaggccattcacagtgcagtgaggtggcgtgtggcaatcgttgtccacgttggcaaaatgcatgtgttgaggagaaatggaggtggggcccatgactacaccgggttcatgtacccttctttggttccgagagcgtcagtacgaaacaacttttgtcagagaaaaacgaatcacacgcatcgctctatggcaagaaagccagagagggaggaggggaggggagaagctcactggagagagggggaaggggagaagctcgccggagaaactgcatccgcgccgagcccgagctcccgccgacgccgcaccatcggtgaaggagagagcggcgccgactgtggggaggaagagccgcgacggcggtggggtgagcggccgccggagaggagctcgagctccgcgccatcccgccccgactcgccaccgccgtcgcccgccgctttggccggcgcagccgccgcttggaccaccgtcgccgcccgacgctagatccggctggatctggtcatcccatcaccgatctgcccggcgccttcactggatacgccggcgctccgtccagtgctgggaccgtcccgccgccactctgtcaaccgcctaggctgccgcgtcttccacttccgtcgcctgggccaccgcgtcgtccgccgccgctgcctgtggccgccgctccatcctccgccgcctgtggctagggatgaaaacggagcggatacggacggataatgctcataccgtattcgttttcatattttttaccggatacgaaaacgaatacagatagctcgaatacggaaacaaatatggattatctcgaatacgaataagaatcgaatatgatcggacacgaatacgaaaacaattttttctcggaacacgaaaaccaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccaaatagcactgttcaccggatatccgaattattatctgtatctgacggaaaccccgataccatattcgtatccgtatccgggagaaaatatccgtattcgtatctgtatccgaactatccgagaattatccgatccgaaaggtatccgtattcgttttttgccggagcggacggaaactatccgctccgttttcatccctacatgtggccgccgctccatcctccgccgcctgtcaccgccgctccatccgccaccgccgctgtcgcctaggccgctccgaccgagacttcgctcccgccgagaccgccacggggtcgtccgccgccggcttccgcgccgcctcgccgccggccagccgccagatccagagagggagaggggcgccggcggcgcagtagaggagggggagcgagtggggaaaggcagagaaagagaggagagataaaaagtgaggatagagaatgggagggacccactgtaaaggaaaacgtagaccacatgcactatggagtttgttgcttacgaagtttttagtctagatggaagttttggctcctcaaaaattagtgacacactatgagtgcccttagcacccggaaatcctattgggcaatcgatcgcctggggcgatcagatcccctcccccacgcagttttctttttttgcactgctttactttcctattttagtaagtttatacatctaaaatttgtatacctaaagtttatatctctaaagtttatccacctaaagttgtagagcgaatgtttataggtcaaaagtttatatacccgattcaaattcaaattctgattcaaatattttatattttcctcttctagtaagtttatgcacctaaagtttacacatctaaagtttatccacctgtttgtatacccgattcaaattcaaattcgaattcaaatattttatatattctatacataaagtttatgcgtgcaaaatttacggtataaagtctatgcacgtgaatgagagtattattttttttctattttttttactaattttgtttttttttttaaaattatgatgaaaggagagaagggagaggagtacagggggaa

SEQ ID NO: 58580 - DNA, 4619 bp, Oryza sativa
agcacatttaataggacatgtacagccgactaacaaagtcgccatctctaatataatcctcattatatatgaacagtatatattaaagatagcagcaatagtatctataaacagtattaacgagaatgtgtacacaagtttcgggtgtgctctcgccgtatacactaacactaacaaggtgttatataaaattctaaaaataattagacatgcatttctactattactgtacttatatataaaattctagtttcagattcatcgttaatatatagcaaagaaaacaggaaactgtgataaatctatactcttaaaccagcaaaattttcattttctatgaccaaaatatattgaattttcagttaaaagtctataagtaggtgtagtaatactataagtacttatataaatttatttttttaaaaaatattttggagacatttattaccgcctccgttttcaaaagaaggaaacttctgtgaaataattctcgataaactatgccaatgctgcaaagaaacacatttttttctctcctctacttgcacagcagtaaatgacctctacttgcacagcagaaaaagtcatttaatgacattagttactccgtattatcatggtacatgctctattctctctgtatggtttagctagtcatatatggatttcttcaatttagtcaatgacaataatattcaattggacataatctgcaggccaatatcaggagcgtccatgaacccggccaggaccatcggaccggcgatcatcctcggccggtataccggtatctgggtgtacatcgccggcccggtttttggcgcagttgctggcgcgtgggcctacaatcttatccggttcaccgacaaaccgctaagagagatcaccatgactgcatccttcattagaagcacaaggaggaactaggtcccagaattgatcagttttattgtggtaaaatgtttcctttttttttctgtagctagtgatgttgatggaatgaatgggcagtaaaagtaattgacactgtgattgcatagattttacatgctttggttggcttgttgtagcttaaatggtgaaggattgggttacttgttgtaattatcattctgaagaaaaacattgacaccaaatggctgtgctagaattttgataagatttatttttatttgagcattatcgatcacaatcaaaagacctccaatacagcatggaccagcaaagcgataggtgcaaaaatccagtcaaatgatgcggcgtccaacaagcgggtactgaacaaaatatgcatttcttaatcatttggcctacggcttattaatctacctaaaattaatttataagtaaaactttttatacttgtgccattggcgatttaaatgccaatctagtgatttgatgcaattaaaaaaaatcaaattcaacttcaaaatttaaactaaaaaagggcgaaaaaagaaaagaagaaccaaatctgtccgatcaaaaaagagcgaaaaaaaagaaaaagaaaaacgaatccgattccgcggtaaaaaaagggcgaaaagaaataaaaaagaaatctgtctgattcctaaaaaacgggcgcaaaaaaaaccaggtgaaaaaaacgaccagccaataaaacgaatccgcgtggacgcggtaaaaaaaagagcaaaaaataaaataaaaaaaacaaatctgtcggattaaaaaaaagaattatgtgtgatgcggtaaaaaaatcggatcctattatatttgacacggggctatatatctatatcttctctatctctactacttaaaaaaatttaaaaagtttccgttgtccgtaataaccaaaaaagggcgaaaaaacaataaaacaaaaaaaagaaagtgtgattcaatttacttccgtcccccgtgaaaatcttatattatcttaatatctctctctctctctctctctctatatatatatatatatatatatatatatactacttaaaaaataaaagaaatttccgtcgtccgttgggaaaaaaaagcgataaaaacaaaagatcagaaaaaaaagtccgactcctccggtggaaaacagagagaaaaaacaaaaaacgaagagaaaaaaaaacttccatcgcaaaaaaaaaaatgtccgactctaaaaaaaatccaactcctcggtggagaaaaataaaggcgagaaaaaacaaaaaaagagaaaaaaaaacttctactataaaaaagaaaaaaaaaacgtcctacatccctgcccgcgtgatgaaacgccagccaaagcaaaaaaaacaaaattgagcaaagggataaactagattgaagttcccaaaattaaaagatgataaacgatattgaaactcccctaactcgaaaagagggaataaaatatattgtaatttcccgacaaaatgctctaaatttgaagaaccctaatttcgggtaagaaccataagagtcaaatccaaatcaattaagctaagggttcgggttacttaccggacttgaagcccctgagctcaccccagagctttccgggaagcggcaccgccgcaccttcacctcctcgcagtcgtgtcgggttccctgcgcgcgtgctgtcctggagcacccctccaccgtcctttgccgaagacgggaagcgtcggcttggcgtcgtccctaccgccgacgaggtctaggtcactcagcgctcgtccccatttgcacgcccacctagtcggaccgccgacgtcgtggcatggctttgcaccgccctcggatgcaccccctagccggcgaagcaggagccgctcagcggtcgtcgctgcacgcgcgcaccagcttgccggaccatcgtcgttccgctcgctcgtcgccggagagaaatgggatcaagagagagggatttgggagctagggttttgcccctctccccggttggcacttcattcggcgcagggacgattggagccgtccattagattggacggctcagattcgcctagcgtcgggccgtcgtcgccattgattacgctacgccaatgggccgcggaagtgcatcggaccgcccccgcatatgtcggctgcactcagctgcttagcttgcggaccgtcgaattgactcaactcgccgaagatgggccagcccaagtttgggccggcttgggaagacctaggccgaaagcaaatttgatcaaacaatgtagctcatatttttcaaattaaagtccattagataaattcttaagtaggcccgaaaaataaatctaaaactaaatcctaaatcctatgctaattgatcaaattagactcggttctacctatttgttaatatatcaaattagacttgatttttacagatttaaggtttttcaaggtgtcacactatcaaacggtgtttttcccgttgcaacgcgcaggcgctattgctagtttaaactaaaagtgaaaatcaacaaacttgtatcaataaacgttaaaaaatatattccaaggggacctgatacttctgcttccgcaggccacagggtgggggcccaaaaatggtatgggccagagctaagctaagaactaagaagctgctactcaaaaatttgtacagctcggcccagtgaagcaaagtgtcatgtgatcactactttagcttagctatgcaagaccaaaatagttgtaggatggcactggcatctagtgatgtgatgcaactttctagtttgctagtaacacgaatgattttcagttctccacaaaaaaattgtaacagagtgccatggcagtatatagaaaaattgcattcctgcttacaccaccagatctgttgtacaaacatcgtatgctagcaagctttttaggcttcagcctcgtcacaaaaaaaaaatatggcgaaagaaggcggatatggatatatgttgttactggaacatcctgaggaagttgttcgcgtaggccatcggcttgacgtcagggtgtggctgcaagatgaaatcagtcaagaccttggttgtaacgaaatcacatattatgctgtttacaagacaaacacaaaactacagtagacactacatacaaaaacataactagtactcgtgtcaaaattatctgtcgtttccgacagcagaaaataactacgagcaggtcatttctatggtttgaaacgacgagtatttcagatcagagggagtattcagaccagagggggaatcgagtaacaagtgtaacatgcactcgaccagcttcctacaaaaacatactactgccacatacagtcttctatttcttgggatactaatcttgttgcaagaaatagagtaatagtgtaatgtactcaccaccgctgagaaagaggaaatatttggttttagttctggagctgtgaaccgaatgtatgcacccttgttacccatctgtatcaaaatcgcaattcacaagatgtaaaaggcatgattagatatttaagaagaatatcgggagcataaaattgaccaggaaacaacttccatatccttatggtgcaattattagtttgtgcaaccaactatagttctattgtcgcaaacctggtcgcaataattgggagcagagaacaccgttataagctttccatcatgttcaatttcatagccttcatctttcacttcatggggatc

SEQ ID NO: 58581 - DNA, 8569 bp, Oryza sativa
aaaatcatattaatcaatttttaaaaaagattagttaatatttaattaatcatacagtaatacatgcttcgttttgcgtgccgggtcccacagatactactgtgccttaaagactcacatcacaacacaataataaactaataatccatataatattgtactacctccgtcccaaaatataggtatttttggctatgaatacaactaaaaagcctatattttgggacggagtgagtaacttttatgtggtagatacctactccctctattccaaaaaaaaagacaatctgaatatagatgggacattacctagaacaacgaatctggacatgtttatagccagattcattgtcctatataatgtcccatcaatgcaaaggttggcttttttttgttgggacggagggagtaccaattctaataacttgaaagatgactttgcaagagaattttaagtacgtgctgaaattgcgagggaactttaggaaatcaagacgaagtaaaattctgtacaaaaagtttgccatttaggattcttcaacaaaaaaaaagtcctttgaaatttaaactgaaactatcagtgagctctcttgtatgcacacttgcacagaaattatgcagaaaacaaaatcagccttggcattataaaggcatattgttgctaagcaaccagcataatctgttagtctaaacaaccataaaagtaatatttagcttagaacataaaaaaatacttccatttctaatacattgtcagttaaactattgttttagttttgttgggggagaaaatatacaaatgacgctaaggacatgtacaatggatgccaataatggtctcttagcgttgctaattaggaaaacttattgacatggaagaaagagaaagagaagagataaaaaatcattattatgcataacacggtgaacaacgactattaatcactataatatagaaatatggttgcttgaggataaaaaaaggaaatatttttaccatagggaatattttttgagttagtgattagagtttttgtcgtctcaacaattgtaaagacatgatctctaaataatcttgtattatttaagagaccatactcgtctctatcatcgaacatgccctagtgcccctagctcacacaacgagattcacgtattctttttcatcctactaataataggcttgtgtattgtaacatttcagaaaatagattgacaacttattagcatatgtaggttactgtagcacttatagctaattatggactaattatgcttaaaagatttgtctcgccattttcatgcaaactatgcaattagttttttcaattatctatatttaatactccatgtatatgtccaaaaattcgatgtgatgtttttaggaaaaaaaaatttgaaaactaattgccctagtaggttcactggcattctcattatggacagaacggtgcatatatagctcggccggcattctcattctcattcaaatcctcctcaacacaggttttctcaccattctttttctttttaataatctgtgctaagtctctcattgttccttaatattaccttatcacaactactcgccaaaatacaagacgaaatcaagatatatatagagcatgcgtggggaaaaaacattgcgagaatatccgcttaggtttctttagtatgctttttttgtgttttcctttaccttgtttctttcaccttccttgttgacattgtaaatactttcttttctgcttaatattaatataacaccagcttagccttctgtttaaaacaaacgaacaccacgacaggatcaatgataaagtgctgccgttctgtgcttattagggcctagggcaccacccttagccactttgagcaagtggcattagtgccggtgccagttctcatgatgcttcgtatagaggtgcttgattagctagggaagaagcatcgtgcggaagataatttatttattatctctcttaaatataaccattattataatgataaagtatggtcaagtacatgaacacgtttgtcctctggctgaatataagttttattccctataccccaaaatattgtaatttttggttggatgagatatatcctaataatataaatctggataagagacatgttcagactcgtagtactatgatgtcctatctaaccaaaagttgatatattttggaacggatggagtacggtattttagtaaatttagacatttaacaatggagtgattttacaaatttttaagaaggtatcaaaaatatcatatcataccttccgtattagtagaaggtactaaaattgacattaaatttaggtatcttttaaaaactgtaaaattcctcttaactatgttccagcaaactttgccgaggtgcgtccagcctgcagccggctacgacagtacgaccttctcatttctcaatgactgcctagcttctccgacctcccgctcggacctccaacggctgagattaacctgggcagacacttgcctacagcgccaacgcgcaaacagcaaccactagcaaaccgtgtacattaccgaccaagcctctctccatccatttacgctcgatcgaacggcccaaatcggcgcattactagcacggcgccacggccacgcgcagcgcgtgtacgatgccacattgccacctcgccgctagctcgctctcgcggtctcgccctcccccgcgcggccgcgcctatataaatagagagctctcgcctcgtatgatcgtatcaaactcaaccatccttgctttggctgcgtagcgtgtagcgcgcgcgaacgaacgaacacaccaagctttgctctgcttttcctctgtccaaaacagccggccatggtggtgcttgccaagggcgagctcgagcagatagccctgccggcggcgcacccgccgccagccgacgtgcgcgcgatcgacctgtccgccacgggtcccgcccgcgcggcggaggcgcgcgcgctggtggcggcgtgcgaggagcaggggttcttccgggtgacgggccacggcgtgccgccggggctggtgcgcgccgcggaggccgccgcggcgcggttcttcgcgctgccgcagcccgacaaggaggccgccgcaggggcgccgctcgggtacgccagcaagcggatcggcagcgccggcgacctcggctggatcgagtacctgctactttgcctcgcccccgccgccgccgccgcggcattgccgtgcgccgcgacgtcgcccacgcctccttgccccttacggtaaataccgatctttccaaacgcagcagcagcagcgccctactgctactatctcgcggtgttctagattatatcttttaagatttgatgaagtataattataaacgttttattatcgataaatacatcgtttatcataaaaaattaattagtcataaatatgagtatgccactgtaataaatctaaacggtgaatcgtattttggcacgccaccacgtgcggggtgcgtcggattttgaccgttccgggaaggaagcgagcgaaggcaccaggcggctggacaaagcggtgacatctacgtctgcgttgcgcgttgcaccggcgggttactgttgcttccgtgccgctgcctgcgcagacagatacatgcaccgttgctgcacgcatgtcacgtctctcctccgttcctttgggcattattaagtccagtcatcgttgaatcatcattttcttcgcatcactttattttcctttaacaaactttaataattggtccattggaacgttcgtgtcaaacagtagatggagggtccgatcctagtgagctgagctcggacaagtggagtacttgtttcgacagtacggacacatgatgtgtgcaacacagggtttattggggtgtagtgtagggactgatctgaagtcgttatacgcgcgcgcgagcagcaaaacggaatcatgctattattagttccattccattttgctgtgtagtagtataagcaagcgatagttttgtccaggaatctttctgatgttcgcatgcaccagcattggataccttaggacttgctgttcttcttttccccgtgtatttccatttggcacgtggaacattttacttgagttgaagttcacaggaacgtcagcaacattctaaaaagctcattaagtgtggtgtgtggtggagccatgtcacccatgtgcgcatgacttcactcattaccagtggtctaagagggtgtttgggagagacttatgcttttgtgaaagggacttcctattttccaaacacccctaaattatattaccaaaaaatacacacgtacgcatatacttaatttatcattggtttttatctttttaagtcttagagtgtaatagtgtagtgttgtgtgattgagaaaagattcgggattcaaattcatgacgtgggtatcgttctccattaattaattcgagtcacgcatatgttttcagactttcagcattactctttccgttccatataaagtaaatctagaaccgaatataatacattttaatactataaatctagacatatttatatttagattcgtcgtggatgtatcacctccaatcttaagttaattcttctagaggggcttttgatacattcataaataagcgttcatttattgtagtgttgcccatctggtaaattaatagtgagaaaatcgtgtggataagatcgcccatcgtggccgcgtgtcgcttcacaatatctcggggccgacgtacggagaccggcgccggcggctccgtctgacgctgccgttttgattcacgtgcgcgcacggtcgcatcgccgtacgtggcgcagctcgccacatcggtcgcatgcatggtggtgatcgaccaacaccaccgccggatcatgcatgatgcatctcccctgacctgcggatctgcccgtctctatccacaaaccttttacatcatcacgatccaagccgccgatcgaattcgttgcgcgattttggcttgatctctttgttggtttcttcttcagttgcgttctgcgtgaaccgcgatcggtggtttagtctggtttgtttattttgctcgcggtgcagggagcttctacgcgagtacagcgcggcggtgcggcgggtggcgtgcggcgtgctggagctgatggcggaggggctcggcgtcgggccggcggacgcgctggcgcggctggtggcgcgcgaggacagcgactccatcctcagggtgaaccactacccgccgcgccccgatcagctgggcggcggcggcgggccgaacctgacggggttcggcgagcacaccgacccgcagatcatctccgtgctccgctccaacggcgcccccgggctggagatctccctccgtgacggcgcctgggcgtccgtgccgcacgacggcgacggcgactcctttttcgtcaacgtcggcgacaccctccaggtacgtagtacacgtactatacttccgttgcttgcgtgcacacacaaaattaaaggtcaaaaagtttggtcacttctgctgtttcgcgtacgtgcccctgtcgatgtcgaatcgaccgttccatcgatctccaatccagtcgagcaaatcagggtgatcagtgcacgatcgactgcacggtgtactatgcgtcaagcaagcgccatcaacgcacggttacttgtatggttaactagcacaatcatctgcatgccatgcatatatagggcccagcctgcacgtgaaaacacgtacacttgcatgctagtacgtacgtgcctactactactactaatgggtccatgaacggtgatgagatcgatcggtcactgcaatttgccaactctcaagaaaaggccatgcaaattgttgcacatcacatcgattaattattgacttaattatttacatttctctgtatccctgaggttaaatttctttgtgctgctcgtgtgtttgcgctttgcaacccacccaggtgctaacgaacgggaggttcaggagcgtgaagcacagggtggtggtgaacagcgagaagtcgagggtgtccatggtcttcttcggcggcccgccgcccggcgagaggctggcgccgctgccggcgttattaggggacggcggccggagccggtacagggagttcacctggaaggagtacaagggcagcggctgcaagggccggctcgccgacgacaggctctgcagatttgagaactagtagtagcagtcatctgacttctatgtacgtttgtgtatattaattcgcaagtagtgattatcactgtggtttgcctctagcaatagccttgtacgtaaatttcagtatgtgttaatctgtttatatataagcttccagcaaaagttgcatgcatgtaagtgctctgtggacagtttagttttattacaattaaatgagctctcttaagatgatggttgctagtacactggagcccagaaataacttttaaggtgaggctttacgttgttgtggtttggattgtaatccaaactgttcttaaattttagagtttaattttaaaaataattataggtaattttgtttatttatcttattaggaaccatggaaatagagctggccaatggaagtgacagagagaaaacccttaaaaccaaattctaaatattcaatgtttcaaacatacaatcgaaagcacaacctaatactcccccatccacaattataaggtattttggtcatttatattttctccaccaatatataaattaaagcctgtacatagataaaaaaaatgtttaggatatgaagatgtgatcatctgtttcttggaaaggggtggttgctacttgccccctgtttccaatcttcaatctttgatgcagaaattaatttctttgcttttagaatgaagggaataagacgagtctcttagagcagatacaatagcagactataaaacagctataacacatatcgatgagataaaagaagagagagataagcagcgggctatagatttgtagccagctatatcacggactccaaaacacagtgtgtatatgatatgtgggaccagatattaatagtatagtatatatttataaataataattgtaattaattattaagttgactataaatgatttgaagctaatactcttatactgcaacctgcggcagcatagagcctaattaaggaatctctgtttagggttcaaaaatgcgaaaataaatcctctagtatcttgcatgattggagccggccggtctgcatttagaaaccacacaataaaccggttaacttcaaactaaatgtgagttttcggtaaactttatgtaaatttcacaggttttttatgaaaccatccttaggaattgatattcggtgaccagtcgcactttctataggagtactagtattttccgatgtttcatgtactacatactccctccgtcccaaaaaaaaaatacaaaccctgattttcgtgcccaacgtttgaccgtccgtcttatttgaaaaaattataaaaaaaattaaaaagacaagtcacgcataaaatattaatcatgttttatcatttaacaacaataaaaatacgtattataaaaaaatttcatataagacggacagttaaagttggacacggaaatcaaggtttgtttttttttggaaggagggagtagtcgcctgtgctgtttgaactgacagaaacaaccagcagcccatcacgagctgagcaggagctaggtgcaaatgtaccgtactaacttaacagtactgattaccgaacaactgatgcctgctcagccgctcagcaagagaattcatcgcattcatgttctgggtcaaacaactgaaatcaggtcactctgcattactagcacgtacactacctgtaggttgtggcccttcttcttctatcatcagcatttgcaacactgatgacaggacaaaaggccatagtatcaaggcaaacaagggaaggaatccgtacagttgtctactgcgttccacccgccatgacagtaatatgaagtacgaacccgactgccctctgcacaaccccgacatagaaatagtgaaacacatcacaatggcttgcaagttgcaagtaaatagagggtaccatttggccatatataaattatactagtaagaagctcggacgtcgtaacagatttatagaaatatatagaaaattctactccctccgtttcacaatgtaagtcattctagcatttcccacattcatattgatgtacggaggaagtagcttaaaatgatatgtatttcataaaaagtttttcttttcccatttgcatgcaaatatgcaaatagccaatttgtatgcacaaaaagaagcataagtagatatttgagttgcatacatggacctcttcccttttcgttcggatcgctcttccatggtgatcatggttcaccgtgaatacatgacgatcaactgatattttctcaggaagatagagtgttctaccatttcattactgtaagccacaaattggttaattaaccgcttttacacatcattagtaatgtccgtgtgttgcaattagacagaatctgatgaacttggttcaaat

SEQ ID NO: 58582 - DNA, 7144 bp, Oryza sativa
cccgcccattagcctcaccccttagcacctcctgttgggtgccggtttctaaattcagcatcacgtggagttgataaccgacaactaaaggctttttttttaagtagtgtgtgcgcagttacagagttaatccgtgaccgtgatcatctccacttcgatcgaccctttcgtcgcggccatgaaatcgccatcaaaactgcggcatccgatcgggaaaaggacatccccgtacacgagcccgactcgtaccagttcaccacaccacactaccccgccccacgctataaatacaagcgctcctcgtcctcctcgacctcgatcgatcgtatcccaccaccaccaccagagctagcgcagcaaccgtgagctcagttcagttttcatttggtcgtcgttcgagtcgtcagctagcttcgattcaaagaaggcaaacaatgaggttcgtggcggcgtacctgatggcgaccattggcggcaacgcgagcccgaccaaggacgacgtgcgcgccatcctcggcgccgtcggcgccgacatcgacgaggacaagctcggctacctcttcgaccaggtcgccggcaaggacctcgccgagatcttggccgccggaagcgagatgctcgccttcggcgccgctccggccgccgccgccgccactgccggtggcgccgcggcagctggggagaaggaggaggaggagaaggttgaggagaaggagaaggagggggaggacgacatcgtcttcagcctcttcgacgacgaatgagctatcgaccttcgtcttcagccctgcatctacgtgccatagtctacatgtcgtcagtctaagtttgtacaagtagtagtagtatatatactagtagtaaaatgcacatgcttcgttacgggtaaaatgaatggttgaatgctgtaaagtacacagttaacatcataataatgtttcaagatagatatattatttattgggttaattataatttgggtggatagaaaatccttacgtattttttttattaggtatagatatatattgatcttcaatcctacgatatatttatagcccatatcgcttttcaagtttgcagtgtgtacaagtctctcggaaatgctaatgagcgattgctcgcctggcgccgagggtagcgatcaattagaaccccctccccctccccctcctcttcccttcctccaccttgtttccttttttggcaccgcattactttcctattttaataaatttatacacctaaagtttgtacacctcaagtttacacatctaaagtagacccaaagtttataagtcataagtttatatatccgattcaaatttgaatttgatattgtttatatatagtatttctataaatctaaagtttatacacctaaagtttatagactaaagtttataagtcaaaagtttatatacccatttcaaatttgaatttgaattatatctgattcaaatttgaatttgaattcaaatattttctatatatagtatttctatacatctaaagtttatacacctaaagtttatacacccaaagtttataagacaaaagtttacatacccgattcaaatttaaatttgaattacatctgattcaaatttgaatttgaattacatctgattcaaatttgaatttgaattcaaatattttctatatatagtatttctatacatctaaagtttatacacctaaactttatagacctaaagtttataagtcaaaactttacatacccgattcaaatatgaatttgaattatatctgattcaaatttgaatttgaattcaaatattttctatacatctaaagtttatacacctaaagtttatagacccaaagtttataagtcaaaagtttatatacccgattcaaatttaaatttgaattcaaattttttatatatagtatttctatatataaatttttctaacttttgttttttttaaaaatttttgtggtgtactgtagtagtaagagaagaaggggaggaggaaggggagaagaggaaggaggtattgcctatatgagggagggggcgaatctgatcgctgggcgatcgcccattagcccctcccccctcccccccaagtctctatcgttctgtacccatcacccaaagcaagaatagtgcattgagtgaaagcatgggtatatctctatgcttaccatacattatacatatactaagtatttaaagctcaacatgcgagacagtatttattaatactcctaaagtctaacatacaagtataccgtatcaaccaagtaaacacttaaagctcaacatgtaaagcataataatgacatttataatttattaaattctaaaaatcaacatacacatgttaaattgtcatccttaaattatttccataatatttcaggccaaatccatccattggttatacaacatttaacaccattcaaatatcccgcaacaaattgtaggagtcacattagtacagaaagcatgtttccaaacggtcaaatcctatttttcgtgcgattgagcagcccgtctgctcaaaagagtctacgaaaatcattattttaccatgtgggtggcgaaccacacatgagcattgatttcgcacgcgtgtgcttatgtcacccaaaataaaattccaaaaatataaaaatccctaaaaatcaaaaccctaactcctatctgcacccaaatgctggcggtggcagatccagccgtcgtgggaccgatggaggaagatccgcccgcagctgaccgctcgaggtcactaagccaaccgcacctgccgatggccagtgagagagaaaagaggagaggaggtgagagagaggagagaactcagaggaggttcaaaataacgaggagagggggtgagagagatggacagaaggtaaggatgatgactttaaagattttgaagtgttgagagagaaaaggaggcaagtcgaacttctaagtggatccttaagagacctgcctgttaaaatagacccattttacatgcgggtatgttaagagatccgtctgcgaaaatcatttttttcatgtatcttagtggttgtatgcaaaaatgttctcgatttttgtagatgtgaccagttacgacccatctacaatttaaaggggggtcttgttcagaaaaaatgtttctagtagtgtcagtacatatatagaaataattcggatttaattgttctccgacaataacacgggaagaattatccttaatatatgccatatagaatgcagatgttaatctctcggttgtgctgcaaatgaggctacgagtaaaagagactaggctgtgttcagcagccatatttcctaactcatcaccatcgtttctcacacgtacgatttttaaactgctaaacattgtggtttttacaaagcttttctattggaaagttgttttaaaaaatcatattaatccattttttaaaaaattaactaatacttaattaatcatgcactaataagtcgctccgttttacgtgcacgtgggataagtttttacgaggcctttgggtgtcctcatttcacaagagagagttgagctattgcagtcagaacccatgtgacgatgttagcagcagtggcgatgtaggcctcagagctgtcgtcttaacaacgctatagtatcaaacaaaagaactaagcctactagagggaaaaggtgaattataggatcaacaaaaaccaaaaacttatagcgaaattaaatgtcgcactcgaaatcgatggagatcaatcagaccagcctaactgctccagtctgaccggtgtagatcggccggtcggactgcccttcgtgccgccatcgcctgtcgcctcctgtgctcatgtaatgtaacctttctctctctctctcgtgaacggcggtggtggcggcgactgttgtgcgtgacagtggaggaggaggattggcgcgacggcatccaccaatcccatccccagtccttactctagtcctctccccaagtagtggcagcggctctgcctgggacgagcagcgacggcactattattatctactccactgtctattaaagccactattccttctcccgttcggccattccccatccctcctctcccacgagcagcaccactcctctgatggtaagtaagatttttgttctttgattcatattgtgcaaatgccaaatattatatatatatgtcatgtgctatattgttcatgtagagttcaattgaccatgtgacagtaatgtgtcatttttagcccaaattttgtcaaatttttcaatttttttccctagtattttccaaaaccgctatattgcttagctgctgatatagcctgctatagattttcttagctattggagagctgatccgctaaatgtcttagcccactatttagaacattggttttaatcaggcaatgtcattgttttgtcggcgtgtccttctcaaaggcttcgttttagtggttttctcttgttggaccactgttcttaggttgagtgtctcggtccgcatgttagctcgcttttgtcagtgctagggtttttctatagttaatcatattgttgtaaggatgttgggttcgattttccttataaactaaatcagatatcttcttctaacggtgaatcacaggagcttcctgcctgttccatctaatttgaggaactgcacaccggttaacttggaggttataattttcctagaaattatggcggacacctagacctgatattctgtgtaattatccatgagggcataagcatgaacatgcaaaagcagtacccatcaggctttggatgtttacccaattattgaactatgtttaggattagatacaacaaaaagatctaagcattattttcaaacacaatgctttcgaaaaaactttacagcgtaatataattttatatagggaatacaaaaccctctttgatgaatatagtgataagagagtgagaagggcatttcttggatttcaaaagattaacagaaactatttcgtgggtcaccaccgacctttttttttctattttcacatgtaggagcattgtcacctcatagcagtccatatgcataagcatcgagagaacaagagatttcatttctttttctcaggcctgtagtttgcaaatgcataaaaagcaatggcaacacatggttttccaatgagttaagacaatgaaagaagaagtatattaaacaaaataaaaaaggcgcaagaccatgtaagaaatggagtaccaaaataatgtctatttatggcctgaggtcctagggtgttggcgggctcagatggccaacaacacaatgaagaaaaacagaccaacagtaggcacaccaggcctcctataatgcgctccatacattccatcagatgaagggtgttctgatctcccctcttagataaatgttttcagggtttctataaaaaaaattgagaacgagtttctattaattattgcatgcaaaaaagaaaagggttgtagtaattgggaatgggcagtatcgagaaaattgcatgcatatacacttctagttctagcagtagaacctaacaaaaatttggagaaataattgagccctgtagttcaggacatggtaggcactctgcagttgagaaaggcagctattgacatgcttgttagtgtttagatctgcttcgctgtttgtaacaattcatggcagtagaaccgattggctcaggccacagtgcagtgctctctttaaagacagtgagcaatacacctcaaggctcagatcagtagctacccatttctttcgaagcttaggaaaatctcatgcaattatatgctcgaattgaaacatatcattatttctttgctttgcttcaagatcacatggagtcatggaccagagatcaaatcgaacaaaaaaaaagaaaaaaaaatgggggtgaagagaaacagagtggttacccccagggcatgtcgagttgtcgactaatcttggtgccaccgccgggtggagatctcgctgctccggcggatcccgaaggcggggagcgcgtagagccacgccacggaggcgcacagcgccacggccgccgcgatctcggccggcgacggccgctccgcgaggccggccccaccggcgcgccaccgccggaagaggatgtagagggaggcgagcgcgagggcccggaatacgcggtcggcgtggcctcccgtcgccgccgccgccggcgcaggtccagcctcgccggcggcgacctcgtcgtcgtcgtcgtccatgctcagacgacgaggtggggaacggatttaccggtgtagttgagttcgcgaggcccaagtccgtcttttttacttgggctgaagcaatcgggcccaaatttgggagaactattgaaaacccaacttagggccgtgtttagtttctccttcaaaattttttttttgacataaacgaaaacacattcgaagtattaaatatagattaaaataaaataaattaaagatttcatccgtaaactgttagaggaatttattaaacaagtaaacaacaaacgagccaactcgatttgtgtgtgtttttttcttgtagttgatgccaaccaaaaatagctttccaatttggacaaatacttcagcacggatattgtgaatcttttgtgtctcaaatgatgagcacttaatagccattgtgtccacctattagctgctcatcactccacatgctatattaagtgttattttgtcacgcccggaatttctatctaaaattctaaacgcttacacgtatagaaacccttgtccagaaatcagccgaggtacataataacaaattgataatagagtacaattattactctaattaataagagaataaaatgtcattacagaggtagatagttcctctcaatcaataaagttctaagcaacggaaaataaaagaaacaacgcaggcgactcctctccacatgcagcttgaccagggctacgcctaatcatccactccatcggcatcactgtagaactcctcctctgataaatgattgcaaggtgagtatatgacatactcagcaagccacgcagcaaatatgcaagtgcacaggataacaaaggatggcataatattgtctcatttgcataaacaacatttaataaatatttcagaatttaattaaatagttaaata

SEQ ID NO: 58583 - DNA, 9485 bp, Oryza sativa
ctttttaacaaattttacttcatacccagattattttcttgtagaaatttcttagtcacatctgcaccaaacgaaagaccaacaccgcgtttgcttggacctctaccaagttgaggctgaggatcactccataatacttcacacattagacctgtcagcagaaacaggagtcatgttggcagataactaacatgggaaaaaaggcatcaaggtaaataatatgccaacacttataatgcaaattaatggttaataacttaatatatgtcactttggaccataactttgaattgaggttcaatcaagtgatactgggccattaatgtattccatctcacaagaaaaataaagatgatagatcagcaaaaatagccaagttcatgtgctagtaagttgaccaagttatagaatcagtaccatgttgttcaacaaaataatcgaacaaaactcaaattacaagatggatcagacataatagctaaatcaaatgggagcgaacttcaatgataaattggaaaagacaaggtggatcatacctagaatctgctgaaaatcaagcacatacaaaatagaaaagaaataaatagctaccttcttcaggaggctcacggaatcgatcgatggctctaatatctgaaagcttaacaccatcaacactaaagagacctccatgaacaacaaagaccttgttgttgatgacatgagcaaggggtaggcaacagaatgcttccgcaaatagttcaataaatgcttctcccaacttcgacctcacttctccctcaaaaccatatatcttattcatgctcttgctctcatggtttcctcttgcaaggtacatacctggatcattcaaggtatgtataaaggaaaccttattacatgaacaactaaaatcgatacatctattataagttagaataatgtaataaaagagctagtaaagtaacagattgcatactaatatctagttcatgaaaagtatcaaaactagcagttacctgtcggatagaggcacttgaaagcaaaaagagtgagtatgacttcaacagaaaaagatcctctgtctacaaagtctccattgaagaggtaaggattctcttccgagggaagcccattgagcttaaatatattgagcaagtcaaaatactgcagtggaaaaaaatattacaattccaatcaggctgtcagtatatcaatatgtaataaactaaatcaaatgacagctaaaattttagcatgtgaaattaccaatatcattttccatttcaaaaaagaaggggacacccagaagcactaggaaaaaaacaaaagcaatgcattcaaaaaatttaaatacctgaccatgcacatcaccacaaaccgtaaaatgacttccatcaggaacgttcacatcaacaagcgaaggtacagaacgcaatagctgcacggtttgtaacacaatctggtaggcgtacctgcattatcaacctaagtagtaaacaaccttggggaaccaatataaccaaagaaaacacttcaggtatgtcccttgtacaaagtgtaccttttgtgtatgcatttctgtttctcaaactcatccaacatagccttgacaaaatctaatgttattgtgtctccatcaactcttggtcctgtatattgtggctctacttctggaacatacaaaaaaaaatattaaccacaatgtcaactaagcaagggatatttaagaaaataacaaaagccatccacccagaaagagatgttcacaggtaacatacgaaagagccatagtacactactctgtaggcattggtactgcaaatttaaatgaaacaatagcatagaagtaacatgagacaattaggtccttatattatagaatgcatccgcttggaagtagcagattcataaaagtgctaaacagaaaactcatcaagaacaacttttctgtaggcatcggtactgcaaatttaaatgaaataatagcatagaagtaacatgagacaattaggtccttatattatagaatgcatacgcttggaagtagcagattcataaaagtgctaaacggaaaactcatcaagaacaacttttcagttatcctgggaatccagggaagtacgaatttcatgagactagcaaacactccctctgatttttttttcctcaaatggcattggttactcgaaaaatgaactaataaaacaaactcgtcaagtttgactaaataacactaatatatccaggccataatcatacccaaggttggctttgtcaaaaagagtacatggacctagcagagtggaaatatgttcagaaagtaaacaccagatacctatgatacggtagtcaatagaatcagctacagagcgcttctcttcatcccctacagaaattgcctcttcaaaacggattttctggacagctttctcacactctttcaatttcctagtagcatctggatcattagggctgattcttttcacctagaaagaaaagtagacttattaatgtaccacatgaaacaaaataatgtggttcctgctatccctagatggtcaccaacattaatataaagcagcaccaagaaaagcaagaaaagtgactagaaatagtcattctcaatcactcaatctgggaagagaccacaaaactaggaaaacaaactgcgcacctgttgaaaatccttcagagcttccttgaacttacccatggcaagatatgccgctccacgtcggtagtaaccctacaaacaaaaaaagggtaaaagataggaacttgcaaacctgtggcaggaagaaatggcaccatcacttacttttgagtatctagcatcaatttcaattgcttttgaagcatcttgcactgcacttccatattcctctaactttgtatgagcaaatgcacggtttgcccagtaaactgcatttgaactgtttagctcaatggcttgactatagagctctatagccagggagaacttgtttgctgcagaaaataaatagaaagattatccaccagggaaatattcctttagaaaactttgggaaatgctgcatacagcatgagagcccgaatcttttattttgtgagggcaatatcaatagcctgctaccactcagatggatataaaatataacacattagagtacataaacagatactccctcccgttacataattcttgatgttttggacaactgacatggtctccaaaacatatctttcactatgattttctattaaaatatatacaaaaaatatgtaaacaattaattttattgaagtactgtttaagaataatctatgcatcatgttctagtgtcttcaaaccaaatatttttcacgttattgatagtcaaagttctaactgtttgacctcaaccttgtccaaaagtcataattatggaaccggagggagtagatataatactaaaagccttattgatcaacaactattacaatttcatgttgattggtattctaaataagtgttattagcatgtaactcacttatgtcaacatttgaaactctgaattacaactcaaaaacacatgcagttctgacataataaaggatgaggacatgaagtggatcaaatcctaacatacctttaaaggcatcatttgctttaagcttgagttcttcagacttttgctcatttaaactggagttggcatccatgatagtttcccttgagctttctccagtaaatgctacttcatacacagaatttcaagtcctgtaccaatagaatacatttgcagcaaaaaataaattaccagatataattaaaaaatgcaggagtattacggctacggacaacattaagtagaaacaatgccccagcatattgggtagaaaaatcatgcatatttcacaccaagaggcatccatgtattagaaacaattagcctggagtgtggatcataaagcacgtgagcaaaaggtagaggggctttttagaaacattggctgcggctgcggctgcagttgtgctgtagccgtctaactcgcccaagcatggctgtctttaaggcagctgatggctggttgctccagcgcagctgcactgcagccagcactgccaaacagctccagagaagggaggctgcatatggtttatttccatttcaagccatacctaaatttggtaacattaacggaattggccatacttcgtgacttgtagcctatatagcctatactttagcagaaaatatgcccaaggtttaacatcgctagattttggtaaggctcgtttggacaacaaaccagacatgccctaaaaactacaaggaatcagaattgccaggaaccaaagttaaaaagtaacagagtaatcattcttatagagatacgaatacaggatgggcagtgatttcctgccaaaccaaggtttggacaaggccctgcagaccatagagctgatccaacaaactctgcatttctgcagatacggatacattttgcatattggagatctcttcccccaataaccaacaaatcacaggctcatataaggctgtgttcttcactcaactttcccaaactcaaccctttcgcttcccaaactgctacacgatttaatttttagaaagtttctataggaaagttgctttaaaaaatcatattaatccattttttaaagaaaaactaatacttaattaatcatgcactaatgagtcgttctgttctaagtgcacgagggattagttcccagttcccacctccaactaccaaacacagcctaagcctatctgaatactcacatctcacctgagcttggtcggagttcattagacataatcaagaacaaagcatgcccatttcacatgatcaccaactgttccattttctaattctcccacattttagatttaaattaatataatgctaaattcagaatccattctaatgtatcttccgttgttttcacaatttatttaatattttggaattaaaaggtatctaattgtatttgtgttggagttttagtttagcatgtttcatggattaataattctaaaatctggaatcgatagatattgagttttactcagtttggagctctataattagttctttttcacagtttaataattccaaaattcagaattattaaggagtagattacatatgatatatggactctctttttaaaatgaggtggactcttattttatctaaatgatttgtataatacaaactcttagtatgacatatggccacgtattacaatccacctaatcaacggccagatctttctagttaatgttgtccctcaaagagccctttagaataggtaaatatataccattatgaagttaccaattttgaaaaatgccattatgaagttgtgccttagaatcatgccattgcaatatgaactcatggttcaagaaggcagctagtcgggcagctaggtggcacctagcgcctaggtcaacccaactagtcaaacccaagaaattagcaagcatattacataaaaactagactatataacactagaatagcgacaaaacatcacccgaggtagttcagccgcctaatgcctaatagagccagctagccggtgccactccacctatcccgtcgaggtcaaggtcggcatccatctccgtctcgcctcctacccagctctagccctgtctggccatgctcagaggacaccgaacagcagaggtccaccccctgcgagctgaggccgccagccacaaccagtgattttccttcaccaatcttgtcactggagcttgtcatatggccattctccgtcaatatgtcggtggtagatgagatggaagcaatggaattaggtgcaggaatgaggaagataagaaaaagggaaacatggtctaaatatctccacattggcatatttcagaagatgggaacttggtgtggtatgtaaggcagagtaaactttacaattgcaagtttcaaaaccttttactcctcaatggcacatatcaaatagtttaccccctaaacataattttgatactatggttgttactgttgattgaatagcatacccaaattaagcacgaaacaagcatttgcaataagaaatcttagcagcagaaacaaaatcgtccatacacatactgacacacccttatcatcaggagcagccatggacacttgacaatctgtgacagttcactcaatactgtgacagtgcagcccagaatttgatttttcttagaaaaccaacaaatccaagagttgaaaactgactcgcgcaaccgctggtcaaacatgcagcaaaaaggagggcagggaaaccgaaacattacgtgcagcctggagggagaagggagccgaggcagcgtcgtggcgcggcccgaaccaacgaagcgcggggtggcccgccggcgatggagggcggggtggcccaccgcgcggcggcggaagcgcagggggcgagggtggcggcgtggaggagacggcggaggagtcggtggaggggagggaatcgtcggctgcaaagggggatacaaccggaacaccaccaatctagggttgccaactgggccggtggatattttgcgtggcctatgggaataagttcacctgacgtcccttgattgtacgtcgagtctgtcggaggtcacctaaccgcaataccagaaatgagtgcccctgaactatgtaaaaacatccaacaccaaaggtaccagatgcctggtttcgctgacgtgacatcgtaggttgtaaaataaaataaaataaatatgtgaggcacacatgtaattgagagaaaatggtgtgggccccacatctcttctttcttttctttttctcttctctgctctcctctcaagcgggcacgcagcggcaattgggggagaggcggcccgccggtggcggggggggggggggcgctagtcgatgagcatgagcaacacagcgcctgggtgtgaccaatccgggggcgtggtctcgttggccacggcgagtagctgccacccaaggacagcgggcagcgggtggtggggtgccacggtgaagatgatccaccaaaaagggaggcgcaacgccaggagcggcgatgattggtcctcatcggagtcaatggcccgcaagcgcgagcctcgcggcggtgcaacccgcgaggtttgtttcaccgacgatgaggcccgggaggtgaccgaaaaaagaaattttcccattttggctcaatcatcttctctctctctcctgctgtctcgttggccacctctctccccctctcctactgtcgctgcccccagatttctggccccatacaggtgaataggctggaatctaggtgccgttgctaatgtactctaatgggaagcccttccaagctgcgacgacgatgatgtccacgcagcgccggcggcacaccaccaccagcacaccaagctacggcgggggcgggctcgaacatggcgacgacgtgtgcatggttggagtagccgccaccgagagttggagcagcgggaggcagggcgctgctacctttttttcttcttgcttacatgtgggccccataacttttaattattttttgctgactatgatgccacgtcaacgaaactactcatatattgccatgggacctaatttgcacggttttgtatagtttagaggtgaagatttctggcattgcagattagggacctcagacagactcgacttaaagttgagggacgtcaggtgaacttattccacggcttgtttgggaaaccctaaggcttttaagagtctgtaaaatttggattctcggcttttggtttctcttttattttctagattctacaacgtagtttcttatttgactcctttcttttcttcaactccaaccttcaactttctcgtttttcattagcacacttttcaaactgttaaatgtttttttaaaaaaaatacataagttgtttttgaaaagcaaataaatccatttttcaagtttttaatagttaatatttaattaaatatgtgctgatgagctttttcgtttcgcgtgtttagaggagcttatgatcctaggagaagctccttaaacaggtcctttagataggcacaacgcttttctatccaactaaggtgataacgggtcttctttgttgatctgaggccctattttataagtttaagattccaaaaaagagatgattggtaaccagtacggcatcctaaactcaaatttaaaaagcaaagttataccaataggagtaccttcacaccatattgtttcttcacttggagggttaccaacgtcaaggtcatttgatcatcgggaagatctcatcttcttgatctttgacatttcgtcttccatttctcaaatgattaatgcggataatccatggcttcaaatgccctcgcacggttcatcatgacacagtcttcactcgcccttcaccaccggtttcggttcgtcggcgccaagccccttgcttgcccttcaccaccgcattgttcatcgcagctgagcgtcgcttgcgcttcaccgtcttgccataggtagtcacttcatacccgcatcttcaatatcttctctttaattatcatccatcgataagtccatttcctagcttcttcatcggactaatcacttgcttatacactcaataagtgcattagacccttaatcgtttgtcatcaataaaccaaaacccactacaggcatagatgctctttcaatctcccctttttggtgattgatgacaacacgattaaagcttacaaaagattgataaaaaatgattttgcatccaaaggttagtttgagctcccctaaatgtgtgcatacaagtttatgaagtgagcacatatgcacatatttttgaaaatgagagagctccccctaactctttgcatccgtggggtgtattgtgtgtgaacgagataccaaaagtaaaacaacatacacaactcaaattcttggcaccaattcaaaatgtatcaaatgaaattctcgatgccaattgcaaaaacttgattctatgccaactgattccggttccgattgagaaagcatgagtaatcaagttcaagtatcaaaagaaaatctcaattgcatgtggcatggagatcaaataataagcattcacgccaattgataaacacttacaaatattctctccgcctttctcatttactcttggacatctttaaagcatgcatttcgatgatttctcacaaatatctcaccctttgatcaatcttttctttatcccctatagaatatttctccccctttgacatcaaacaccaaaaggggcataagtagggaaagaaaagcaaagggatccttgatgagggatcatcgagtacttacctctcaattttatatttcatcacttgtgattaggaaatgaagatcaatttcacataaagatcacaagtaaatcaataagcattgagaaacaaattttgagcatagaaagctcacatgcaaaggatgtaaagcatagaagaaaaaaaaatctcacctaagattttcacaaaacatttcacaaaa

SEQ ID NO: 58584 - DNA, 10717 bp, Oryza sativa
aaggaatgaaacttggcctagatgcacagacaaggcaagtgatccaatcataccaatttaaataacaagctatggatcgtcgagttaccttccatgttgatttttgagatgcccattcaataaaattgatatcttgaacccaatttgaaattggcaccttgatgggtttgatgaaatctcttccttgatttgcttgattccaatcccgagaaagaacttaagctttcccatcacgaacatgtttaactccttgatcacagtctgcgtcctgataatgcttgtgctcttcttgtaaggccatgacccgatccggtttagcatttgcaccatcttccttctagctaatagtccaaagacaacaagagagagtaacattcacaaattttgtaaattgagaatgaatagttactccctttttgtaatgtcattgaggatgttgtagggaagatctcgttgaatgatgtggtgaattcttggatggtacaccgatgggacttgagcttgcatggtgtaacttgctcttgagtgctcttggcatcaatcccatccacttgtaccgaaagtatgttcttcatagtcaattgcggcaggttgaattgagttgattgaggttgatcaagtagtccaccttggtcatcatgggcttcttgtggtctcacctacccaagtgtcttcgaagatgtttttaacctcctatgagactaatcacaaaaatacacttgataacaagttagtctcaaaaacacaaaacatagggtatactccccctaaaagtgtgcatccaagttcttgaattacttgtagaaatgcacttgtttgatgaaaacaaatggggagtatagcctatattttggagaaaggcacataaagtattctcaagaaaacacttgtgccaaaacataacacacatcataaaatgagcatgtagattatcggaagatattgaatcaaagcatgacaatcaaccataaaaaaaactatttgggttacccgtgattcttgcacggaaggataacctttaagtatgcatgttcttgtgagcttggagccttcggcctagatccttcgggtaaccaaggaatcttcctggagtctccgaggtatccacccagagccttcgggctcgatggcatggtgatagatgagcttgattacaaatcgagcggtcttatcaaagcctttgattccacaataaaatctgcaataaaccttgtagataggtcatagaacattgcatatttttcattttgggagttttacccaattctcaaacaaatagaagccacaaaaatcacaaaaatttagaaaactgaaagtttcaggattttcagaatttggaactcaaaaagagcttgaaaagggcatcataacaatattcaaacgactatagaaaaatccaagtaaatttagatgtgaagtccaaccatagaggaacaaaagtcattatatatactcattccagtttgcaacctattttgagatataaaaatcacaaatcagtcaaaaaccatgaattttctaaaaatttcagcaacttgagcaaggtgagaaaaagtcaaattctttccaaattaaatcggaatgatgcgaaaccttgcagaaatgatcttttcacttaatagaaacttttccaaaaagaatttctcaaaaaagatttttctatcaagagaaatgtcaaaaagagttttgtaggccattcaaatgaatatatctcaaccaaagtgtcaaatcacattcaaataagatttttatgaagtttgacatttggaaagccttagatgggttagagatactaattcatgcccatattcacaaagaattttggctcaaatagttcaacccaccatatgcaatttttggccaaaagaggtaaagtcaagatttttgatgaacttcacaaggctgcaacatttgaatggttggtcttttgaaaaagctttgaactaaaaatgtgtttgaaattaccaaccctaaaagttttgtattggcaactttttcaaaaactcaatagattttgatttggggtaaaatctcacttttaacaaaaacaaagatcactaaagatcctgtttagacaaaaaagagttgttttcttttgaaaataagaaattttactccaaaagctttggaaaacatttcaaacacatgttgaaatacttttgaaaagattttcacaaattgtggccttttacatacgatttttgacttttgactaaatatgctcttttgaaaacaatgaatgcaacttttgagatttttcaagttttgagagcaagagatacatgaatgtggtttgcacaatttcactctaaagtatctctcacttgaaatcaaagagttgaacatttaggttaactcataagattgagcaaaaagatacataaaagctcactattcaaaaaccttcatccaaaattcaagaaatagcaaatgagaagattttggattgcaatacatatgtataagcttgacgtacctccatgaaccaatatatatcaagatatatgattctagtggcaaaactcacttgatgatacaataggaccaaatagcattttaaagactatcatagcatcaatttgagccaaacacatttagaggatgcgaatgatgagaggttatagcacttcccctaaatgtgataaccaattactcaaattcaacttaagcatcaaccaagaaatgtttaagaaaagcattatgcacaagcataacctacacaaggttaggacataagtatttaaatgtaaatacttgttaccgagatgacattggttctttatatagaacaactattctcgtatttgagtccaattttgcgtattgtgtgaacttaattttccacaaatgagtcaaacctccaatgcatctccaagtacctatttctcactttagcacattttggtccccaacaacattgggtccataaaggttagtcacaagagacttagacaccgaaatggcctttgtgctagtgtgtggcgaacaaatcaccctagtagcacaaatatcatttttggcattcctaagcaaattatgatcaaatgagagacttggcttaggaatgttacccatgggacaatttttaccaatatgtccctttgcccggcaattttatcaaagtcgacttttgcttctatattgcttttcggtttgtttgttgccggtttgcctctcacttgatgttttgcattgttcatccaatgtgcaaggagaccttgaggcaaagtgtcccgcttcagtgcacttgaagcacttgatgtgaggaatgtccttcttcttgctcaacttatttcctttcttccaagggcaatctctaacatgatgtcccactttcttgcacttgaagcaagtaatggaactcttgatcatcttttgatttcgttccctggtatgatcattgatggacttgatatccctttgatggatcttggtgcacgctacggttgatccctttctcaagcttattcaccaggccctcacggttttcttgagaaggtttgagcaatacacacaagtccatgatccatttgcttctcccttttgcctacacaatccaagtcacatatagtgctcagggacatgtttgcttgggggaaacaagggttagcacaagtgagattaacttgaacatgaggctcataggattttaccgttgcaattatcacctcatgagatacctctagcatagcatgagaatccacaagattcacatgagaacacaaaagttcatcatgtctttcttgtaaatccacatacttgttagtgatctcatcaagttgaaatttgagctcttgattttgcttcttcaaagatgctacacaagcaatagaattagtggcacaagcaaattcattttccaatttttcatacctcatagtcaatgaagaatgaaaatccttaagtttcttgtgttcttcggttagactcatgatttcttcattcttcttgatagtgcatgcttgttgcttttgaatggcttccatgaacttgatcaccattgttacatccttcttgctcaagtgatcaaactcggagtcaccatctacacccataaagcaagcataatcttcggaaatagaagatgagcatcttggtgaggtggattcttcacttgtccattagcgctcatttacttcttcctttaaaaggttagttccacatgtactataggaggtagagcatttatccatatcatcctcacacatatacttggggctaggtgagatgcatgagtcaacaacacaatgcaatatgacaatttcattatcggtgttgttggaatccaatgggagaattggatgatcgtcaaccttactcaccaattcattaccttcaatgtagtcatgtgttgataaggtagacgtgggatgattatcacgatcatcgaaggtagttacttgaggttcttcgcaatttggcgatgaagttgaacacttctcaaatggttcttccaaaaagagtacatcatcacatttggacttgccgtatctctccttgagtgtagtccaaatgagatgagcatcttcaagcggcatgatggttttaaatacatcttcactcaaaacactaaataaaacattagtaacttgagcattgagatgtatgcatttctcttcctcttcaaatgatagcaatttatcattaggaggagaaatgctcacatctacaactcgctctatttgaggacccatggtcctaaatatgtcaagtatgcgagtactccaagaatcataatttgagccatctaaaaggagtaaaggaaccatatccaccaaaccactagtcgatatctttactctctaagcggtaaagccctaaatagagagacttggctctgataccaattgaaaggaccttgatgtcgcctaaagggggggtgaataggcggttttaaaaataaatgcggaagctataacaaaacagggtcagattgtctaatatcaggtcggatagtcctatgtgatcggatagtctgaactgatattagactatctgacctgcacaacaacaatataaacaagagaacaacctaagagctctagattcaatccacaagtaaagaggtgagctcgaccaacaacaatattagcatagcacaaagtaatggaacaagaaggtaaagagagtgaggaattcaccgaggtttacgcgccgatgtatttcccggagttcaaatccttaaggggattctagtctccgttgaggggctcgcaaagagccgggtctttttcaaccctatcctcgtgaggttgcacaaatgcactcctccttccactaagggtatctctttccttgcggagacgagatccggccttcacaaacttctcttagccaaccacacgtagatcggtggcccaagaacgacacctagtcgtctaggagtcctcaacctccaagagtaataaacaccacacaactcttggacaaatcctagtgctcaagattaaaacaaacacacactaggctcccaaactccaaatccatacacaaagatccaagtcacaaagaacaagggggatttgagatagagagggagagagctcaaaaatccaaagcacttagcacaaagctcaacccaaagcaagattggaatgaaatcagtttgggcaaccctagaaaagggttggtggggggtttatgtagatccccccaaaatgtgaccgttggaggggaatctttcagcccacgtcggatagtctgatacaagatcggataatccgatattttaaacctccaaggcaacgagaaacagagaacgaagttccatgaaatttcggactttccgaggcatcggactatctgatgttaaatcggagtatctgatattttagaagcaaaaacttcgtcctcaaacagagactcaagttctatgaaatttcggagtctttgtatcatcggactatctgatccaacatcggatactccgacacttagaaaaactcactcgaaaggatttttcaaacaaagacagagagtgaagttctgtgaaaaatcggatagtccgatacatcggatagtctgatttcaaatcggatagtctgatgttgctcaagtaaaaatgcaataactttttactccgaactctgatttcgaagatcttggactctatggaaagctagtttcgtgagctatcaaacccaacataaaacatggtcaaaacattcaatagatgttgaaacacttgcaaagaaacccggtgtaagtgttgtgacaagtgaaacaactcgggattaaaattttggcataggtttttcaactcacacaaagatgaagcattttgagcactagtattcaaccaattatatgcatgtggtatccctcttaatagtacggcatcctaaactcaaatttaaaaagcaaagttataccaataggagtacgttcacaccatattgtttcttcacttggagggttaccaacgtcaaggtcatttgatcatcgggaagatctcatcttcttgatctttgacattttgtcttccatttctcaaatgattaatgcggataatccatggcttcaaatggcctcgcacggttcatcacggcacagtcttcattcgcccttcaccaccggtttcggttttcgtcagcgccaagccccttgcttgcccttcaccaccgtatggtccatcgcaactaaactaagcgttgcttgcgcttcaccgtcttgccataggtagtcacttcatacccgcatcttcaatatcttctctttaattatcatccatcaataagaccatttcctagcttcttcatcggactaatcacttgcttctacactcaacaagtgcattagtcccttaatcgtttgtcatcaataaaccaaaacccacttcgggcatagatgctctttcaaattgtcaaggatataaaaaacagagagaaaagaatggcgcacgctgtacatgggcagggagggagggaggtttgggatgtttttctaaatgattaatctaacagactaaaataatgtgtcagatgtttatgtcgaaaccgatggtcagatgttttattttcttgtcagaattttattaggattttctttgatttaagagaacaacataatatcttaagagcatttataagatgtgtaatcatcttttaacaccgtatgccgcaaaggagggagggaagaaggtttagggtgttctttttttttaaaaaaaaagatctaatgacctaatataatgtgtcaattaatccattgaaaaaatgtgtccatcgatttatgtcatatctaatggttgggttttttttttccaaaacttctaagatttttctctaatttaagaacgccatatagcagcttagaggcatttataatatatttaatggattttaacaccgcacggggatggggagggaaggagggagataggtttgggtttttttcttattaaaaaactaacaaatcgatagccaaatgttttgttctgtttttaagattttctagcattttatttaatttaatagcaccacgtagtagtttagaggcatttgtagaatatttagagtcacagagcgagagttgctagacctaataggtggaggtatctttgtgatttttttgatgtaaaaataattttgattatgatttctcatgaacatagctcgttggtacgtatgtgacgggaggttcggaatgtgtgcttttttaaaaaaaaaatctaaccttctaatataaaaataatggatcactgatttaaataaaaatcgatggttggattagagtgcacttgacgacctaggagcgtttgtaaagtaccatttggtgaattaaaagtatttataagatgtttaatgaacttttattatataattgtctttttttgaaatttaagattttatttaatttaagtatgtgatatagtagcttagaggtgtttacaaaatgtttaatggattttaacactgcacaggggtggggagggagggagagaggtttgggattttttttattaaaaaatctaacaacctagatccatcaatttaagtagaaatcgatggtccgttgctttgtgttttttaagattttctaatactttctttaatataatagtaccacttagcgatttagaaacagggagagctgctagttctagtagttggtctatttgtgttttttacctgtaaaagtatttttgtttagttctagtagttggtctatttatgtttttttacctgtaaaagtatttttgtttttattttctcattaaatagaaaataacacatgaatgaaaatatggaaagacaaaagggaagtacgtacagtacatacgcacgtacgttcgacattacgaacgttggttccgtatatgatggttctggattttcttttttctttataaaatagatctaactaaatccaaccatccaaaataatgggtccaccaatataagtaaaaatagatggtcagatttttcttatttattatggtgccacttggcgatttgagagtgtttatagggtgtcacttgacggtttgggagcgtttataagaagtttaatggatttttagtatataatagatagatttagtaaacacattattttgtggatttaatcaagatttgattgagaatcggtgccttctaaaaaaagtttagattgatacaaggaagtcatatgccttgaatagtacttctataaacattaattttggataaagtttagaccatgtattttgggttcgattacagtttgcccataatttggaattggaacctcatggttgcactttggaccagggtacctatcatctcccatcatgcttttgctctttctctaacttgatgaaacagacaatcactccaccatacacctagtttggagaataatattatgagcgttacttatagaaaaatgttgcattttatagtgtaagggcattgacaatacgatgacatggtgagtggtgtagtgcttccccgtcagttctgaactaccacatcaattaggagagcagcctgtgcatgtaaatatatatgctaatgaaagaacagccttgtcttacaaattagcttgccgaaggaggtgtcttggggtctgtttgagggagcttccagattctcagaagttggctaccaatcagctgcttataattttaagctccccaaacagacccttgtacaagctcataacaattgctttttttgacccattaaagccaccatgtaatgaaatatattgtactcaacgatgaccttaccctccgtggcatattcgtctctgagactacacaatgagacaacttcgcgttgtacatgtcctaagaaagcccaaaataacgtgttgtcttgaaatatagagataggcatgcatctctcgagctaatattcccatcgaaaaagaatgaatcagccgagttaaaaacatataacattttcttttactagtacaatacaacattaccagcatttttcttttctcacggatccatccatgtttctatctaactactgtagtataaaacttctgtacacatgcaagaatcttttacaagtttctgtgatccaaccaaaattcagagacttctgttctgaacaaagtagagcatcaccatcaatccatcacatggcccctatcctatcctgtccactgcccaccaattagcgaggtgcatctcagtttcggccatcgaaaaagcagaggcctctcttctttctaatcttcttcttcctctttccagacttcaggatcagaatcagatgctgcagagcatagactgtacactgtagttccatcgatctcccccaactgtatttgtcagccaatgctgattgcggctgttttcaacaagtcttctctacaatactgctaatgtgggtcgctaatataagaacccattagacatgaaacccatatgtcaggcactcaaaatcagagagatctgtttccgcctcgatgtcgccggaaatggcaacagatcatcatcgtcaacaaccaaccaaccaaccaccagacgagtagaaagcttctcctacctaacattgtagttggcgccatcgccatgaaaggtggtaccacacacgatcacgtcagcgtctcgagctattagcaatcgcagtcacactcacatggctggtcgtcgtcgtcgtcgtcgtcttcaacctctggacatagctattagctagctagcattattgcctccggcgtttggaggtggtggccgggaagcagctgtcgggggagcagatgtcggggacgaaggcggtggtgtcgggtccgccgccgccgccgccgtgagtggcggctggatggcgttgccagtggaggccggaggccgtcggcggcgaggggagctccggcaccgaccactggatctctggtacctgcccgaagagctcgtcggcgttccggtcatcttccgatgacgaccggtagtacggcgagccgtccgtgctccctcccagcttcccgctgtcagcctggtccatccatcaatgacacgacaaaattttatttcaataggattttaccaagatcaggatatatcactagtttccgtatcttatagtataatattagacgatgtattcataaaggttgaggtgtaattgtgatgttacgtgtacaatggtgtatgcatcttctgagtttaaatagtatatattgcgagaatttcaaaaagaaaattgtatccggccaaaatttggaaatagaaattgtatctagtaattctttattttttttagaaaagaagttgtatatattg

SEQ ID NO: 58585 - DNA, 3088 bp, Oryza sativa
tgaaaagttcagaggacgagaggaggggctgaagagatcttgacattcacatcccccagcgcatgtgtcaagacctgaacttaggtactttacatgtagtactaccgtacttgttgcgttacatcacggtgcattgactatatatttgacatgcgcaactcaacatttctcgactttataagtgcagggaaggtgctgatccaggatttcaaggtttctaggcccttgtttaatccaaactttttcttcaaactttcaacttttccatcacatcaaaacttttctacacacataaacttttaacttttccatcacaacgttccaatttcaatcaaactttcaattttggcgtgaactaaacacaccaaaattgagttcaacaatatatctttttaaccgattcaacaatttagtattactttctgtctccctccatttcaaaatgaacacaactaaattccttttagtgtttcctaatacaaggcgtgcatacaagcatgcaataaatagcacattttactcctctaaatttttttaatcctctattcacaagatctctaatctaattggttgcttgcattgtatttattagggtaatataaacattattattattattattattattattattattattattattattattattattattattattattattattcctccctccatccacaagtttctatttgtagtctttatgcattcaatacttaaataaagagataaattaaatgtttgattagaacctaacgagtcatctaaatactcattagttatatgcatgtattcactacttgattttgtaacattcaagatgatttaatttctcttttatcttggtgacaaaaataataggtgtaaattttgtgaatggagggagtattatttattggtctttgcattagtgatagttgcgtcttatattttgaaatggatggagtactattgctaaatgggaatagaaatcaaggtccataattgcataaactctaatgcaagttgttccaaacatagacaacgtcacacaatagcttagacaaattttaaaatcattaataatattactgctcgattattaattgtgctttggaagccaggtcacatcagcaccctcaacatgtgaaaaaactcagcgctagcagtcctatcttttttttttacttcttgttttagacatcaacataatcttcaattacatctctcatcattgtgttctctaattgtatgtttcaaaaaaaatatattacaaaataaccatatgaagtgtcttcatgacaaatctattaatgtcctttttcacatattaaattctaatattttcaatctactaatgatttaagaaatcgaggtgctatggaacttgatattactgaatttaatcgagtggtacttcacttcattgaactttagcaaagccggagcgacatagttttgccacgcccaatgtaatattacaccgctttactatatttacgagtacaaggaacatacatgtaattaaacaggatataattgtcaataaaactcaatctcagctcaactacaattgtgaaaaaaaaggaatgcgctggtgttcagcttgtggacactgtagccccccggcacagctccggcagcagcttcatacaaagtcttgcctgtctgacacgagggaacggaattgtgctcccacgcaactgcatgttttgctctccttagcaagcaaacaacaactagtagtagtaacagctaattaaaggccataatcaacacacatgacctagttgacgaacaaagagaatctagtcatgcaagtagtagattaaagccgactactgtcactttactttctagctaaggatttttgcagcagtcctattgtttctaattaaggagacaccgagtcctaaaagcaatggctcacatcctttgcccagagaggaataaaattccagaagaatatcaccaccattgatttataatatgatgaagggaatgagtatgatgattaataaggtttgctcattagcgagaccagcacgactactgatttggctcgcttgcaacagcaacagaaacaaaggaagcaaaagaaggcccaactttggcccacatgctgcagggaacaagtctatcttaccttcctcatctcttgcctatgattgaatcgtctctctcaatcacaaaaccgggtataacgcgtcctccatcttctaaaccaccaccacctcctcgagcacctgcctccccgagtgccgccgcctcctctatccaattctaagaacaagtgaaagtgagctctcttggtgagagataggggaggggaataagaaagggggaggtggaaggagaggggattggctgctcctctatggcctagctcagtcaccgccgccactacctcgcttgtcgctcagatttaatttggggcagcgtggcacgattggcgacgggcaactgggcgtggagctcggtggcagtgcaaccttgttgagcccctatctccaaggacgtgagcggagccaaagcgtccatggtccttgcaccagtagtggagtctcgagcatccaccattacatgatagatttgtccctatttatatgtttttctttgtgaaaacatttttcagaaagatgaatagtcaaagaaataaaatatcaattacatcatacattaaaaaacaaaggcaatatgctgtattcttatggccaaaatgttgtattgatgggatcaaagtgtaatggggcgctcgaagtgcttgttaagcttaagcactattttttcgcttagataagcactagaccatcaaggagcatttacatgtaagtctgtgtttacaaattaaatttttgcatctcggtgttgcaatttctcacattcactgatggttagccttttcgtccaatttctagagacgcatcgaaaaccagataagcatgctctatgcactctagtgtaagacattctagcatttttcacattcatattggtaacatcaatatgaatgtgaaaaatgctaaaatgacttacattgtgaaacggaggaagtacttagaaacacaagaacaaggacatcaagatgtaagaaatggag

SEQ ID NO: 58586 - DNA, 5790 bp, Oryza sativa
  unsure (1)..(5790): unsure at all n locations
cttattagccattacttcagtagaatcactacagatattaaacctacaactaataatgcactagtagcagtcgaaaatcaattagacggtcaacaggagcgcccatctggaagatcactttgaagtacaatagggacaaggtaaattctgatatgccaacttcagattcatgactagtgactacacaacttgttctctttctccctacaaatgatatgcatgtctgcaaggagactgcatctggctttttcagccagtggaacacataagctttgaaagatccagatgaaactgaatgagtgaagtgcatcactggcatttttccacttagggatgtttgtatccaagcaacagtaaaagccaatatgctatagccgaataagggattattcatggtttaggataagtatatttgagattagctcaacaagccagaatggcaaattacctgaacaaattgggagggaagcaacagacaatccagcaagtgctaaagcagcgacgccaccagccaagccatcaagatgatcaaccaatgtaactccagtgcccatggaaagagaacatattgcagccaaaacgagatagatttttcctatgaatgcaaggccaagaggaggaggaagaggaacaaggaatttccttcatgaacaaattcgaattagtaaagctgacaagtgaaaaaagtcaaaaacatcctaaagtattagtcaaaatggcaaagctatagaactatgacaacggtagtgacatgtatctttttgttacagaatgctggttatggagtttaagaccacatcaatgttggttatggaatttaaggccacatcaatgctggttatggaatttaaggccacatgactagcttggtgcactaaataggaaatgaaaatcagaagtggttagcaaagcacccttgcctctaaattaacatgtgaacacgatcactagtgactagctactagcatgagttgaaaatagatgttaaatcagtacatttggaagtaatgtaaggcacgaagtatctgtgcagtgttcctgtgagtacagggaggcagaaataatgttgtgcaccttattaactgaattgtacattgtactgcatcatgataatactttgatataggccattaagaaaggttactcctcatcaaaaaaaaaaaggcaatttaccacattgcctaaccgataaagcattaattcaaactgcagttagtttttcagtatatataagttgaagtaatgcttacgtgttatatggtgttgaaatatttgtagaacttaaccagatagataagtaaatcccagcaacaatctgcaaaagaactgtaagttgctttcaacataataagggaagagcatctcccgtcaaaaaaataagggaagagcatcctatcatctctcttgaaaaagcaccattcacctgaacaaataatctcatccaatgcggtattttacgattgcagtccatgacaagatttgaaatatcatcaagaaatccaaccattgcaaatatgagggttataatagctgctccattcactccagttgaggaaccaacctgtcttcttgcaacaaaaatgccaataggtacaaagaacaatcctcccattgctggtgttggctttctatagaatggagacataagcttccctctcctccggaaatgatgaatcttcatgttatcagcaactggtgcaaaaagaaatccagctaatgctgatagaactgatgatattaaaaaaggacgtgtcaagtaaaaagagtccagaggtagtctaacaatccgccaagaacaccagtcgacaaacaaaagtaatattgctaagaaagcaatcagtccaacattattcatcagcccttgttgagttctgggaattgatgtaaagagcttcagtcagaacctagcaaaaacacttgtaaaaagcgtgtgtttcttactactagtttgataacttttaagtgccatttaccaggaataacataaacagataatcctggaagatcataatgcatgctacaaatctacacgctgaatctctagtttttaagtattatcagaagatattattatcttgcctgctgtccctatgccctttctcaatcgtggcaaacctatgggcagcaactgtcatcgcaccctctacaccctcaaagcggctcttgctctttagaggtaactcaacatcactcgttggatttaacacgacctcctcatcgctccagtcgctctcacttgaatatacaacaacctctaaagggtcatccccatcagcgtgcaccagcgagaaatcacccagatcctacataaaaaccaacgctaatagtaaattaagctactccataagaatcaatgtatcaagaaactccataagaatcaatgttatctaaagaaaaataaaacagtacctcatcaaatgcagaggcaactggaaggacatcgcgcctgcttgtgggtctcgtggagatatttctgaattggaagtcctgaaaggataattaaatgacaatgcgattgccttagcttaaccatttcacacgcattggtttgtcaaacgaatcattctcgcgcaaactcaattagttatatacaaacatccatcataaagtcaccactcagaaatccaaggtgatactgtggatgatttctccaacaggcaacatcctaaccgtctcgacgagatcaaatagcatcgaaacgaatcacacaagcagcatcccaactcgccaacacatggataatcagacggggaaaaactagaagagaacactcatttcgtgccaatagtacacgtgctaaagcctcgatgaacatcagcgaggcggctattcccccgatgcggaaccctagcaggaggagaaggaacgaaggcgcccgcgagatctgggaactcacccggagagcggaggatcggcaggcgacggaagagggaagcacccgcggctgcggctgcggcggcggccggagagatcgccgcgaccgcaagcgcgggcgatggggagcggcacgcgcggccgcggcggcggaggaggagggagcggacggaggcgacgccatgggcgaggcggctcgtcggagaggagggggacaggagcgcacgacacggtcggagatcgcggcggctttttctagaccgcgacggcgacggcgacggcgttgcgccgatgcgttggtggggtgggtcggtgggtgtgggtggggtgctcgtggactcggtgcacgtagacaagcgagctagaccgactccggtgctcatggtgggtccatgactccggtgctcatggtgggtccacgggttgtgatttgtgacaggtattagacaggtggttactggttgacggtttattccttcacgtgtccaagtggacattttttttctcctgtgggcttggaatgggccaaaagagcagcatgttgggttccacggccagaacagtctaagcggctcgaacattgtctttgcgttgtttctgtcaataaaattttcagcttaattaacacaaggttgccaagttcgctttatggattagtatgataatataaaggattttagatggatgtgaccagattcattgtaatagaatgtattatatccacccaaaatcttttatattatgggacggagagagtatactataatttctacgagctgacacgtcatgactggaatgaatttctcctttactgatgtctggtgacgaaatccgtattgtgagtgggaagttactgcatctgtctaaaatattgtaatctagtagtagaatagaatttaacttattctaacaacgaatctagttagatggatcaaatctcatcccaaggttgtacttagtaacattttgaaatgactagtatctatgcaaatttaaaaaagaagccaatgttgatggacatggccctgtttaaatcccatcttaaaactttacaccctatcacatcaagcatttgaacactattaaatataggctaaaaaataactaattatacagattgcgactaacttgcgagacaaatcttttaatcctagttgctccatgatttgttattgtggtgctacattaaacatttgctgatgatagattaattaggcttaataaatttgtcttgtggtttactaacgtattttgcaattagattttttgttagtgcccgaacaccccatgcgataccctatataatatcctatgcgatacgccaaaactttacacccctacatttaaacaccccctaagtaagtgagaaagcacaaatcaatcacctctcctctcccaaccctctttctatgagctccatctttgttgaccaatgtggcaccggccatgcagcagtagcactatgtttaaatccctatttgcttcatgcacaacatgttgnnnnnnnnnnnnnnnnnnnnnnnnnnnaatcctgtcattgttaattggagtttgagagtgattgtttagtcttaattagattatctaatgttattagatcttgttgcaatgtacggaattttttttagtcatgaatatttcaatttggccagaattcagaatttagacatgactggtcaacagcatggatgaaacaatttcgcattagtgacctaatcgatcggagcacagaatcaagcttatcccttcctgaaagtagaactcaattcatttccagatgcttttctagaactcgggatcacaagctagccgagctgaaggcgacacacgaaacaaagtgatcaagtagatgcatgtgaagaaattacaagaaagcattggacacgaggtcgaccagatctctgagttaggcttcctgcaagccataagctcccaggaagtccgtgataaaggcagggaaaactgaagccaaagcaatctgtgtacatttcttcacgtcctcctgacaacaagatgtttctttttcactaattgtcacatccagttccatgatctctctggaccctgcaaagtcagaaacaagatgacacgtgaaatgatccaaattagccgtgagttcttcgtttgcagccaaaattaacaaacaaacctaagagcctggtgaatgtttagatagcttggggatcaatagatagttaatactgatgacaagctttcgctattctcaaaaaattaaccaaaaaaaatctcttttactgtcttgtacatgtttagatggctcgaggatcatacataatgatactgatggcaagctttcgctgttctcgaaaatggccagagagacatttaatagacttatcaactgatcagaagatgtacagtacagcttcactggcaaaatgcagtcattgaactaagagttgcaacttgcaatgacatttaaactcttcgtgctgtaatgtcgacatcttctcaaaatagtacaaaattataaaggaaaactggttaaataagcacttctgcaaacgagaatcaatgagataattcaatacccttggccatcccatatttacgaaaggtccaactggaatgaaccttcagatgccaggaggttttccagttaaattcacacgtaattttgcacctcaaaaagcatgctctatgcgactatgcagacagcaaagattatgaattatggatattaggagagaactgggatagttcggggtatacaaggagtccctggaaacaacatgcacgaactaatgaaaacagagtgatatttctgctcttcttgctataatatagaatcagctgaagctgggtccgtttcaggggggaaaaacagttcattttctataaaaaaaagttcaaaattttcttaatctccgattgctacaatgtagaactctgcaa

SEQ ID NO: 58587 - DNA, 965 bp, Oryza sativa
ttaaaggtaatgtggtgtatgagttgccatctaattaattagttgatgatgtgaataatattagatgcgacaatcacctcaatcacaaaactcaaaaggtaactaataaacctttttcccatctttttaatactcccccatcccattttaagtgtagtcatggtttttcgcgtctaactttgattgtccgtcttatttgaaaaaattttgaacaaatttaaaaacataagttacgagtaaagtactatttatgttttatcatctcataacaacaaaaatagtaaggggctgttcagattgatgccatttttaaccataccatttttttggcaaatttgtcaaaaaaaaatatatgcgtttagtttgttgccaaatttgatgaatacataagaaatcttgctaaaattttagcaatattgtcatcttgccaaaattttaacattggtaaggtttattttgtctacaatctgaacaggcccggcctaattataaaaaaatttcaaataagacggaagatcaaaattaggcacggaaatttatgactacacttaaaatgggatggaggaaatactatagattaaaactataattttaaataaatagtgggagtatttactgcagacactagtacactacccgttgagactgcactgttagatccacttactgttatatctgggacatgcatgcatgctgccaatgaagcagctggccaaacgcagtcgatcgcctcgagacagccatgtacagcactacgcgtgtgagactgtggaagggagtacattataggcctggtttatttcccaaattttttttcaaaaaccatcacatcaaagctttaaacacatactgatagcattaaatatagataaaaacaaaaactaattattgcacaattttcatggaaatcgcgagacgaatcttttgagcctaattatttcatgattagccataaggctcaaaaa

SEQ ID NO: 58588 - DNA, 4945 bp, Oryza sativa
ggagctgcatcaaacatgccctaagaaacttaacgccagctcggagcttcgcttcaaagacaagaccgagcggttcaagttccctgcatgagtgtataggcgcaaaggcaaaaacaccacccatcttgtagagaatgcaacacccagtgtgtgtgtgtgggggggggggtggggggggggcagtaaaggtggcgaccttgtacactctcgccatagtcatggtttagttgacgaacatgagacctgataggtcccccttccacacgttaacgttggtagggactggctctcacgtggtgctctatagtctcctctcactccaaatatagctccatcctcgcatcatgagcactgccctcgttgctccattcaccatcagtgctgatccaacggcggatgtagtattcactcaacaattataaatcctatttttggttcttagtaagttagggtccgtttggttccttggtaaaggctagcctagccttacctagcaaggctagctgtttggaaccggttaaaaaagctagcttttaggagcaatctagccttgcggggcgagaaaaatctcgctggctcgggagagccgatttggctagccttcgacggcaaaactctgctcgcacactaggaagcaaaccaaccaaaaacacagtatgtacagcaaggttagcaagctggcaatgtgatggtttagcttagcggagctaggctagctgggcgaagcaaccaaacagacccttaaagtttggagatattttactttttgcgattacacgacagtcggcagacgcatacgcacacacaccattacatgcaatgccaaacacacatccccatgaatatgtcacctaacatatgctttaagaaatggaaaccagtggcatatccctaatgtcactaaatccctgttgaaagcgtaattgtatgtgcgtaatattcatgcgcactaggatttaaaccctattgggtaaagccatgcaccccacaatttcaccaccacaccactggtacttgaaggttattttatcttgattctctatgcgtttttctcaactcaattttttaatttcttttgttgagttagatcaatattttgaatcttaatttgttttaagtgcaaccattatatggtaaaagttagaaaataagagagtgtacacaaactatgaatgatatgattgtgattttttttacattgatgttgaattttaattgattaagatataactaattttgaatcttacagtaatttagagattattaatcttagagtaatttagaaattagtaatgctgatttttattttgagtaatttagggattattaagcttggagtaatttagacattattaatgttgaactttgattaatttagatattattatttttgaatatttgagtaatgtagagaatgttaatcttggagaaacttagaaattatcaatcttggagtgatttagagtttattaatcatgaatttagaaatttatttttttagatgtgtaccagggctctattaattttagatttatttttcgtattaagtggtatatgtatgtcaatgtttaatttgaattttttttagatcgatggataaagatggatctacgaaatgccgagcggttccttacagtcagctagcggagttaccataaccaacttgtgaccgcggcgacgagtttctgatcattggatgcactggaatatctaccttggtcatgcattgattgtgggagcaagagacagttttatgagaaacaagtccactcatatctcataacaacggttttatgtctaattatacatatcaagataatcatagggttttatatatacatagtgaagacgagaatatggttaaccctcgcaccatttccacaaaattttaactcaacgtatctattcatcatttttaataatacttgatttaaaaaagtacagatatgattatgaaggcaattctagagcttaagcccaagctgccctatctgtcttgcctctgctccagttgtgaaatatatagatgaatatgtgtttgtatttttttaagaaaatcaatatcctattagttaagtcttactcgagctttaggcttacaagatttctagcttcactataatagcaaagcacgaagtatcataaagtaataaagaattaaaacaccagcttgatcacacacacccagaccattcacagtgtgacacggagttttgctgaacctcacatgtctcctaggtcaagaacgttgttagccacatgcttcacaatgcaaagttgctagtagtaggtcccaccactaccatctttctcactttttccctttatcctctcccctccctctctctctctcagcaccgagccgccggacggagacggcgaggtggacgggcaacttcgcagctctccgcccaaccgccgtccacgctcctcttccccaccatcgttggcaccgctctccctcccccctctcagccgcccccttttccctcaacacttgcgcaacctttcgctccatcgccggccacactcccctttcccaccatcgccaatgctgctttccctccctatccgcgcccccctcccctttcctcgtcggggtggcggcggaggaggatccggccactcctcatcccctccttgccagatccggcgggatctggccttgggaggcggtggcaactcaacgacgacggcgggtgctcgacgatgccaacggcaggaaccgcaacggcggtagctcgatgatggcggtggggtaggttcaacgatggcagtggcggctcgacaacagcggcaacagctcaacgacggcggcggaggaggaagtttaggagggcaccagctccgactggggcatgagcatgaccacccaacgcggtttcttttgtcaccgagtgccttccacctgacaatccctgacgaggtttgtgcgttcaatcgacagcttgggttcttcttcactaggtcacgactcacgccgacgtggcatggaatcttcgagctggcgagacgagacgaggccgaatgtcatctcaccgcactgcgaatggcctcgtaataatgctcttcgtttcatcggtcgcatttcgcctgcgcaacacacgtacacaaaaaaggaagctggatgtgatcacacgcatatattcacgtgaagaaaggtacattggaacccattattgagggggggccatgctacctgccttatctgacatgtgatctgcatatatgctgccccagaaagagaccatccatggatgctacatgctccatttgccggagaggccggtatgggtcgatcggaaacgtcgacggcggtgaccgggtccttttctcatcctcggagatcacagatggcgatcgatcaggtccctccatacctgtaccaatgacctaacgcctgttttagttctcaattttttttttcaaaaacatcacatcgaatctcatgtactagatatatgtttaaaaataactaattgcatagttagggggaaatcacaagatgaatcttttgagcctaattagtccatgattagccataagtgctcagtaacctacatgtgctaatgacggattaattaggcttaaaagattcgtcttgcggttttcaggcgagttatgaaattagttttttcattcgtgtccgaaaaccccttctgacatccggtaaaacattcgatctgacatcgaaacattttcttttcgcgaactaaaccagccctacgatcggtcaggctctccctgaaaccggaaaattttgactggaattaattttgtaggattattaattaggcccatttagttgagcttgccttttcagctgccacttatactgcagcttggatcctctgcagtagtagagagcgattaagtatcctataatataacataaggttaattatgcaattacatagctagtattggtttgggattctttgcattgaagaagaagaatgcagaggcgctatagtccttgcgttagctcatgttctgatgcgttggatcttcatcgaacggtacaaaatcagcatgctacagcaaaaatgttcgacggtaaaaccgattacggttagaacacttttgcttcggtgtcgttcagctgtcctaatacatatcactgtagcgcatcactcagatcaccgtgtaaataaagttctctgtagtacatattttagatcatatatatataaggacatcctgaataaaagctacagtactttacgcaatggaaattccagtgctctatataaatattaggatactttgatagaatactatcaaaatttggggcgtggaagaccccaacatcagggcaaaaattgcagaagaagacttgtatgcatgtgctaccataatttggcatcacctcaagacataacaaacaaccttgcatgctgagtacgtagctagacgacaaagataagtttatgctgcagcacgaagacaatcaataaaaagcaaagagtggaatcgaagaaatagcaatattacttaagcctagacaaacatgacttgattgtacaaactactatgcaccgcatatcagacctgcaccatgcagtcttgcttgaatgtggttgcctgttaatctatagactaaataaagcagcaagaagggtcctcataccgcatatttcggtagttctcattgttagcctgcatgaagagcacatggttctcttgccgctttatttagtttgtagatggacatgcaacacatacaagcaagactgcacgacgcagatctgctatgcggtgcaaatagtttgtacaatcaagtcttgtttctccaagcttgagtaatattgtcatttcttttattccactttttgtctttttattgattgtattcatgctgcagcataaacttatctttatcttttagttacatgcccatgcatggttgtttgtcctgtcttgaagtgatgccaaattatggtag

SEQ ID NO: 58589 - DNA, 11734 bp, Oryza sativa
acaatgccttatcaagcttgcaaagatagtgaggcaccttagattcctcatatccaggaggttgtcgcatatacacatcctcctcaagatatccatgtaaaaaggcattctggacatccaactgttgcaggctccagccctgtgaaacagctaaagacaaaacaagtctaatagttgttgccttaactacaggactgaaggtatcctcatagtcaatcccatatctctgtttaaaccccttagctaccaacctagccttatatctatctattataccatctgccttcctttttatcttataaacccacttacagtcaataacatttgttcccttctgtggtggaactagatgccaagttttattatgaacaagagcagcaaattctttatccatagctatcttccaatttttatcatgcagtgcttcttgtaaactagatggttcttcagtatcagttaagcaagcatatcttaccgtcccatctgtatatttcttgggtttgtgaattccatggtgcgctcgtgtgattggacctggaattggctgtgcttctggcgttgcctcggactcgactgcagagatggttggagtaggcgatccggtagctggcgtcggtgtcgggcccgcatcttgcagagacatggttggcccgaacgcatctgagtcgacgtggctcggcgtggttggtggagatgacgccgccgagccatgagccgccgcatccgcctcgggatccacctgacgcgacaccgagtcagctgaatcagcattaggatcgtcatcagcggtataatgttcgccggaactagccagatcgcagttctgcataaaatcatggttaattgatgtggattcgctatcattagctgcgctgttttctccgtttgctccagaattttgtcctgcactctcaccactggaatcagtaggattaggattattaattagaggttgatcatgtactactgcacccccgtgatcaagcataattgaaggaaggagattgggagtaagaagctggatttcagactgaagacgagcaccagcattggaatgcaactgagcaaaggggaaaacttgtacatcaaacacaacatcacgagagatatatacccgaccggcagcaatgtccaagcacttaaaccctttgtgcatcgtgctataccctaggaaagcacactgtttagatcggaaggcaagtttgcgtgtgttgtagggtctaagattcggccaacaggcacagccgaaggtacgaagcaggaagtagtcgggaggaagattgaataggcgctggagaggagtctcataagacagaactctggtaggggttcgatttatgaggtatgcagcggtggtaaacgcctcatcccagaatttgagtggcattgacgcatgagctagcaaggaaaggccaacttcgacgatatggtgatggttgcgctcaactgatccgttctgctggtaagcataggggcaggcgacatgatgttcaatgccaacattgttaaagaaactattgaggcgctgaaattcccctcccccaatctgtttgcatggttttaatcttcctatttaggagttgttcaacaaggttttggaaggcctaaaatttctcaaaaactttagatttgtgtttcagcaagtaaacccaagtgaacttgctaaagtcatcgataaaactaacataataacatttattgccaactgaactaggggcagggccccatacatctgagaaaataagctgcaaaggttctaaagaaatactaacagacttaggatagggtaattgatgacttttgctttgctggcaagcatcacaaatagactcacgactagaatccctagtgacatggagattatttgtgctaacaactcgatcgacaattgaaaaagaaggatgccctagacggctatgccaccgagacaaagacggcttgatggcgccatgggcctgcttatcagttggcaaggggtagaggccgctttcacacctgcctcgaagaagtggcctcctcgtgacctgatcctttaccaaaaagaaacaggggtgaagttcaacaaaggctctattatctctagcaaaacaatgggcagacacaagacttttataagcttcaaggacatgaagaatgttcttgagccagagatcacgagtgggagtgcaaatagcagtatgaccaacataatcaatgtccatacctgagccgctggcagcgtggacctggtcgttgccatggtacttgtcctttatcgccagcttctccatctcgctggtaatgtgatcagtggcggcactgtcaatataccagtttgtgtcgatgctataggagttgttggttgcagcagtgctcgcaaccttctcttctcctgtgaaagagggatcaaacctcttccaacacttggccaccacgtgaccaattttgccgcaaagctggcaagtgggcttgggtttgccgtcaccacggccgcgcctgaaaccgccgccgcgtccgccgttgttgccgccttgtcccctgccaccgcaccaccggcgggccctcctcgcgacacggtgttggcagaaggggaggagttgttctgaagcagatccaggcgtgtctcaaagccaacgagcaaagcatatagctcgctgactgagattgaatctgcacgcccagcaacggaggagacaaccgagttgtagtcgaagtcgaggccgacgaggatgtaggagacgagatcctcctcgtccagtggattcctgcagaagacatctcatctgctaaagctttcatcttacccacatattcagcgacagttttgttccctttcttggtggtggagagcgccatgcgggtgttgatgacgcgagctcgagactgcgacgcaaagaggctttcaatgcctcccagacttctgtggccttgccgagcgtggccacctgggtgaggacgtcgcgagagagcgacgacagcaagtaactcaggacttgttgttcctgcgcaacccattgcgcaagagcaggatttgccaccttctcagtggtcttcccatcgtccttggtgatgacgatggtggcttcaggcgccttgttgctcccgtcaaggaagcccgccatctgagcgccgcgcaacgtcgctaggacctgcgccttccagagcacgaagttgctcttcgtcagcttctcagagactgattgcccatggagagcaaatggaatggagctggacgaagatgccattgatttcggagagattggatgcgatggagggtggaggctctgataccatgtgcggtgaaacgatgcccttcctctaggctcgcttacgtgttatataggcacgggaaaaacccccggcgtggtgtttacatctcaacagaatacatccttatctcaagtgtttagttacaacaaactcctaagaagattcggttctatctatcctaatagaaccaatattatctaacatgccaaactactggggccggggttaccgtgccccagcggtaagcatggttaccgcatggtaaccgtggcaaaccgtaaaaagtttatcaaaattttaaattattttttaaatttatttaaatttaaggagctaggttaccgcggttttccttataccatactctctccgttaaaaaaaaactaaccgtggaggggtgctcctaggttggcttttttttggatggaggaagtactcccgcggtaagcgcggtaaccggtggtttgaggaaccctgatcatcataactagtcaaagaagcctattcgagcagaaatgatcgatatactccgacaatcctactcacactcgacactgtcactgtgcaagagacatggatttaacaccgggcaacgcttgagcttgagagacggctagtatgagctagctgagaagaccgatggtgtcatgtccgtcgtgcaacacgtaacagtgacgatagcaactggatgatcctctccatcgatcgctagtcacctatctatagctaggccagccatgggctagctgctgagaaacaaagtaaagtagggtcccgtgtctcccagtcgagttgatcgatcgatcggccattcctcgcaaatgtgtgtatacgatgccattcaagttcgcaaggcgcatcatgtctctgatccactgattatgcttacgcgatcgatcgctaattcgctagccaagccaccagggcgcgcacgcaccggccagccaccctcgcgggcgcggcatctccttggcgtcggcgtgcgtgcatgcaattacacgcaaggaagttaacgtacagaaaaaacacatcggtcgatcggtacgagccgggcgcatgtggtgaggccggcccggcgctcgtacgttcgctcgtcgggcgagactaccgtgagtgcgtgcgtgacagatcagcgcggccccgccctagctatagctagcccttttcacgcacggtacggctgagtcgacgttggatcgatcgatggtcccgggcgcgggccggcctaccggccggcacggcacggcagcggtgtccggtgtgtgggcgtgttagtacgtacggtactccgcctagctcgtgcatgcgcgcgcggcgctctctggttgctctgctttttgacgtacgggcgtgtgttttgcagtacacgagttgactacggcccgtgacgatgcgtcgatcgggtttggatgtccaagagaccattctgctcagtgcaaatgtcaggctcccaatgtgtcctctgccatcaatcaatcccaaatacaatcgatctttcgtgcccacctctcagcctctatttctagtaaaggtgagtttagctcacgctaaaattgaaagtatgattgaaattaaaacgatgtgacggaaaagttggaagtttatgtgtgtagaaaagttttgatgtgatgaaaagttgaaagtttgaagaaaaagtttggaactaaactcggcctaagatatcataacatccatcctaaccgcgaaaataaagagaagatgtgattatcatatagtgctcctttcgctgattggatttgacagcatcatgcttgttctacagcaaaggagggatttctatttgagcgagcaatgtgatgtttttttactttggaagaaggtcagccacacggaaaatcgttggtacagttgatctagaaatgtctgaatttggagggcgctaatgatgatgcacgaatgcacggtaatgttggagatttggatgcacaattctacagctaatcctgctgagttctcccttctagatttgtgcagatcaaacatattacagcccttgacctttccagtagaagcagcctttttagtccaggctgggctctggacggaccatagacaagtctaactttaatttcgggccaaaattgactaacgaagccccgctcaacaagcttaggtcttcgttgaaggaattagttttagatctttcatcttatcgtcaaatttaaatcttgttcttaaatcataatagcagatatagagtaccccggactattaaagtcagatcaatttacgtacataagttgttttgatggtggttttattccacgtggcattttagttatgaaaaataaattttaaagtggtggagcccatgtatcggtgacacatccctcctctcttctccctctctacttctctcactctccttgccatttcttgattccactatcgacaaccagccgagcggggtgagtgacgacaaagggtcctcgcgacatcggcgacggcccgaacggagctacccggcagcacgtggttagggtgggaaccattggggtacctgtggtcacgcatggtgaagaagtactagtctcgttagccgatcatcgtctgggcaatgatggggaaaggggccgggtagccagcggtgcatacgtagagatagggcaccaccaacttctcatccgtcgggtgggagtggaacctcggcaacagattcaacacctctcctagcgacagaacaatgtctcgacgatgagtatgggggttgggatgttggaggtgcacgtatagaggaagtgcgccgctagctcctcatctgttgagtggaagcggaacctcggcgacaggttcagctccgcccctgcgtcacgcccctgctgcgccacgctctcggctcccaacagaagtagccgaccagttgacaaatctaggcatcaagcagtggagaccaggcggagaggtcgggctaaggaggtagcagaggcagtccggctggatgaccacaggtggagctactccttgcaaggctccgcccgaatgtcgtagtgtttgactttgcaacaccattgggcattggttgccaacgttgccaggctgttcggtgtcaacgcggtgccatgttctctatctttgccactttcgaggacctcgcgtcagcgcctgtggatgggaaagctggagaggacggtgacttagggtgtgtttggttcacggtcaagttaggatgggatatggtgatccatattttgctggatatggtgatccaattttctgtttggtggagtggatatggcgatccagttttttgtttggttgtagggataaaggtgaatttggtgatccaattttctgtttggttggatggaggaggttggatttgtaggtgtggtcacctctcacttgagatagtgaatatacccccatcaaattaatgcataatgcattttataaattctctagcaattttacaccgctacctttccatattataaatacacatagaaaaaaaaagaaaaaagaaaaagaaaaaaagaaaaaagcattagatctggggctcctcctcctcactgccgccgccgccgcctcctcccgccggcggccgctgctcgcctcctcccgtcggccgtctcctcccgccggctgcaggcgccaccgcctcccgccgacgcggctctcagcgcccgcaccgtcgtcgttgccgttgtcgggtccgcatcgtcatcgtcaccggcaggcgtctccgagctcgcgcctcctcccgccggcggccgcctcctcccgctggccacctcctcccgccagccgccgcctcccgtcgacgcggctattgcctcccgcatcgtcgtcgtcgtcgggttcgcatcgtcgtcgtcgccagttcgcatcgtcgtctccgccaacgtctccgagctcgtcgctatcgtccctcttcccgttgccgcgccagcgccggccactgcgcccgtataacgcgccggcccactcgcccgggcgaccgcctccctccctcgctcgcccgggcgctcaggcggctggatccgggcaaatcggccggatccccccatccagcatctgggggaatattcctccccgagccgccccatcccacccctgcccagcaaccaaacacctacaaaaaaaataggcggccatgtcctatccacccatatccctccatccaaacacacccttagagaacctggcagcggttcttcctcctgtccgatggttctggcgagttcaaagtcaccttcacacccgaagtagggggcttgcttttgtcaatgttgtcgagctgttccctactctgtaggagcttctatggaagaacgacttgacgtctccatccatccgtgtggtttctcaccttatcgatgctcggtgcggccgagagatcgttgccgtcgacacctagtgtacattcagcagcgtgcatgactatggtgggatgcggtacaccgctgacagacctgctatcaccattggctagctctgtcccgaccaccgctagcatcgcgtggcccctccgccgttgcttgccccactacaggctgctgtcggagtgaaatcaagaaaaagcagatgaaggatacagagaaacaaagatgagggagaagagaggagagggacatgtcactgacatgtggggtccactacttcttaatttattttttctaactgaaatgccacataggtggccatttaggatgaaacaaccatcaaaaccactaatggacataaattgatatggttttaatagttcatggtactgcatatatggtattgcggtttaaggatacgatttaacatcaaaatgagagaactaaagtgaatttattacttagttaaatgggcagaaaacatggcatatctgtgtgtgggctaatattttatagtttaattatacgcggatggattgaaatgttattaagtcctttataatgtggtgaaaaagtgagtagcaatataaaacaaaaaaaatagtgagtagtctgtgcgacaaaatgtcaaagccaagtcggagagataccttcaaaatgtcaaaaccaagcccctgtgccacaacgccggagggatacaggttatattaccatgtgcgtgatgaatttgcagttaggtttgtctatcacgtgcataccgtggtggtgaaagtttgtcatggaatcacaatctatcgagtgaatgcatgctaccaaaaaagtaaatgggaaaataaaagaaaaagtaaagcaatatgccaccgctcaataatgagctttgttttgatttgtcatcgagagcatatgcacgctttttgggtttctccacgagactgggactccatcgtaaacaacatatttacaaacagaaaataatttataaataaaacttttataaacatattatttgtgttttaaaagcaaaggctaaaaaataactacgatgaaaaaatcttaaaaatcaactctaaatttaaactaaatttaaggtttaaaattcaaattttagcttataagtataaacataagccactgcacgatattcatagtgagtcacatgtagcatgaaagttttttgtatttttagagtgatgtcaatattcttcctcatctagcatataataagtactatctccattttttttaaaaaaaaataaagtgagatacaattagtaagaaagtaggtataactaaatgagggaatgcttgattgaatgggaaatgaaggtaggtgaaaaaattgataataaataatcatgtttgaacgagaagagaatgttgatgcagaaactgttatattttaagacaaattcagaaggctaaaagttattatattttaaaactgatggaataagagaaaggttatagtccattgagtgatattccagtcatatcctcttggtgtactactccgtcccaaaaaagacaaactctagccatgaacttggacatatacgtagctaggattgtttttttgtgaggggtagaacgtagaggcagttcatgccgatttgtacgagggatgagattaactattcccttttcttcatctactccctctgtcctataatataagggactttgggtagatgtgatacatcttagttcaatgaatctggacaaatcatgtatcatatccatctaaaatctcttatattatgggacggtgggagtagatgttaggggtgagaactgagaagtgatggtgctgagcaagaaatgatgatggttccaaaattcgagcctgagacaaacttagaaaatctcagcacctatctcagtctcaatgagggcagctagcaatattatgtggtgattttgatatatatatcagatgatgaaagatgactctattgacgaaagtgtatgacggtgttacaccaagagcttctatcccaatctgattttctctctcgtacatcatgtcaacacaagaggatttttaattaatttttaatcattttctgttgtttaaaagtagataggtgcatgcttggatcgcaaaacagttctttgtttcgccttgcacctgaagatcatttgacagaaacccaacataaccatggaagttctactaacttttggtgaacaaaaccaaaacagagcagcagctggctcagaacctgctcatccaatgctccttttgggtgtttagcgagttgatgccggtggtccccacgcaccactgtaaccaagtgcaattcccccatcagttcatgggcccccatacattaaactcggtccaaaaagttccaaagtccaaactcctaaccggggcccacgtccgagggtgctttgctttcgcgggcgtgacagcacggctcgaagtcactttccccactcacagaatcacaacttcccacccccaccacgccatatctccagccttcaatgaaccaattcaccgaagcgacgctctccgtacctccactgacatgcgggccatgcctcgtgtagggcccatatctcagtgggtgatatgactgggttcctgcgtggaaagcgtctcgctcgcccgagcggatacgattgcgcggctgcgccccccgctaacgacaagcggcaatctctttggccgcggcaccccgtcaccgacgggtggtcccggctccggaacggcgtgaggagaatgggcggagatcagaagtacggccacgtcagaacaagcagagaaaggcccccaggtcactgcgtggtggatcccaccgtggcgccaccctattgggccctactcttcagcgtgacgtggatggggcgcgtaatatgtgtttcggcggtagtagtaggttctagattatttaaggcccctcggctgctatctctatctatctacacgacgcgagagaaaaaaaaaatctggctcccgagaagaaaacaaaagggtaaaaagagcagagcaaaagctctcttcagttctccacgcccaagggcagaagagagggagggagagaagggggggagacgaaggaagcacgaaaccctaatcccgaggcagcgcgcctctccgatcaactccggcgtgagtcctctaaccgctctccatccccgatcgctcgctcgctcgcgccgctcggtgcttcaatccggctagggcttgcggccgtcgcaatgtggggggtttttccgtgcgatttttggtcaaattgcgggtggtgtttggtggtttttgtggactctggtgggtgggattagtgtttcgaactcgaagtgtacggggttgggattatactagggctttggtttaggcggaggttttggtggataatttctgaaaattttcagtggtttgggtagtttttgctggtaaatggcggctggttgttgcgattgctggtgggttttgatcacgatgaaatgtggcatgttaccatatggcgtttttggttggttggatttttattttgtgtattattgaaggggtcggttttaatggagaaatttcacgtttagcagtttagtcttatgtgaagtgactaatcgtcggttttgctttacccgtagtttgttgtctcccacaaaaaaattgcttcgatgttgtggggttttggtactatgacgtttgggttttagtggcagttatcacaaccattctgtgcgtatccttctacgtcagggtgggttttattgcgaaatgatggcgacttctcttaatttattagattaatttgttttatttgtaaaacatccactattaccggataagagagcattagattatataaattccgttcgaggtgtagttttgctgcatgcacctcgtggacttgcggatttgcatgtagaaccctgattaagagattgattagctttgtgcattgtttgttatatcattctcaccattatgtggtaatcaagaaatttgattaccattggatgggacatgttagtaattgcaacactcatggtcaaattgtcttcaccaacacatttataacatgctgtatatcaagatgcatggtaattttgtagctttgattatctttgctttggttgtctcgagttaagatactgcagccagtagggttttacctcccttcatagtt

SEQ ID NO: 58590 - DNA, 4572 bp, Oryza sativa
caacttctcatgtctctagcatattcgttctagctgaaggcttatcgtctctttaggtagttccacccgaagggaacacttctctacggccacaggttatcctgatgcctaagcaagatgcaggttaacaatgagaactaccaaagagttatcacctacagagccccttacataagcactaagctaaacaaatagactgggatgtacaaaggaaattacttcatataaaacaaacaaagtttaccatttgtttacctatggttttccctttcaggaacccgcgagcttacaaatagagctgaagtattaccttcaagcccacacagaggtcgatctttttataactatattagttcaatctatgaccaaaattaagctgttcacacatgcatgcctgaaggaattaaaaacataatcaaatatacttcacttgctaatcctgctgtactgaaactacgtatatacagttctctcgcccgaagctcatggcggcagtagatggtgcagcggcggccgtggaaatccggaggtggcagcagagaggatttgagatgctccgactagtggcggcggtgacgcagaaccagaggtggctgcaaggattatttggaagtgggaggggtagctcgggcgagcggcgacacggccatgttgctggaagttggctcacggtttgctcccttgtacagtgcttgggaggtacctcagtaacaaatcaacaatccaccgttcattcatatagcatactaatttaggaataggaaataatattaacaagggtagcttagtaattgctacattcctatttgctttacataatattggcatgaccctgaaacctccctttgtgtttaatcctaaccctataccccgagtgaaagaacgaggttggagcaggcacagagcgtgcggcggcggtgacaggcgggagcgatgggcgcatgcggcggctacgaccgcggcgcgcgtgaagggcgcgtgcagcggcggcgccaattagccaagtcagccaagctaacttaatttgattctgggaatggtaatcttgttgaactcatgcatgattaattcttaaaaagtaagtgaattccatattggaccagggtttgctaaactttgtatttcacaccatctaacttgtcaaaaggttgcagtttggactaaggaaatgtttcggctgccagcttgccgctattgttcttcgtcccacctacatgagtgtgagtactcgcacgacagcggcaaatgaagtgctcgacgggtcttgctgtgcagacaatcacgcgagatgctacagtgattctactctgatcctcccaggtcccgtggtatcgtgtaattgtattcccacaaaaaatccattatggtgaactcacgtcgacgcagagcgggaggcacactcgaaatcagcgacggcgacggcgacggcaacggtcggtgacggccgcggtcgtcgatggcacactacgaaggaaggggagcccgtgcgcctccaccacagccaccaccacctccaattccaccttcgcctggaatgggtcggggaggcacgcttgacagtggcagcgaccgccacggccgccgtgagcttgctgtcctgaacgaatcggagaatatagatacaaatattgaaaagatgacgcatttgccattaactgcacaaatcaactatgaaagtcaattaccattttaaccttccacctctcatagttggtccacccttttaatacctttttcctggtacacgttggattattgatgatcaacggttgtaattaattccaagcaccgaataagatctacttgttcagggaggcagtgagggtatcacacacaaggataccgtcccctaacatctctgttaaattaaataaaattatttttaaaattacacggtataatgcagacactcacaacgcacgtatactcacccatatgaacgcacgtacacaaaccctacccctatgagcatcttcaaagattaggccggcaaatccttgatattgacgaagtcaccacagacgcctcgctgtcaacgggtacgtcgtctaccactgaaattacaatgccgttaaatcctgaaaatttcactgctaaggggagtcgaaccaaagaacaaaggtgctactgaggctcttgtaaacattaggttacatgtcctttcacaaattaaataataattggttgcaccatataaatctatatggccaccaagcagatgcccttgagtaggaaacacatggtgggaaacaaatttaattgctcaatccagtcataatgtttaggataaacttttaaaattctaaccatcttgaaaaaaccaatttacccataattagaaaactcaatgatcaggacatcacttcttcagatacacatgctactcctcaagttgttttgcaaggtccaatcactagagctcacattcgataattaaattttcaagtgagcttgtttctaagtacttctttacatggttttgaggatagattattacctaataatttaattatgattagaaactatggagagtaccatggagtgcatggagagagaggctaggagatagacaaggtcattatggatgttcaagttaagatggaggtcctactcatatcaagttcgagttgacctcgggctccaagagtagtccacactaaattcgtcgctcaagttgcatttggactccgatttcaatgttcatcatatgtatggaaagttaatgagaccacctttcccatgtatctagtcccacgtcaaaattccttccaagttaatgggaatcatcgaaacaaggagtttagaatctatcatggtgctgtgttatcgtctttgggttcattgggccgtgtatcgtctctagtccaataggtacgcatccaggggtccagtaaccgtcattgagttagggttgggttttacttagataatttctaccatcacggttttgctgctagatcggtttttcgaacaccccaacttcgaattcttgattaatcattatctgcaattgagttgttatctttcttgttcttacttgtatttttcgatttacacacagggattagccttctcggcgaggtcaactgggtttcagtgggttgataactagagttgacgtgatgttgcgattgtagggtttggattgtgttgattagaaaccggatcgtgtgtgtatacttttcgccaaattgatagttatcttcacctaacggaagatcgggcatcccgttgccatcattcaagatggttcaaaaatccacatccttgatttaagaaggaaacattagcaacataagaaacattcgtgaaactttgacgtataagagcaatcataattctagcatttcagttgctaaataatcatttttttctcccatatattactgaaagataaatatttttggtgtggtttgaaaaaaaataattatgtcggtacaatattacaatgataaaggattgattaattaatggaaaattttagaaaaatattatcgcaaagatacgtgatttgtaaaatacaatcgtaagtgagaataatatatggggctagaccttcatgttagcatgtactatatctgtcctaaaatataagaaactaaaactggataagaaatatcttagcttctctaaattcgtagcagtaggatatatctcatccaatcataagtttttatgttttgtgacagcaggagtaaactatacataagatgttcttttctaacaccttgatttttgcgattgtactaggcaaataggcccaactaattaactgcatagatgtaagtgtacctgcaaattagaactgttttctatcaacatttttatcatttaatatttgaaaaaaaataaaactgacatcaaacaatgtttaattgggtgtacacgtgcatgggttaacactcatcttctctttttactgggaggaggctagtggctgccatgcagcaagagacagggagtccgggctcctagctatgaaatgtgcagcctatgtcctggtcctgctgccttacatgggccgggctggctacggccattttggtaaacaaaggaataagtttactttagaaccctcaatttgtcaccgagtcagaaattcatccctacactaaactaccaggtacctgacttacagtaccgtgtcaactttgatccattggcagcatagagcctgtttgatagggctccaaactccaactccgatgggagctagctctagtgggagctagaaggtgggagctagaagtcaattgaaaagtgattggccagctacagaacttcggggctaggcacaggtgacggcatcggtggccagggcatggacggcggcgtcgactgccaggcacggcgacggcggcagtagccatccgcgggcggcggtggctcgcctcgtcgtcttccagctcgccatccagctcgtcgtccagctcgccgtccaccgtcccagccaggtgttgcagggccccgctcacccaccgggtccactgcggggacggaggcgggtggcgttttccacccgaccacctccgcggggccggggtcgggggagaagtcggggggtgggggcgg

SEQ ID NO: 58591 - DNA, 648 bp, Oryza sativa
gtcatttttaaggcatgctttgcagctcatcgagtcattttgttgggaacaaaatgcagtgttgtttaatcggtttcgatatttctatatcaagtgatttgcatttttttctgtgatgaatatcttgcatcagtgtacaggtgtaacctggtggccttagcctaatctttgtgataacatttttcacttgataattggtaataatattttcccccttttcagcttccctgctttctaagtatcagttggagctaccatgacgacccaagctaaagaaaaatgcccactttgcacagaggagatggatttgacagataaacagctgaagccgtgtaaatgtggatatgaggtgaaaattcaatgcttgagcaccaatttgtagttcatctgatgtgcttccttttttcccttggatatcatgctttatatgcttgtgataaatacctaacggcgagagacatctttagtctgttgttcttcaaatgcttaaagagtcgaagttcatttgcttgtagattatttattttggtgaaattgagcaactcttatctctggatgcatgtcctttcttcaattagaggttttttttttttctgaatgaaaggttaatgaccttgaagtattagtgcagtttggggctgcaggaat

SEQ ID NO: 58592 - DNA, 17750 bp, Oryza sativa
ggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaggaggaccttgcccactgagaaggggaggggacttttccagattttaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaactctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgaccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgtccctgttatcctccgacccagaggtcatcagcacagaagacaagtgcgccccgcgaggctgcttggacgaagagtgccccagggatgcggcccctagcaaagaggatcggccccaccgaaaggtgcagcggcccgtctactttgttaatgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccagctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcctagacgggataacatgattgccgacgaactctcacggctcgcgtcctcgcgagcccagatcccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccgcagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcatctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggcgggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgcgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggactgggggctcaatccgatgcgcccggatcgccggcctcgacgtcactgtcgtctgcaccaccggcattgccctcctcgtcggagttgggggcgaacgcaagccgaggggccgagccctcgaagctgttgacgatatggttggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccctggcggacgagtccagcgagccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgcagcgcgcctgctcctcctgcgctgcctcgcggagggacaggttgaccgccagctgttgcgccgtggcctcggccccctcgagagctcgctcccgtttggtgagcgcgtcctcgcggaggcggagcgtgaactcttcttcggcgcaggcagcctcgtgcgccaccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaataagggcagccccccgctcctcctccacttccttggcaatctccgccagcaccttcttacgggtttcaagctccgagacgtgccggcggtgagccttacggcccacctccaccatggcctccatcgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgacgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctcccgagcggtttcctcggcctggtgggcccgggcggcctcctgggcggcctcctcggcttcccgtaggcgacccgcggcctctcgccggtcagattcccacctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctactgctggcacgcgccgccccgccccctcggggaggagatgggggaggtgttcctccctgcttcctctttccccgggcgtcggcagggcggctgctccccggacccctgtcacgggacccagaagcacgaccccctctcggggtagattgttcccccctgcggctcccgcttgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccattccccagatctaccggcgcccgccagctggaggcctgcgctgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggtgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttcccgcgcccacgcttccactaatcccattcgcccgcttgcggcgcatgaggtggatatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccgcgagggacgtcgggcccgagggtgatgcgttcgccctcctcttagtccccccgagggggtcgggccgcacccccctcggccccgagggctgaggcgccccgacccctcgtgggttttttgctccgcgtatgggttaggtgagtacagtggggcttacctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaaggaggaccttgcccactgagaaggggaggggacttttccagattagaaacccagaacaagggagaggctggctcatactttgtagctcctttatacacagatctcccaaaaacacaggagtagggtattacgcttctcagcggcccgaacctgtatacatcgcccgtgtcttgtgtgtttcctgtctcgcgagccttccacatacagagagcttagaatctctccctgagcccccggccgaaccggcaaaggggggcctgcgcggtctcccggtgaggagccccacgctccgtcagggtctgttcgactggcattttttacagctgcacgaaggctagctgcagctgcacaacacaagcgctgcagccgtagcactgtcgtaggaatggcagtcgaacatgcccatgggatatacgactccatcttgacctccttcaggcttaggattgatcgatgggggtctggtcccgctttaagggaccatttgattccgtggccatgccgtcactaattgcaccctctctccactgtcgcctatacccagatccacagaagatgggttagtcaccgacctcagtcctgctcgccgctcttcgcccattgtctatctccgccttgttagccgtcctccgctgtaggcctccacagaccttgagtggagatgggagggtcgaggcggaggacgggaggaggagaaggaggtggcgaacccgcagccaccggctactcaccttctcgatttaggtttaattatcatgcgggtacgttcaccttctccctttctttctcttgacactgacgagagacgagctaggagagagattgaacaagaatcgatgagagagcgagaaagagagagataagtcttgaccggctgctcgtgctgatctggcccagccggccaactcaacgtggcaaacgtgtgcaaactaactggagaaaacgttgcactattgtattgtgtgattatacaatgcacgggcaaaaaaaagtcatccatttttgaaaacactatactacctccataaaaaaaaatttctatgaaattaaggacaaattataaagataaacaaatgatcacattaaccttaattatttaatgaacacagtacacgcacacacattatatataaacttgattaaaaataaggttgagacaagaggttaagagatgaaatggaaagaaaggagattacaaggaaacaaattttgatgtaatcaatttgttttgttaggtcccacattagtagacataaaatttttatgggacaaagatttaaaggtagaaattcaatttttatgaaactaaggcagtagaagtttcataaaagaaaacgtgtgatgcaaaaatatttaatgacctcagtctaaattttcatcaattgactacagcgcaaagaaccgagtcgttcacgaattaaattttaaaatatactgttcattcatttttttctcaaaaatattcgggatgcaaaattttttacagaaatataccgtcggtctcgcacaactgttgcgcaaaaatgatgtgggaatgacgtcgtgggcggtatcgcgtaacggaatagcgagaccgaacggtctcgctaaagcaacgagcgacactgtctgacagctccttttgattagtgattaattactcaattaacaattaactaataataattagtgattaattatcctgattaatgattaaataattattaatcaataattaattaatcgctaatgaaatcggcatggcacggtatcgcgcattgcttcaacgagactgaaatctcgcgccgctgcgcgctttcagtgcgcgataccgtctgacgtcattcccacatcatcttcgtgtaatggttgtgcgagaccggcgatatatttttgtaaaattttttgcataccgaatatttttgagaaaaaaatgaatgaacagtatattttgaaatttaattcaggcgttcacccatctgtttctcccatgctaaatcatcaggcacacacatcaagatcatcgttcacatcccgaacgtgtagagccattgtttcaaacaaaaatataccttttgtggtaattacactccgtcgatgtttatgattttgctccggtgcttggataaatcattgaggtcaaacctcatccaccttaccattacccagtgcaatgcaggagtattttgcaaattttacaaaaaaaaatgaattaacccaactagcaggatgtctcgagcactccatgaatttatataacgatgcaaaaactatatatacgctatatcctatattataagtagttgaaagtttgtcctaaatgaaacttcttaaaagttgattaagttggtataaaatacactgtattttaaccataaaaccaatattttatgaaatatattcaatagtaaatttaattaaactaatttgatgtatgccgtagaagatgttatattttttctatatatttagtcaaacccaaggaagtttaacatagtacaaacccataacatcttatttttcaataatttacaataatcaactcgttgactttgtttgtcaccaatagtagatttccatagtagtagtagtttcactgccatctcatctagagttctgactttatcatagaagtactagtgctacgaccgttcttcttggcaaaatttaccacatgataccaaaaagtcatctaattggttgggatatatcaatggacatcacaaaatttgtgtaactggttgtagcgcacccgagacaatattgtatcatttccaatgaaaaagatatataggatagaaatttcaaaagaacataaatgcctccggcctcaacagcatgtaaaccggcctggcctattggatcttgttcaagttcaaccggactcaatcgcactaatcgttcaccctcacaaccgaaatccccatccaaacctaaccctaggcagccggtggcggtggctttggcggcggtgggcgagcggatctgggaatcaattgtggggctttaatggaacctcaatgctcgtaaaaaaaagccactttcttccctgctaacttcttcctcggcgacatcatccccaatgccgtcgacgcctaccaatttcacagctccaccccccgtcgattcccagagccggtcgctcgccacctccaaccacctagggttagatttggatgagaatttcaggtatggggttgaacggtgagtgcgtttggttgaacctgggttacatgctactgaggttgggggtatttttgtccttttgaaatttctctctcatctttttcaccggaaatggtaacatattatctcggatgtcgctattgctaattatataaaggcaaattttgctacaggacactccttatatgtggttttagccctaggacactgcccaaactcacttttgggggaaaatactccataaacgtggtaatttgccagtggacaccgcgccgattaaaataataatttccgattgaagaggaaagagaaattgcgtgaaatgtcaaaaatgcccttgggcccacatgtcagctctatctcctatctctcttctcctcttcctgcccacatgtcgctccccgccggtcgtcgaccgtgcacgcgcagacagcggcggaggcaacggcgagcagcagcagcaccccggccctctggcggcccaccagccgcagcgcgcggtggagcagctgcagccgctccttctccccgctgcctcgccaccctcaccctctgcccccacccttcctcccgccgccggccgacgcgagcaagtcgtagctcccgcaccgcatctccagcgccaacgccgagccactcatcgccaccgccgccgcctttctctcatcccaatcgccgaatcacgacactgctgccgacgacgatggtgacgagttcgaggaggaagaggacgtgcgtagctcgtcccccgcccgccaccacccgtgcccgccgcatccagctcatctccgtcggctgtcgcccgtcttcaccggcggcgcggagcggggcggtggctggcacagcacgcaggccggcgaggaggtggttcgcggatccggcggtgcagagcggggcagtggcggacgacgacgacgatggtgacgagttcgaggaggagcaggatgcgcgcagctcctcccccgctgccgcccgccgctcgtgcgcagctcctccccctgcgcgggcatggccgaaggccggcttggagagcgaaatgtgggcaagaagaggagaagagagatagaagatagagatgacatgtaggcccaagggcatttttgatatttcacgcgatttcactctcctcttcaaccgaaaattattattttaatcggcgtggtgtccactggcaaattaccacgtttatggagtgttttcccccaaaagtgagtttgggcagggctctagggctaaaaccacatataaggagtgtcctgtagcaaaatttcccttatataaatcttgtggtgcctatcagcaatgtcacgtatttgcgatgtctcttaaccaattacaatacttataatgttatgcaacaaattttatcaagaagaacacagtcgtagcactagtactactatgataaagtctgagctatagaaaccaatttcttttggtactaaaggagtacatgaaatggtctgccttctgcaacacctctcatcatctataaatacccgggacgtgcgtgctttcccctacaccaccactagccaaagcagcagtcaactgccgcatcgatcacatcacatcaaccagtaatcaattgaccaagcggttcttgcgcctagctaggtagctcgagcaatggcgaagtgggcggcggaagcgacggtgatggtggttctggcggtgacggtggcggtggcggtggtggcggcgcaggcgccaccgccggtgcagtgcgatcccgggaagctgtcggcgtgcgcggtcccgatcttctttgggactgcgccgtcgaagtcgtgctgctccaacctgcgcgcgcaggagaaggacgggtgcttctgccagtacgcgagagacccgatgtacgcgtcctacatcaatagcaccaacgcccgcaataccatcgccgcctgcggcatcgcctttcccagctgctaggctagcttcgatcgccatgatgcatggcgtatattaaatatatggtgtgtgcttgaataaaggatgtgagtttgaatcagtaagaactatcgatcgattaatgcacccccgtacgtacgtgtttgatcgatcgatcagctggtgtctcctgactatttaagtttgagctaatttccgatcttgtgtggtactatcagtagtagtactactacactactactagtactactactataaacaaacatatattttttatgtataaaaaaatatacacatatacaaattttgtatatgatgtgtgtcaggattacggataaggtataccttctacccttggatttatgctgtataccgatacggtatacctgtgcgtacacggatgtttcctttactcattaaggaaattcatcgtgtaacagaaacgaaatccacggacggaaggagtcctactcggactgaactgggtcgttactgtatcgtggtctgatatctccgagttatacttggagatcaactgacccgcgatataaaagggacccccggggggacctaaggcatcgaatctcatcgccaacacaaccaccacagcctgcgaagtcggatcctacaggagccaagttgccgggtgatctagtcgaacaactcgactacagtctcgtcggtatcatcgagttctactattccctttgtaatatgtggtttccattatataatcccataccaactggattagagctattacctattaaggggtctgaaccagtataatccctatttcttgtttgcttgatgtcgtattacatagatcttcgtaccagcgtaccccaataccctctatatccgatctacgagtatccatcgtcgacaatgtgtataaactttatatacgatgtgtacaaactttatatacgaagtgtgcaaactatgtatatgtacgtattaaaaaaccaaaaaaaacatcatatgtatacatatacgtatacaagtatacatactttatatacgtatgtataccaagtttgtacatacgtataaaaagtttgtatacgtatatgttaaaaaaccgagaaggaaaaaaagaaagaaaaaaccagaaaaaatgaattcaaaaatgaagaaaattttctgcgcatacaaaatgtgcaagctcgataacacatgattaattaaattttaattattatatatatttaaaaatgaattaattttattttttaaaaacaacatctatataatttttttaaaaaaacacactatttaacatttaaaaaacgtgctaacaaaaaataaggaagttaaccatttaacagttttaaaaccgcactagcggaaaacgagaagtttaagtctcaagttgaagaaaagaacgaagccttagtcattgtctcgtacctgcaatgcacgacacgtactctacaggatcgctgaacatgacagcgccaagaagaaaggatagaagaaaggaagaagggaagtggaactagagacgggcggatgcatttggatttttgtcagttcgtgcagggagggcatacgcaagtgttggagggattttcgtttacgtgggttgaacaaattgatgtcaacattgtagctatcgagagccaaagttttgtgcaccttctgtgaactgtggcttcgaactagagctagagctgtccttaacattcatctacctcgatgaggactctgttcttagagtttgatgtagtcttaaaatgaaagaatttcatagtattgatctgagctaattcatatttttgtaagatctatatgtgttataaaactagctccgaaatcgacattggtagctaaacgcggaagaaacaccataggagatccaaacacgataatgacaccgagacacgatatttagtaacggagttcagccgcagcctacatcttcggggcactgattacaggtgttcctcttcgatctagcatattacagtgtatcagagctacagcgactcacggccggttgccgccggcagctgctccctctcgctatgctaagttgccatgaagttacaacaagcacacccttctacttatgagagatcctaggatagagtccgactcttactctagtcctaatacctattacaactctaagtcctaaactttaaccgactttgtaaacatattcatcacaaactctaacaaactccacctaacactaacaaacttcaccttgacaaatatatcacgccaacccgaatctgttacttgctcaaacctccgttacatttccagccaacacagtcacctctcacctacaaccatagtccccacgtcttcgcctggtcgtggtcaagatctggacgctggagcttgcctaaccgccaatgcccctagaaagctgccaccgagagcctccaccgctgtcatctccatccgccgtagccaaaccgaccatccaccaccatcgtcatgtgcattcgactgacctgccatcatgaggggagggctagcccccaccgctgccagtgttgccaaccctcaccacgggtgacagtgaagggacgaaggactagtcaatgtctccacccaacggcaccgccgcccaccaagttcaaaggtgacagtggaagggacagcggactagcccccatccccgcccaacactgccgtctaccaagtctgccaccaccgccagtcctctcactgtcgatgagagaggaagggacggcgattagatggttgttactagttgagatgaacaagtatgtagagaaattaaataaaagatagttgtaatttgctgagataaagaaagtaggtgaaaattagctcaatcttggaataaattttgaatgctcaagatgggaaatacatcacctgttctttaggtggacataagaccaccagtaaagttatggtggtgaaaaaggttgacagttggataaattttcatggaaaaaaagagtatattttccttttcgagtagtacggaacactcttttgaagactgaggaagaatgcattttttttctccatgcaaattggatgcacgtccacacactcacacaacccagaactgctatttttggtgcatgcatttccagtaccatacgcactacagtttacacacgtttatatagacgtgaagagaagtgtgtcgctcatcgtggttttatcagacggttgttttatctatagtccatacgatccaagtgtttaaatttttggacgattttgtttatgagaaatttgagttgagaggtcgatagacaaacttgaaaacacaaatcatcttagaatacttaactcttaaagtagcatttcacgctcccacaagattagaaattcaaaactcaaacttaaatcccagaagatacctgatcgatcgatcaaacacgggtgcattaatcgatcgataatttatgtattcaaacacacatcctttatattattcaaatacacagtacaccatatatttatatatgtttccacacattgtcctttattttattcaagcacgcagtacaccatatatttatatatgttgccacacatcatggcccgcaccggtgaacggcggcgacggagcctagctgcagttgggaaaggggatgccgcaggcggcgatcatcttgcgtgcgttggtgctgttgatgtaggacgcgtacgtcgggtctttcgcgtactggcagaagcacccctgctgtgctttcaggctagagcagcacgacgccgacggcgccgtcccgaagaagatcggggccgcgcatggcgacagcagcccggggtcacactgcggc

SEQ ID NO: 58593 - DNA, 9162 bp, Oryza sativa
taatccaatctaggatgataaattttttggatcggtcgacgctgactaagtctaaatagtcctccctccgtccctaaatatttaaccttgttaatatttttaaacatatttgaccatttccaaaactttggtgaatattattaaaaacttgagtagtagtactttatttaacaatgaatcaaatgagtagaaaaaaattaataattactttatttttttaataagacgaacggtcaaacatatttaaaaaagtcaacggcgtcaaatatttagggacagagagagtacatatatacgcgcgcactaattacagtttgcctataaatatgaatggtcaaattttgctacatgacactgcttttgtgttgttttagccctaagacactgcccaaactcacttttgggggaaaacactccataaacatggtaatttgccagtggacaccgcaccgattaaaataataatttccggttgaaggggagagaaaaatcacgtgaaatgtcaaaaatacccttgggcccacatgtcagttctgtctcctatctctcttctcctctatattctctcggaggcacatggggcggcgtcagtcaccggggcttgagctcgtcgcggcggaggagatggtgaggactgcgaccggcggagtggagcaaggcgtcggctgcggcggaacaaagctggcggccgaagcaggcggaacggtagcgtcggccgagcgcgtggcaagcaaaatggagcgccggcggcggcgggcattcgcacggtggctggcgaagcggcaaggggaggagctgtgcacgagcggcggaggaggagctgtgcgcgttctcctcctcctcgagctcgtcaccatcgtcgtcgtcgcccgccaccaccccgctctgcgccgctggatctgcaagccaccatcccgcaacggcgtcgtgattcggcgattgggatgagagaagggcggtggcggttgcggcggtggcgatgagtggctcggcgtcgacgctggggatgcggtgcgggagctacggctcgctcgcgtcggccggcggtgggaggaagggcgggggtagggggtgggggtggcgaggcggcggggagaaggagcggctgcagctgctccaccgcgcgctgcggttggtgggccgccggagatcggggtgctgttgctgctcgccgctgcctccaccgccgtctacgcgggcacagccggcggccggcggggagtgacatgtgggcaggaagagaagagagataggagatggagctgacatgtggaccgaaggacatttttgatatttcacgtgatttctctctcctcttcaaccggaaataattattttaatcgacgtggtgtccacttgtaaattaccacgtttatagagtgttttcccctaaaaatgagttcgggtagtgtcctaggattaaaatctaaaatcagacataagtagtgtactgtagcaaaatttaccatatgaatgttaaacaaacccttaattaattataactacgcatattattaattgcatgggcatgacgtagcgtacgtgtatatatgtgcgtgttgcgtgtcgtgggttgcgatgatacatggagctgtgtgtgtatatatgtacgacgttgttgctgtcacaggaaggatctgggccgggaggcggtggtacgagtggccaggcccgtgaaatcgtggccgcctgcattcccaccacccaactaatcaaacacgctcgatcgatcgcaatcgtcgctgctgcttgacggacgcccagcaagctagctaccaacccggcccgaagtaaactacggccccccgcggacagctacatcatgcagctgctcaattattagtatttggcgttttacttagtacagtttgggtgtgttcagtttacactaaaattaaaagttttattaaaattaaaatgatattataaaaaagttaaagtttatatgtgtaggaaagttctgatgtgatggaaaagttcgaagtttagaactaaactcggtctttatctctattagcatatctattctaaacatctcgtatagttagtttgactctttaagattgataaagttattacatgcacaagtgtgtcgttatcgataggtacaagtaagttgtatatcactgaaaacaaacaaataataccaagtctaggatttgaattcgacttgaataattttcgtaacaaatttaactagtttagctgtatgttaactaaactgtgtcttatttcgaaaacagatgtagtatatcaggatagtataaaaaagtcgaataaatacccaagttgaaattaaagcactgacatgtactacctacgtttccaattcgaggatgaccacgctataatcattcttttcgcggaatactttacgtgctgatgtcactactacagattccatttttacaaatggggcaaatcgattttttcatgcggacggatggcccgcatacgctcaaaagtctgtgaaaatagttttttttcatgcagccagggcaaccgcatgtgaaaaataggtttttttcgcatgcgggcgcttaagccaatctcatgcgaaaagaaaaaaaccgtgaaaaaaaataaaaattccaaaaatccaaaaatacacataaaccctaaccctataatgctcttgccaccgtcgttctcatcctccagccaccgccaatgccagcgtcatcctctcatcaccgacgccggatcggggcaggggagggcggccgccgatggatcggggcgggggagggcttccaccgctcaatccaggtgggggaggtccgccgctgtttcccatgcccaccgccgctagagtccgcgctcaccacccttgccctcaatcgccgttaccggagccagccgtcggagtgagagaggagaggggagaggagtggggaaaataatagaggagtggagggagagtgagggcagccggatccacacgggtggcaccgcccgctcccagacacctcctcgtcggtagtggcgcccgccgccgcccgctccctctcggtgaggagagcaagagagagaggagaggagaggagataaagggagaggaaggagaggaagagagaaaggtggaacaatttgaagtgttgagtgggaaaagagagaggaggggagaaaatatagatggagtagatgagggtaatttcgcatgcggactacttaataggctagcatatgaaattctatttttcatatggccccttaagaggaccgcataagaaaataagctcatttttacatgcggctccttaagtggcccacatgagaaaatagattttttgcatgcttgtctcttgagcagtcgcatgcgaaaatgaagattgattttctagacacgatcagttccgatctacttgcagcctatatggttctcgtacggaaaaattgttttttagtgtgcgtacatatggtaccaaatatgataagtagttaccagtgtatgacattaggtatcatgtttatgtgtaacatcctcaaatttttaaactaaaatttgactgcatcatgctggcttttgattaaattagtgtgttttaaaaaaaatctatttgattcttaaattggttcaagtattacttccttagagccctactaatttactctaattattccctttatttcaaaccttagtgaatttgagcaaattctctcaaatttcaaactatagattatttacctagcttaccctaatattagtgaggatttgctttactccaaaccctagtaaaaccctttcaaattcatagattaaattcaatcttttctaggaaaatatacaaaattcttgaattttactgttcatcgcacacaaggtgctcgatgaaatacccagcccagctagagcagcccaacaccatccaatcttgcacaaagtttaggtttgatcctaggggaccacatcccactcaaaaactgtggtttagttggccttctcctccccttcacgcgcgctctctggcgttcgactttgccgcgcgccgagccaccgcgcgtcggtctctggatcgatcgcacgtgcccgaccgccttggcacgccgtcacccgtccgacgccctcagaccgtcgtcaccgcaccaatcttcatgacgacaaagccaggatgacgaccgccgccagaaatcgtcgctcgacgccgtgcgctcccgtccaagccgccgccgagtgcgatttcgcttctacccggggtgaatcgcgccaattcttgccgcacggttggattgaagatagacggtggtattccctctcacaattcaaaccattcacccccgagtcggccgtttccaccctcgccgccgccacgagtcgctcccggattggcgccaacacgtcgccagcagatttcacacgtagtcaagccaatccttcgccggtaagtattcaaacgtggcctcccgccactcaaattgatcttggccgccctctcacagcctctgccaccccagccatatccaaagctcgagctcatccatggcgatgacggtgcccgagctcatccattcctcccagccctataaataggaccccaataccttccttgtccatcatcaatcatcaacaaccatagccccacaacctcgaagctctgctttcccaatccattccatcaaccaccatcgctcgtcgatcgaacaccttgtgcgcaatcgactccacacctctccatccatcctccgccctaaatatcccttagaacaccttatatcaaccatgttctagcatagtagaccctaaccgaagccctgcgtcgagttttacctcgccgcaccaagccgagcaccgccgcccccgcgctgctctgttcttcgccgccgaggagtttttccgaccgcaatccttcatctcggcatatctcggtgagttcttccgttttaaccatctacatactccctagattccattttagcaatcaccttgcactatcatgttgccctctgggctgccgacgtgagcacggccgccgcctatggaggcgctcgtcggcaactaccctccgcgccttgccaaaggttggcaagcagccggaattcatctaggtacctcgtagatgctctagaacccctcccctagccatgtctaactcatatcatcttgaccaccatcacggcctaaccgtgccaccgccgccctagccgctaggccatccacatatcaaattaatccctccgctgccgctcgccgtcgccggagaaccctagctccctcccctcctcggccgcaaccactttccccctccatcgctgccgtaatcgccaaccctagcaccgccgaccgcttttggggattggccggaggtagaagaagagaagagagagagagactgacaggtgggacccacacacagtgctatttcacatttatttgattttcaaactttagaagcccatatcttttaaaatatagatccaattccagtgagacttggaccaatattcttctaaaatcattctctatcttttaagcccatttttgctatttttgcattttattttattttctctatttttcatatttttggattttatttgaattctttttgaatttgaattttatatatgtctaaccttaggtcttgaggattcttctgactcaatagataatatcaatcaatctcaggacatcgagcaaggcaagttaccatataccttttgatcatttaagcctatattttataaattatttatttatagccttatattcaatattctattttccatgcataaattaatcatagaaacccagataatttagtattgcttactttgcttacaatctggttaaaataccttatacttagattgggacagtacgtaagatttggttgatttccgggtggctagtactgtctcgatcgatataagttttaccaggtacttatgtcgaacgaacaggtacgaccgcagtttctagaatagggacagacctagttattatgttaattagcaatatggcatctctgtatagtggttcttatttttaagtcctcgcgcaggaggcaactatagccgcgaagggcaactttaaccattaccatgtacaggtaaatggtttgtgatactcgagtataaattatatggtatatttctaaaccctgatcgagatgacgtggtgtcatacgatcagttccccttaaatacctcgggaacgccagaactcctcttgctactgttaacaatacgttcagagcatatgaggatataagttcatggaacatgtgccataattgttaatgacttaatactgggccatgactaaagccgatgattatcagcaagtcgtggactgcgggtaaagcgtacatctgctgcagtagaatatctttaaaactattcgaatagccgtactcatggagttgagtaccgggactcatatggtaccctagttagaaatctaaagtctatatgttttataaactcttgctataactctttcagattgtctagtactgcttttgtcaaagaaccctactatatgtcaatgcataacatatttccatgataacttgttgagtattgtgaatactcacccttgctcttataacccctttttcagatttgggtcaagaggaggacccttatgactattactacgatgaccccgataacttagagaatccttaaatattataccttcctagtcagaatgtatagaaacttccgctgtgtattaattagttaggtgagtacctattattgtaaaacccttagtattgtaaaactttaacatatgcaatgaagaaccagttatattgtatgtatcaatatttactgatccagggactgatacattatcttagtcggatccaagttgttagttctgggctccgacattatgcatatattaatacagattgtaccgtctaacactatagtgttacgtagtttttatgtttcaattaatgtaatactccctccgttttaggttataagacgttttgactttggttaaagtcaaactgctttatttttgcctaagtttgtagaaaaaagtagtaacattttcaacccagcaaaaatttattatgaaaataaattcaattattgatttaatgaaactaatttagtattataaatattactatatttgtctataaacttattcaaacttaaaataatttgactttgaccaaagtcaaaatgtcttataacctgtaacggagggagtatatcggactgttattccgttaaatacttgtgaagtcacactagaggaaattgttgccaataattttacatgcagtttatctaataagctctagataaaaaaattatacacataaaaaaatcacaaatcaactcttttcactatcatgggtcacaaatcaaagcatgttggaggccaaaattggatcaaaattcaatttaattggattgttcgaatgtacctattgaagcaaaattcggtttgttcagtgtattcggttaactgaaagtactaccgacttgaccgaataaaactcggtcgtctaatacatgacactgaactaatgatcaaatttctcgatccgggtcttttcggtttggtcttttcatgcccatcaagcccctagatatttggtagagcagagacgggtcggtgtgttaagaagataagcaagcatacaggctggtccatatatatatgttgggctgaaactgaaatgggctttaggcgagatttccaaactgtactcttcgtggggaaacaggctgtggctcttgcatatgcatgggccgcgcagactgctctagttttttttttagaaaaaagtatactttgacaccttcaactataggtcgaatctaaaccataccccttaaccacagaaccgggtaaaacgactcctccaataattaaatcagtgctcactgacgtggtgccaatgtggcacggttgacttggtcttaatctgacgtggtgcttacgtggcattacaatgaaaaaaaaacaaaaaaaatatgtgagacccacatatcatttacatgaaaatttattgtggaacccactgaccatttggggcccacatgtcattctgtccctcctgcctttcttcttccttccactccagccaccccaccaccaacgcgccgagctcattctgcacaaagatggtcattgagtactccttccacggccgcgccatgtacgtcagattcaccttctccagatccgggtgcggcgccacagtgcggttgtgcagccccgtccctcccgcgacctgcgccgttaattatgatgttcacctggttccccatcggcttctgtagctggatcaagcagttctggagcaccacctgcatgcatttcatttgcttttttctaaatatttgcttattcttcgtcgtcgtcgtcgtggtggtggtggtggtgttaattgttggatcaaaagaaacagaagaagaagagtttaattatatacttgcctgcgagttgcagtatatgaagtcgatggtgccagacacggagcagtcgcggaagaactgccgctgcgcatgagtcttcaccttgtccgtgaacttctccaggtccgggtgcggcgccaccgtcacgttcggctcgaattcctcggcgatccacgtcggcatgccgtcctcggcgatcgagcagccgccgcccgatgctgaggctgccgagcatcgacgagaactggtcgaccacggtgaggatgtccttcatgagctcctatcctacgagctgttgagcgccgttgcgcatcttggcggcggcatcgcggtggtggtgttgaggaagccgtcgaggcaggtgccctggtaggtgagcgtggcgctgagccacgtgcggaggtcgtcgacggccttgttgaaattggtcatatcgaagccaccgagcttgtggaaggacgtgttgaggttgtctatggcgcacccgagcagctccttgcaattctgcagcgctcccactattaaaaccgctggtgcccatcccggatcctgctctacctcgttgtcgccgccctctctactggagaggggaggaagaggaaggagaagggaaccagagggagagagagaagagggaggaggaagaagaagataaggggacaggatgacatgtgggtccacatgtcagtgggtcccacatttttttttacaaatgggttcctcattttttttattttaattccacatatgcgccatgtcaatgccacgtgg

SEQ ID NO: 58594 - DNA, 13348 bp, Oryza sativa
  unsure (1)..(13348): unsure at all n locations
ctggaagtggatcgaattctgtgtgctaacttaagagcaggagagaaaagcctaaaaaaatccagagtagtaatctcttttgcagatacgattaaacttgcgtgcaagaaacgatatctctcctgggattagttacattgttgtccaatttatgattcgtcgaaagaccattccagttagaactatagccacaggactgtgtttgaacagtaaaaactgctacctccggtaaagttgtgaattgcttgcggatctctaattcaccggtgacaattggttggtgatgtgtgtcaccgtttcagggagaattaaagttgacgaaaccgttcggcgggaggaggccggcgtgcagcctggagcttaatttctacttactccgtcccaagacaccaatctagattgacatttcaactagtaatatccagattcgttgttctagataacgtcaaattcttatctggattgatatttttagaacggttggagtacttctccgtccaaaactaaatttacttttcacatatctcacatactaaaaaaatatttctatatggttaaatcgtaataacctttttttattaaaatacttttatagtaattattattagaaataattttattttgagataaatagaataggtaaaaaagaatggtggggtcgccaagatatcggtatagatcggatcaagctcctctacctttaagtgtaggtgtctatgtaatcgacatgtgggtctgatgaagcatgtatccacctgtgagtgataaaggcacggcaccaataaaagcagaggatctcaatttgtataaatctatttgtcgtttgtcaattgtcaatttgtcattgacgaatttgctccgctacagggaccgtctgctcgctgctcgtcgtgaaatttgctcacatattttagctccacgtaagcattaaattcttcatttctcgtgtcactcagtcactatgctataaaatataaaataaaatactcaaatactatcaacaacatgcacaagatccgaccttccgtcccgtgaatccgtgatgaagaatcgaggatagtactatagtatgtgcatcatcttaaaaaaaatatatgagaggatacgtgtttgtggtttagcctgtcatgtaggggcctcaggtatctagttgtattgattatattattattacttcctcgtggttaaatgaaccgaataaatcaaagcggtatctgaattgatagcacgttgtactttagcctgctcgctctttggccgtttacgtacaccgcccatggttctatcaactctttagagccgggtatggatgcatgcccgtggatttaacaatcatgaagcaggagtaccatttacggagtagcatgttggtgtacaaacctatatatcaacataaatgaaggtacatcctgttttacaacttaaaacttggattaaggtcttaaaaaataaccttacacttcagtttttcattttgtttttttctcccttcccctgacataagccggtctggctgattgcgatgtgtaactacagctctcttcttctaatatattaacgtgtaatccttttgcgcgttcgcgaaaaaaataaccttacaatttaaatatggaactattcatcataaaacttttcaaaccgtttactttagacctaaactttcgaacctagaactatttatcactctttttaaagataacagaatatttcgtgaaccgatgaaaatatcgggcctcaacaaatggataataccaagactcttctctatcgaagacattgtagctctttgttttttttctttcgattacatggcagacacatacgcacatacataactacacacgccatactatactcatacacgaatatgtcttctaacacatgctctctaagccaagccattgtagttcaattctacacagatggataactacatttattcattagttatctactaaactttaatttgctagaataatagacaccgaggtatagatagaaatcaactttacgcatctacatagagatatagatagataatccctccttttttacatcgttgacttttcgatatatacttgacaatttgttatatttaaaaattatgtgtgataaacttgaagtcacgcttaaagtacttgtaataatcataacaaaataaataataataatatacttttgtttagaggaatggttaaacttatgtctgaaatatcaaattaccaaacatatataaataaacggaggaagtacatcaaatttattgaagtgttctggagtacgtgttaggccacctatggtatcggtcgatggagccgcctccacgtcgtaccatacgcacgcagcgcgcgggcgcgcgctcgcatcggtgctccccggcggccatacgccgcacacgtagacgcgcatacaaagctgcaaacctgcaacgcgcgtagtggcgcccggcgccgttcgatccacacatatctcgctctcgctcgcgcgcgcgggagcgtgaccgtgtcgcgtcgcgatcgcagcaccgcgcccgcgcccgcgcgcacgacggcgaggcagacgcgcgcgcgacgggagcgtgagcgcgggtacggtgtggctacgctttctagctagtctcgatcagtcgatcgatcgatcgcgatcgatctcccccaccgggccggtcgacggtcaggtacgtcaaggcgcgcggccgggcccggccggagctagctagctagccgaggtagacagaaccctccggtcatccggtgtgtgcgtggtccagggcgggaacgcgaaccttctccatcgccgcgggtccgacacccgcgtgggggcggcggtcgctgtcgttcgccgtgcgccggctgggtctgacctagctttggccggggccgcccctcgcccgccgatcgcgacgtacggcgtcccgtcggccgtcgacactgacccgcgcgcgctgatcgataatatcgatggatgtattggagggtagccttccggcagcgcgcggcgatcgatcgtttacgcagttcgggacggccttcgatcacgggcgtagtacgtaccatatatatccaggggtttaccgagccgtacacggtacactcgacatgaactagcttgcttgtccgtgagtcgcgatcgatcgatcgggcgagacaagtgacaagacgatcgatgtcgtagctggctagatatgcgcctccattagcggcccgggcatgcatgaatgtatcaatagcattggccccgttcgatatgaccatgtcacgatcgatcgacggtacagggcactgtaaccggcgagggctgattcgctgaaaagagagcgagcagtcgctgtgcccggtcgtcggccgccagttgtacaattcgatacttgatagccggtccccgtgaacgggtgaaccgcgggccgaccggcgcccgtccgatctatctaacttcggtcgatctatcgatctcagtacgccatccatcagatccatccgcctcgatttacggctgtgaccgtggggcgttgccatccatctgttgtgcaagacaatctggtagggtcgccctgcgtctcctctaatcattcgtccataattatgcacgtacgagtgcattttagtagagacgcatgcacttgttagtccagggtgtacgtgaattcaaatttcaatcccatggttctccgatgttgaattcaccaagtttctacttggttgtccaatattttaagacccatttgaaacacaggaccaagaaaatgattgagaaaacacataaatagaaaaaaaatgtacgaatagaataccatgcttattgaattcctatgggactttgaaacacaggaaagtctccaagctctcgtttgattagcacataggaaaaacgcagtaattgtaaacacatgaagagaaaaacataaggtgagacctcatgcttattttccttcaaaattgctctagcaagatctattccataggaactttaaggccctctttgaatcaaaggaaaaaccataggaattatagaggattttatcctatgaaaaataatcctatagagtcatttgaaacaaaggattgtttcctatcaattcctttgaaattcctatggaatgaaccttactagagcaatttggaggaaaataagcatgaggtctcacctcatgttttcctattcatgtgtctaaggttcctgcgttttttctgtgtgctaatcaaatgacagtttgaagactttcctgtattacaaaatcccataggaatccaataaatgtggcattcaactcctatattttttctattcctctgttttctcaatcctgcgattaaaaaatgccctaaaggaattgatatgtgatagtcctttgtttcgactctataggataaaatcatctataatttctatggtttttcctatgtttcaatggggtcttagcattttgaaattcactaagtacgttttcttttttgtgcagacttgttaaactcggtatctattaacttattaaaggaatagaaaaaggagcctccacgttcgctctcatggactagaaattctcatattaactagagaaaaagaaaaacagagtacatatagaaatacaatttagaaatagctgaaattcggaactaaaaaataaggaatattgaaagatgagactagagtccatatagaaatacattttataaataactgaaattcagaattaaaaaataaaaaaatattagaagaagagtatagagtccatatagaaatacaattagaaaataatagaaattcagaattaaaataaggaatattagaagtagagtatagagtccatatagaatttaaaactaactaaaattcggaataaacataataaaattaaaagtagagtttagagttcgtataaaaatacaatttacaaataactaaaattataaattaaaaaaagagagtctaaattcaatataggaatacaatttagaagtaactaaaattcgaaattaaaagttaaagaatattaaaagataagtttagagtccacatagaaatacaattagaaataataaaaaattaagaattaaaaataaataatattggaagaaaagcctagagtttatatagaaatacaatttacagataacgaaaatttggaattaaaaaaagaaatattgaaagacgagtctagagtccatataggaatataatttacaaacaaataacgaaaattcggaattaaaaataaataaatattgaaagacgagtctagagtccatataggaatataatttataaataactaaaatttaatattaaaaataattaataactaacacgtatataaaatacagtataaatattacacaatatattatacattagtagtttcgtaaagttagtacaaaatttagaattatgtatcattttaatatatttgaaaattatattaagaaaacatatatactattatatgagagaaaatataatgacactagccgtgtaatctgcgcgggccaccatgctaatttatttgaaaaaaacacactatcatggatatatagagcaactgagtaagcaagatatttatctatgtttgtatttaaaaatgtgacgccacaaataatgacaaaattattttgttatattcctgccttctctgcattatccgcgctagctgctctcctctagctcgctatcttatattctatgcccctgcatctcgatcggcgcatggcgtggcgcggtggcggaatatacgcacgcaccgctccggtcagtggccacggagcgtcgccccgtccagtggagatcaccacggaaagcgaacgccgatgacgacgacgcccgcgcgcgcatcaacatcacggcggtttcagtgcgccgtacccgtccatgcatgcagcgcgctgtagctagccacgacgtgacgcgctggtttagcgacacgtatactcgctctccaggacagctaatatgctctgctagctcacacgtttgtatctccgtcctgtcgatcgttggggatcacgtaagatcgaaacagtggcgacagcattgagcagtggcgtgaccgagtgaggtttgatgaaacctctccgcagctaccacatcagcggcatactagtactacttttgacgatgaaacctctttttgaaactgcgtcctcttttatggggaaaaaaagaagggaacaagggtatcatatagattgaataccgtatattgcagaattgcaagcaccaacgtaatttctagttcggtccatagcttcgataaacgagcgaacaccatctgaccatccgtgtatttcaggcacttctcgcacaaaaataaagtttcccacagttggcgcaatttaaccggagtctgagttaagccatgagttttccaatttttcacagaacacaccagcacggtaaaccttttcttagaaaaaaggttagggcgggcaaacgtccttcctatttttcacagaacgctccagcgactgggtttccccgcgcttacgccctcgttcagatgggtttccattccggcccatagacatgtcagccacaagcccataaccaaaacgagcctacaaagctaccaacaaatgctgcccacatgagccacgcccgcatggacgcatgtgggtaggccactctccgctgctttgcactctgtcgatctgtctttcggaaggcctgaattttgtgggcttggtgattacttgggcctaaatcatagcgattatttttggaaaagtccactttaggttcctcagataggggccgagcttcgaatcacattcttcaaccgcaatatcacccctcgacttctaaaaccatggcaaatttgagtccctctgctttgggcggttttggcttgtggtggtggcgtccacgtggtatgttgaccttattttgaggttgatgaatgctatcaaaacccgatccctatttgagagagagagagagagagggaaaaaaaagaaaagaaaagtgaacttattccttgttctttcgagacctgagatgtttagccacattggtggggaaactcttttaatctcatttcttatatgttactcatatagttataaaaaaaataacaagatagattaatttgatatatgtcactacacaaacatgtaaatttaaattttagttttgcaagtgaaaaaaatatgattgtgaaattaatttttttatgacatcaaatttaaacctggaagtttgggtgatatatcacatttacttttataaagaaacctttgatatgtgagatagtatatgtttgtttttcaattattttcataactatttacatgacacgacagacggaggggatatccctatccctccaaagagaatccatttcccactttggtgagatactgttcaatagataatgatatttgcagttgcacgctacagttttgaatattcttcgcatcaatgtaccaaatcattaggcatgtgatcagatcttcgcgcccgccctctccacgtctgcgttggcagcgaccgcggccgccgccttcgcatcgtccacgtgggcggcatcagcgtagacctcctcgtcgacgtcgtcgccggagcacgcgccgtgcgcgacgtcgtaggtggcgtgcagcccgacgagcacgtagtagagcagcatgatggcggtgcagacgccgaagcggatgaacgcctgcgcgccgagcgagcccatgaggaagaggttggtggcgatggacagcgacggcagccacggcacgagcggcacgccccacaccttgggcgcgcgcgccgccggcaccagaagctggatgccgagcgtgcccgccgcccacgccggcaccagcacggtgtacccaacccaccgctccggcgccgcgccccagtacgccgcgatgcccgccgacgagccgatgaccaccgatagcaacgccaccagccgcctcgcgtgcgtcctgctcgtcacgccccgcacgtagtacctgcgcgcgttacaggaagccattgttggttacagaaaactacgtgccgaacttgaacatgtgcaccgccgccgtaaggtgggagaacgtgcgtaccggcggacgaggagggcggtggccatcatcatgaagatgaagagcgtgctgacggagaggaggctggagagcacgtcgaggctggagaagaggccgatgcaggcgccggcggcggcgatgagcacggtggcgtgcaccggcgtgccggtcctggggtgcaccagcgcgaacaccggcgggatgatgtggctgcgcgcgatgtgcgtggtgtaccgagcctgaccgagcgccccgaccagcagcaccgtcgtcatccccttgagcgcgccgagcgccaccacgtactgcgcccaccgcatcccgacgttgctgaacgccaccgagtacgccgcgctccggtcgatcgccgtgtacggctgcatcatgctcagcaccagcgccatcacgcagtagatggccgtgatcaccgacatggagccgagaagcccgagagggatgtctctcgatgggttcttggtctcctccgccatggtcgcgatgttgtcgaacccgccgtaggcgaagtagacgatcgccgccgcgcggaacacgcccggcacgccgtgcggcatgaacggggtcaggttgctggtcttcgcgtggaggaagccggccacgatgacgaaggctatcacgaggacgtgcacggcggaggcgacccagttgacgcgggaggtgcccttggcgctcagaatggccagggtcgccgtgaccgcgatcaccaccaccgcgatggggtccagctcgttgtacccctcggcgagcgacgtctgtatgcgcagcgcgctcgccggcttgttgatgagcgacgcgaggtacgacgtccaggagcgcgccaccgcggccgtgccgatgatgctctcgaggatgaggttcgcggcggcgatgaaggccgccacgtcgccgagctcgacgcggaggtaggcgaaggagccgccggccacggggatctcgacggcgaactccgtgtagcagaacacggacagcatggcggagaggccggaggccacgtaggagagcacgatggccgggccggcgtggtcgtgcgcctcctggccggtgagcacgaagatcccggcaccgatgacggagccgaacccgaaccacgtgaggtcccaccacgtgaggcagcggcgcatctcgttctcgctgcggcggcgcagcgcgccgagctcgtcggcgtcggtggagcggccggcgaagcggtcgcggaaccgcgcgggcgtcgcggccagcgccgcgcggtacgcgccccagctcgcgaaggacggctccgggaagaaatcttccttctgccaccgccagtagctcctcgcctccgccgccggcttaccctcgtacggcttctccggcgtatcgacggccgccatatcttcgtgtggaggggatcgaccacagctttggtggtgaactggacaactggtggagtgtggtgagctgcaggcagctgcagccttggagatatccgagtgtggatttgtcactttgtgagacgatctcttttgtagtactccctccgtcccataatataagggattttaagtttttacttatatcgtttgaccacttgtcctatttaaatttttttaaaattattatttattttatttgtgacttactttattatctacagtatcttaagcacaatttttcgttttttatatttgcaaaaaaattttgaataagacgaatggtaaaatgttataagtaaaaaagccaaaatcccttatattatgggacatggagggagtagctttgttatctgatttttctttcttctttttcctttttctttttgtttgtgtgtgtgaagcggatgccgagcatttccggcaaaccggcgcctcggtgttacttatgattataagaattcgtttacatgacgtgtaacactttcagttcactaaaattcttcatctgctttaagtagcatggactacttatagatggacggagctcctctgatgcaaagttaaaggaacgtgggtcgctgataggtagggctcacctttaaaggcccacacgttagtgacgacgttcctctaatgtaaaactggagctttatcccttctagataggataaatgaagtcgtagcagtagtgccatgagcgggatgtactttcctaattttttttcccaaaaacgtcacaccaaatctttggacatatgtataggcattaaatataggtaaaatgaaaaactaattgtacagtttgtatgaaaatcgcgagacaaatcttttaagcctaattagtctatgattagctataaatgctacagtaacccacacgtgctaatggcggattaattaggcttaataaattcatctcgcggtttccaggcgagttatgaaattaaatttttcattcgtgtccgaaaaccccttccgacatccggtcaaacgtccaatgtgacacccaaaattttttttttcacgaactaaacaaggcatgcgtttctgtcatggccctaaaatccaaagtctgaagccccttgatttgtataaaaaaatacaaaaaatttgaaaaatttcaatcctgtggaagaaattgtttagtaagtctttgaaacaaggggattgaatccaatcaatttctttaaaaaaaaactacgaaataggcaatcctacatatattttataagtcatcagcacaatctaaaagtccatccctaaaattctacttttggataagtagttagattttcaggtgtcaaaaatttcctccatctaaggactaagtaaacattaactcctaaaaatgaaaattgagtaaacattaactcctaaaaatgaaaatggatctaacactacaccaacataattgtctcatctctccactgccttgccgtcgccgaagcaggccgctcggcatgcatctctccactgccttgccgtcgccgaagcaggccactcggcatgcatctctccactgccttgccgtcgcccaagcaggccgcccggcatgccgagcggctacgtggaaggcggcggcatggcagttccttgacagggaccttgctccctatgcgacggagggggaggagggcatcgggtctaggttcctgcctctagatctggcggtgtaggagatggtagggatgtgggcggctgaggcgtagcggtggtggttaggcccgcgcctggccgagcgggttggtgacagcagcggaggtggttgggacagtggcaggtagcggtgtggcatcggcggcagcatcccttcgagcggcgacgagtgtggcaaaggacggtgacggcctaagatccaacggaggtggttccgtatgcagcaacggccctaggtgcagcggcggcctgggagtttggacagaagagggtggcggcccatgacagcaatgacctgagtgctagtgcaaggatctcagcgaggaagaggcagatctcgtcgtcggcagccctaggtgcagcagaggcatgggagttcgggcgaaagaggactgcggtagaggcagcagtaggctaggagttcggaaggtgaaggaggatcccgacgacgacagtagccctatgggcggcagagtcctaagagtccagcgaagtggaatctgatcatgtcaactcgcgtctggtcggctagttttgactagatgacgaattgacgttggatgaaggcgggccaaccagcggcgcgtgacgccagtttacctgaagcggatgaagatgtcaccaatagaggttcgcagtgacggcacactaggggcagtgaggactagacgacttctactcgatgaatttagccgtttcaggagaggattccgagaagtagggatgtgtcgaggtcgtagtttttttttttgggggggtattatgttccactctttattgagatgtgagtctaggtaatcttgtatctttttggctgatatctttcgtagatatagaggtcagattaacgaaaatccattattaaaaaagaactgcactaacataatcggaggtcaactcctctcgtcgagcgtggcacgactgtgctacctccactgcgccaggtgcccacgtactcgcggagagcgagaaacaagacatgggattagggattctaatttttggacatctctataaagaaaatgttggagccattttttaaagaaaaacaaagtttttagtaccgggttttattttgggattctattggacatgctctaagcaagagctccaaactttgactatctctagttctgattccgttcttatgtttatccagctatctactcgaacaatcatttccttattatttttatattttacacttatatttctatcgtaattacgtgtttttattttatattttaatctgacgttttatcatttcaaacaagttggtcgtgcactggtgcctgtggtttgatggctgcggaaatttagcaactactccctccgtcccattttaaatgtagtcatggttttctgcgtccaactttgaccgtccgtcttatttgatatttttttaaaaaaaatttaaaacataaaccacgagtaaagtacttttcatgttttatcatctcataacaataaaaatactaattataaaaaaaattcaaatgagacagatgattaaagttggacgcgaaaatttatggtcacacttaaaacggggcggagagagtattattttggttggtgtctactagagtagcttctgtgcacggtacacccatgcacacatccatttccaattgcatcagcagtgtggtcaaaaaagaaaaatgcaatcagcaattcagcactacagggcacagacagctccacaagcgtgcaaacaaaacaagcatttgcggtagcctcgtccgatcgatgcggcgcgatagcgcacagggggatcgatggatggggacatgtggccgccaggcgaacaccgagccaggcaattggagattgaagatccgtgattgggtgcgatcnccggcctctgcatttgtggattccggaggcacattcgagtgtggggctggggcaacacgcggggcatgcgcaaaacggcgcaaggctccaaggctccggttcgccatcatcccagccgagcaggtcgcttcctctcgctctccctctccctgtccagtggatcaatggatcatgccgtgccgttgcgctcgcgtgttcctttggttggcctggctcgtgctgtgcggcgtgcgtgatttaggattggacctttttttttgttggggggtgtacagactacaggtagtgctcctgtataatccaaagtgattagttaggcggtgccaattcattttgttcagatcactctcttcatcgctcgcctactcataacaagtttaatagtctagacagctaccggcaataaaaaag

SEQ ID NO: 58595 - DNA, 5213 bp, Oryza sativa
agtattaataattataaacttgaaaaatatatttatttaaaatttttaaataatttttatacaaaaaattttcataaaatgtatatcgttcaaaaacgtagtaaaaaaaacaaagaagttggaatttagagtcgaagaaaactggagagagtagtctctctactgtgagtggcaagtgcattataacaagtttaatatatagtatagccaactattaaactattagctctaaattatctataattaatttaaaagctaatatatataatagttacctataaacatatatataatatactacattgttgataactgatgtgacctgtcatatatatatatatgacttcatggtgtccgggctccaaggtataaaacacacaaattctcttaaatttttaaaaatttttaaattgtgagtatatacctaggtatatgaatttgattcatataaatacctaacaacaaaacaacttaaactcaattttatttcacaattcattattacatacctaacgaattatatgtttggatgctatatacttagaaccaaaatctaaccaaaataaaagttcaaacttagttcaaacttgtttgaacatgttagtaaagaagttaatgtttatatcttaatttacccccgctctctctctctatatatataggccgctactcttctatctaattttttatttttttgatgtgtgtttataattgttttatagctgtacctgctatggttatttataggctatctataagagatccatgtcagcatattttcctacatggaagagattaaataaagagagagagcaaagctatctactaacctggagatagtctatagagaaaaacgaagcaatggattagagagctatagatacccatatagacatactattaaggtggtttactattaatctagtcaattgctaagatgtacatattttatattttatagagagcatcttactttatcatcgtggatgtcgttaaaaccacaatgtgcgtggtagtactacatggcagagggtagccagctactctatggcgcctactctgtgccagtcgcctgcctacagcctactgttccgaatgccgatggccgtcgacccgaggtgagacgccatggagccatggagaccctactactcctagtagctgcgactttgacaggcactctggcagactacaccaccagttgatgtgatggaaagatcgagtgccattgcagtgcacaggaatcatatcatcgattcgattctccaataatctgctccacctccactgccatcggcatcctctctagcgtaggagtacagtagtaggagtatgtacctctacctattagatgccaaatgtaatcattttcgtgtaaaacattccaaggtatccaacgtttcaataaatatcttagcctaaatgttaaatttgtacgtgcagtttatattaccatctcccctaaacgaaagaatagaaaataaaaagaaagaatacagaacaggatcacgttagaacggaatattttaagtgatactaccttcctacttccacgtgcgctctctctttgatacctggtacatgtggtaccgattgagtaccggctagtacccgatacctggtaccttgggtgccagttggtacctggtacctagtatatttgctactgactgagtactggctggtacccggtacctggtaccttgggtacataccgcatggtacctaggtatcagaccttggtacctgggtaccaggcatgatacttgtgggtatcagccatgattcctcaagatacccccaaggtagtgaggtccggctaaaagccggccgcgaccatctccaggaacacgcgctgcagcaacttcatcttgaagttggcggcgaaggagacgaggtaataatcctaatcgcatatctaaaccaaagaagatgatatttatttggtaaagcgcattctattatcgtattgcgacactgctcctatccctaacgctagctctgttgacttcattccttgtcggtgttgcgagcccctctactttacgaaacgaaggaaaatagcaatggaatgagaggtcccagagtaggttgccgccggtgttgcgacaaccaaggcaccgggaccgctggcttcttctccttctgctacggcagcagatgagccattggggcgggcctaatggggggggcatggagcctcagctgaacaactcctccaaattccgttcgaagcaagctactattaaacccaaaagagaagctttcagatctaccagagaagttgagtttgaggcaaagaaaaaaatgggaacgatgagaaagaggatggtcatacctacactcaccgacaaggaggcagcgggagcagcgggcaaggacggccgcgctggtggctcgtgggaagcgggcgacggagacatcggcgttgctcgacgcaggcagagaggaggaactcgcgggtagacgagacaaagtcgaggcggaggggaaggcggacagaaaggttgcccatgacggaggaaagagggagacaaggggagtgagtatgggagtggggattaatttatctcgcggcaacggaatcctttgggttagtttttctcaaaaaaaaaagattttgactgaaatccaagtgcaaaacaaataatcgtaaaacataggaataatcatttgcttggaccacagaaaaaacacgctaatcaaataagagaggtagtctcgaaggaaatttttcaagaggttagaactcaggaaatttttcaagaggttagaactattactatgttttctccaaaatctctatagtactgtttatttcatatgaattttaaaggatatgatcgaattaaatcatttatttcaaatatcttcatatggaatttcttataggattgaaatcctccaaaattcctatatttgtttacaaatcaaacggacccatggacagggcccatagtgtccagttatatttgtggatacttaaattatgtttactcccctaaactttttctttggatcccttaccctcagcaaattatttggctcattttacactaacctattaaacatagttcagttaataatatttatcttgttttccactttatacaagttatattttaagctgaaattattttatcgctatagttgacaccatcatggatgttcaaaaatattcttaattttttattaatgtttgctttctttaaaatctagatggtttcaatcaatcttaggtgcttcgaagcaatgtaaacaacttcaaaaattaagaaaatttcgagatgtaagttgcaatgcctctatcatcttaccaaaattctattgcaaaatatgacatatatagagagaggaaaaggagaaataccgtcagagattaaagttagtcatttttaatagtttaaggtgtaaaatgacaaaaaaataatttagatgattaaatgctcggggtgaaataaatggactttttttccatacaaatcgatccacttaataaactttaataagttttatatttaattataattagtagtaccgagtttcgatagaaccagagcaagaaatagcatccggacatccaaaacatgagatattttgcacagtaatattgcccagaggtggtgggccgggtggctaataattggtgtctgcaggtggagtcatcgttggtcgtatggactcttaatatttcccaatatttttaggagctctttttagaacaacttaggaatgatgtagtatatataatacaatgtcatgaagaaaaataaaatttggatagaaatgcatgtgcatgtgcaaaacagaaggttataaaacgttgcaaaattctaggaatgattaatttgcatatttgcgttgtttggatagatcatgtaaaaatacggaaattgtggagagagggatagagagagagagaaaaggacgggcagctctagaaaatagtatcattatgcactattcaaatactagttgacgcaatagttagtagtttcaatgcatgttcgagctcaatatgtgagggggccagtagtactaattgacgcaataattagtaacaaaatatttcccatgtttttctacgaaatatatatatggatgaatatatgttatatattatataaatgatggataggcatatgctaaaaacattgtgtaaatgatgtgctcttaattcaatacaattacgtacggtaacaattattaggaggccaaacccacctcagtcgaaagaaggtctggtgctatcatcaaagagattaacaagaaattcgatgttcttgtaacaaaggtttcttttgaagttttcgagaaattcaatcttatgagaaaaatttctaagtggtcctttgaatcgaaggaatagctagcaacaaaactcctatgaaatttcacgggttgctcaacacatggggatatttgaggaattttaacctgaagttaaagttctaggggaaaaaaattcttgagtctatctctctcttgatctctggtttttttttctacgatagatctatccaaacagttattcatgctttttttgtgtgtttttccaatttatagattaggtgctaaaacacacaatcctatatttttccaattcatgtgtgtttaagaaccttatgtttcaaaagtttatgagattggaacattttaaatgaattgcttataattcttaagtctatatttttcgtttcagtgaccagatacaaaagtattccataggattcaaatctaacagaacatgaactttttgacaaaattttgaagaaagtgaactaattcttataaaaaatcttgaaaaaatcattgtaagaaagtactcatttatattataagactttaacttcttttcttagtcaagctctcataagttcaaattaattttattaaatctaacattgaatatatcttggtcaaacttatagaagttaggctaagaaaaaattgaaacgtcttatactataaaatagaggaagtacacaatatatattttgctaatcccttttccatacttaatagtataatactttatccattttaaaatataaagcacaactataactaacaaaaagaccaaaaaaattattaccttctggtttaaatcatcatttcaataaataccatgcatacatttaacagacttagatatcttcaaagtaaagattaaaagccaaaattagagaactagttacattatatagttgcgc

SEQ ID NO: 58596 - DNA, 4716 bp, Oryza sativa
ttgaccgccaatattactaaaatatataatggagaactagctatgcttataatgcatatttgttttcaaataatatagttccacttatacttggagaataacatgttgcaggaatttatcaaataaaataaagagaaagtgaagagacctcattcctaagcaagcaaatggattaagataggctcacaagtcaggtgtaaccgtcggaaaccgactttcactgtcacaaccgcctaaggaaccaacctatcagtgcctgaccgaagctggaggcctactagacaggcccaggtttgtgttcggccgaaccctagtggcgacggctcagctcggccctccatgtgtacgctccagatactcttccaatgacggttacaggggcaaaaccgacatttcgcgttgctacaaccgtcataccggccctataaaaggaggagctcattcactctcttaacacactcaagcaagctaaattcctctccatacattagtattaatagtatggtgctaagaggaatagtatagaatagtgttcgaaaggcctcagagtcttcggaagagttttcaatatggctctagcagctcttgtaatctcttttgtaatactttccgaattaatgaatattcttctttatatatcttcggcactttgcttagtctgagtactggtcttactttatttttgcattatattaattgtgtgggtagtctaccagagaggtgttatggtgcgggtttaatgtctgatttatcagttgctctatgtcgactgcacgggtatagagtagtatttgataatataagcatggtgcttagattattaaatatcattagttgggcatatatgctgcgggacagtagaggtgggccgctgatggtgacagctcagtacggatattcctccatgttagtatatattcctaagataaattcctggggagggtactcctccgtatttaacctcggttggacggtcatgacatgttatcgtacggaactcggcaacccggggtggtctttcgaagtaccaggaggacactgttagggggtattagccacatgattgtacatttgcatatgcaaactaggatttgagtgtatactagaagtataggaattgaatgctttctatttcttcttccacttacttagaattatttcattacgaggattgaatagctttgcttcatgtcactctacccttatattacatttaacccctatttaggctttgacaattataagtaatatacgtataaagtgcattagcaatgctcactcttattatcttcccttgacattaaaaatacgataccttgaagtacttccgggtgaaatgctataatgatatatccgtgcgcttgcggataaccataaatataccaggactatttctggcgcaattgctaggaatgaatatttctagtaatatcgttaagaaataccaacactggctactgtagagggatggtggcaacaacggcgaccactagctccaccgaatcctaaaggagatgaccggatctagtggcagcaggcaaggaagactagctccaatgatgataggtaaggggatgacgttcatcggtgcggccatgaggagcttttcggacattcgatcaagcagtggcgagtgaggggacactaacttggtagtactccctccctccatctaaaagtgttagacgtaggatgttactcacaattaatcttttcattagtgtagaatagatatggcaatggtgaattcaccatcgggggttacacccgcgtccccgtcaccgcggtgaaaaaatttcatcgtccctgtccccatcaaccacgacggggctacaatttctctggccccgatcaccacgtagtgaatttttcccgtggtgaacccgtccccggttaaacaacatattgacagtcacattatatcaatatatatccaaaatactccactcaacaaatcaacaaattatagatcacaatcacatgaagacgaataactcgatggagaagaactagaggtagacgtctatcgagtacagagaagggattagggattgtagcatgctcaccttgcatcgtcgctgtcgtaggctcgtagcttagggggggggaggccgaagccatggtcggcggatggcgtgctgacggtggacgacgtgcggggctatgggcgagtgaagacggagggcgctggcggaagtcgatggtggctcccggtggcgcggcgacgtcagctcccgccggctcccggtgaagacggctgcaagcgccgcgcccggcgccgtgtcgacggaggctgtcggtggctcccagtgaagacggctgtaggcgcagcgcccggcggcgtttcaacggaggctgctggcaggtcctggcgatggcgtctgccagcgacggcggattcagtccatgcgtctcccggcggctcccgacggacgcccgtgccgtgcgagagaaggcagcgagcggcggtgcgcctggtggctggcggattggaggtgcatggcggcgtgcctggctcctgacggactggcggatggcggtggtggctagcacgggctgacgggcgtgctgccgtgtggatctagagggaggattggggattttggatggaggatttggagtttgacatgttgatttagggttagcttttatatatgcctagtaaatgggcttcaatattatgggccaaaacgtctaaaaagtctaaatttagtcctctgtacagtaaaatcgagtcaccgcggggtccccgcccccgtcatccctgatggtgaaaggtttttaaccattttattccccatggtgaatacatattaaccatccccgtcacctaacaggtgaattcaccgtggagaaacggtgaacggagcctattgctatctctagtgcagaagcatttttagtttggtcatatgcatgcagcatatacttgtataggtcttgcatcgtggcatctgagaaagtgcatggttgtacgtgtgatatgtgcgtgttgagagctgtgtggatgcggctgcacaagaggtgtcaaatatctgcggggtggcaaggcttatacttgtactcctttcgtccaaaaaaaatgaatctagaactggatgtgacataatctagtacaatgaatctgggcagatgtatgtctagatttgttatgctaggatatgtcatgttcagtactatgttgattttttatatgacggagggagtatgtatctacgtgatttagttcgtggctagagaataggtcctggatcgtggctgtgttgcgtcagtctcgccgaagttgattggctggtttgttattgctttggggtgtgtttagtttacgccaaaattagaagtttagttgaaattggaacgatgtgacggaaaagttagaagtttatatggctgtgtttacttcacaccaaaattggaagtttggttgaaattggaacgatgtgatgggaaagttagaagtttgtatgtgtaggaaaattttgatgtgatggaaaagttgaaagtttgaaaaaaaaactttagaactaaacacggcatatgtgtaggaaagttttgatgtgatggaaaaattgaaagtttgaaaaaaaagtttgcaactaaactcggccttgctcgtatgaatctatataatgagaaaatgatgagggttgttgtgtggccatatcaaccaaaagcatgtgtgatttgttcagctgttctgttcgtgtccaccgactaaacaaagctacggctgtgtttgtgtttagttcacactgaagtttggaagtttagttgaaattggtacgatgtgacagaaaagtaaggagtaattcccaacataggagtattaatatttttatcattaagatcaagaaaaaattaactcatccagtataaaataaatagtaaatagtgtatacatacatataatcaatgagtattaaaatgagtactcgtattttggtcaactatttaatttatctctcattacattttgaatatatgcagactgcaaatataattatcttatttgatggagggggtactactggtcctctttgtctgaaatcgacgggtagcaatgcacgctgcacgcccagtgaagacgacgacgacgcgggtccacggccgaccaacagctgaaaagaaaagttaaacaaagagcgggaaaacattaaaaaagcgagcctaaatttcttatcctttaagaaatttgttgtaccttatatacttcctgtctcctcccctcctcctcgccaaccacaccacatctcaaactctctacacacgtttccatgtagagatcgatcgatcgatttctttgggattcttgagctcatccatccatggcgccctccttctccatccggtatgtagtttgatgctttgtgttttcttgttttgtttttttaatttttggtttcttgatattcttgtttcttggtttggtgttgactgacacgaaaaagggagtacgcggcgagcatgaggggcacggcggggttccggcacccggccctctccgccgccggggacttcccgccgatgccaatccggaggttccggtggtgggtcgacgagctacacgccgcggtgagtcgtcgtcgtcgtcgtcgtagctcgccggcggcggcggcgccggtggccaggaagacagcaagcggtcggtctcggacctgttcgccgccaccggtgaagcgccgaccatggatagccggcggcggaagaatccgaggt

SEQ ID NO: 58597 - DNA, 1336 bp, Oryza sativa
ggctgatttcaatttcttagggcattagcaatgcgctattgaaatatgccaaacctcaccagccacatagaccaagaacaatataagctaaatatctcacaatgcatgccacttacaatgggtcccactaatatcaacttaacttttcatctcctctctttttctttccccaacaaccccaccaacagagaagccaagacgctcctctttttttttcccaccacatgagcggagctacattggcgtcgagctgcacgatggatgacagtggcggtgccgagcggcggatctctccgtcacaactccggaccaccacgagcccctctccgtcgcctccctctccctctcttgaagacggctgggtgtcgaagccgcggatgacggcagcgcgggaggctcctctccctcttaatcgtctcactcttctgctccggatcaacctcgagctgctctccctcgaccacctctcggtagcagcggcatggagccacggacgacggtggcgccgagcgacggatctcgggaggctcctctccctctccgtcacctccctcgccggctccagatcaacctcgagctgctctttctctcccccttcttggtagcggcagcgcactgagcgtcatggcagtgacgcggagccacgaatgacggcagcgacgcttctcccctctctcccccttcttcacctcttttcttgtgggcccaaacatgcgattccgacaacgagatatgtctagtggagatgaatctttgagttggctggataaggaagaacgacagctaggtgcactgtgaatggtcttattatacctactcccagtgactaagcacatactgacatacacgcagtcaaaacactgagggaatcttggaccggggctcgtctttttttcatgctctttaacatgatcttgattctgaaggggattggcccggtgataggccgcaaatcgccgtcggtggtagactgcggtggcagggagttcagacttcagacgacgacttcagacgacttgcgagtgcgtggctggcacgagtcctggtcgacgcttgacgtcaagaaatctcgcttgtggaattgtggtgctctcgacataggccctcaccctgttgatgcgcgtcggcttgtccgctaagaaaatccatccgtttcatattacaaatcgctttagtttttttaataaaactagcatggtgccccgcgcagattgtgtggctagcatcattatattttctctcatataatagcatatatgttttctcattatattattcaaatatattaaaatgacattataattttaaattttgcaataactttacgaaactacaa

SEQ ID NO: 58598 - DNA, 5957 bp, Oryza sativa
ccctctatatggactctatactctacttttaatattccttatttttaattcctaatttctattattccctaattgtatttttatatatggactctatactctacttctaatattccttatttttaattctgaatttcagttatttcctaattgtatttctatatggactctagtctcctcttctaatattccgtattttttaattccgaatttcaactatttttaaattgtatttctatgtgtactatagtatcctcttctaatattccttattttttaattctgaatttcagctatttctaaattgtatttttatacggactcaaaactctacttttaattttattatgtttattccgaattttagttagttttaaattcatatatggactctatactctacttataatattccttattttttaatttcgaatttatattttttcttaattgtatttctatatgtactctatactctacttctaatatttcttatttttaattccaaatttctattatttcctaattgtattttatatggactctatactctacttctaatattccttatttttaattccgaatttcagttattttctagttgtatttctatatggattctagtctcctcttctaatattccttattttttaattctgaatttcaactatttctaaattgtatttctatatgtagtcaactcttctaatattccttattttttaattccgaatttcaactatttctaaattgtatttctatatgtactctagtcttctcttctaatattccttattttttaattccgaatttcagctatttctaaattgtatttctatacggactctgctttttttctttttctccgattaatgtgagaatttctaggccatgagagcaaacgtggaggctcctttttctattcctttaataataatataatagatgtttcaaagtttaactacatttataaaaaaatataacaatatttttaacacaaaacaaatctactattgaaatatattcaatgttatatttaataaaataatttttgtatggtagatattgctattttttttataaatttggacaaatctaaaaaaattaaaacaactcgtaacataaaacaaatatggagttctaagaaaaaccggttgcaccataccttgacctcgaggctcaagagggtaccgacaaaaccggttccttccatccataggtgtagccccacaactacattgcaaatagcagtagttcatatattacacagtcaaatatattggggctttttttttctaaaacagacgtattaggatttgggagccacatttttcctgtgcttaccaaaattcagcaggaagggatgcattcgtgcatgtgtttgtttagatggatgggaaagtaggattcctagcccatccacatgatgggccaatttttttaaaacaaaaatcttaaacccatacttgctgcatacatgaaataataataattaaaaaatctatttccctctttttttctctctcccctcttgtgcacggtggctactgccaccattttccacttctatccccatctccagtgcttttccttggccacaaccaacataaagaaacgcaccacattctcttccatttccttcgccgccgaaatcgccgtcgtcggagtcaaaagggccaaagtgtttgtccttaatttttctcctatttccaaagtcattcggccaccaaagctcgtcgacaacacacacccaccgccccacggcaaccgccctgctcggccttgctttgccactgaccaggccacatgacacaatccacatcccgaccacctcaccccaaaccgccgctacaaggagctccactggactttcgtggtggtcaacggcagtcgcaccatgcatctggaagctcttcggagagctgccatcttacatggcaccactatttcagctgctcgctgtcaccaacttcaccatcgactctctagccgcctccttcattaccacaggttgtcatcgctacacgctccgcctgcgccaccgctgacgtgacgtggcgtgggttggggaacaccttgtagcgatgtcacgggcaaggtacaccggcggaggcacggtggccgagggcaccaagcttgaacgtattgagaagcaccctcctggcggcagtctcatcagttttgggcaaaatcgtggcggcagtgtctgatccccccactgtcaccgcaatgccggtgatgaggaagatggagaagagaagaggaagagggagaatgagagtgtgttgcatttttatttctttcccatgtatctaatatgtgggtctcaataatatgagtgtcaacgtgacaaatcagagcacagaacgtgaggaacccatttgggtaagtacgacacaaggacaaagtttgaaaacttgaaaaataatttttagaggtttggggacttgaatgatagaaccgaaaatgtttaaggatcgcccttatagataacatagagaatatagtggcgatggcggtctcagccagatctggacgcgggcagcagttggtgacgatagccacggtgtggtgacggtgccggcggcggcagttggcaacggcgacggcggtcgtggatgtggtggctgccgtgtcaactggcggcggcggcggcggaagacatggcgtcgagcagctagatgctcggtgttggaggacgacagcgcagcggcagtttgcggaggcggtggttggtgtcggtgacagcggcgacggcggctgcgactctggaggcggtggcgacgtcggcggcggggaaggagtcgggtgcgaggtggctgggtgttcggcagcagcggctgcggtggtggtgaccgtgtttgcggtcaccggaggcatggcggcctcggttgactagccgagggcgtgggagacggctgcatctggtcggcgcggcatcgttcggtggaggggtcggagaccggcttggcgtagagaagcgcagccgatggcagcggaggcgcgggcggcagagatggaggccggcttggcgcgagaggcgcggcagatggaggaaggccggattggcgtgagaggcgcgtccggtggaggaggccggcttggcgcagagaggcgcggccggcggtggaggaggcgatctaggtgagaggaggagctgccggtgggtgtggcgcggtcttcggcgcacgaaggctggccggcgggtgacgccggtgcaggggtaccacatgtcggcaaagcttgtgtggtggtggagcaatcggtgcatcagccgtggttttgatctcgtctgtgcccctttgtgtcacgccccgaactagccccgagcggaactaacccgtgacgctccaaattaacctattaatcgataccagtcccaggaaacagtgctggtatcacaggaagacagaatatcacagcaacagaggtctctttattatagagtaggagtacagtcatgttgggctgcggacagatcccgagctcacaactgcattacaaaaagggaagcggaagccaagacttggaccaaatatcacagacgcgacttgggaactaggccgaaaccctaaaactcatcgtagccgacctgctcctggaaaaactcctcgtcagcaggatccgcttcatcttcttcagcaacttgggggggggattatttatatagagcaagggtgagtacaggagtactcagcaagccatgggaaataagtgtttaatgtaggcttcaacgggatggcggttgtttttgcaataggttttatttaaactcttttcttcaacaactaagtgagtgcttctcaaacgacacggatgagacagtgcgtctcgtccggtcggagtatgtgcaaggtatcagtcttctgaattgatcaaggttggcgtccggccaacagctttcaaacggccacccgggcctggctgatcccatcagccgcagattttccaaacatcgaacccaaaccacatcagcaaatttcacaaagcagtagtcaaacaaaactacgctaggaatcacctcacatctgcctatgaccgtgggcacggctgttcgaacagtttaataacctctgcagagagggtacactttacccacacgacgttactaacccgggtcacccagcccgtgcagaacagccacgtctggcgactttgaggctttcacgacaaggcatttccaaagccgacacatgttcaccatatgccaacgagaggggtcccagaccaacaccagattaggtcccagaccatactgtgccaggaaacccgggggttctccccgacaccaccgcgttgaatccacatgtctcttggcatcatggctcccccgattagctaattactcagccaggggcgtcccattacacccatgtggtcgcacttgtcttatgttcggatgaaattccaaggaaacggtccttagtgcaagagcgggaaaccatacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtacagagtgcacgattaccgaggcgcaactaggtggttacaagggaacatgatataacaattaacaatggaaggatcagatgcaacaagttaggtaggcccaccggtctgcctagcaaacggtgcaaacagattaagtgcaatcctatcaatgcataatattttgcaagcaatataattaagttcaaatataggctcaatatgttcaaaggtggcttgccttgctcgagatcttgagcttgatcctcgaattcctcgcactgcgggtcttcgggctccgaaactacacgcaaaacaggaaaactcaacaaacggcgaaaataaagtcctattattgacctctaggcgtgccattagatagatctcgagatttgaggagttttggaagttgaacggagtcaaacggacttacggttggaaagatattgaatttctaagattattggatttttgatctaaaggaaaaggatttatttaaatcctttttgaaaaagaaaagaaagaaaagaaggagggagggaaattagactttcctcgggcggctagggcgcggcccgagagaaaggggcggctcggccgaacttaacgggccggccggcccgagaaggcggcctaaaacatgcgcgcgggtggggaggagagagagccggtgggccgggtccatcccgcatggtctcgggtaggacccgcttgtcagcggctcggctcaccgtgagcgaggtgcacgcagggcgtgctagggtttggggaggggaggcgcggcgcgtgcgcgcggttcgcggaggacgcggtgcggcgggcccacgcacagcctcacggctcgtggtggaccgcgtgcgcgagtggggcggagggaagccgcggaccggggtcagcttgacccggtcgcggccgaggtggcgcggacgtggcgcctacgtggctgccacgcgggccggtgggaggtagatgacgacgtcggctggaacggacggcggacggcggtggcgagcggcggagcgaaccacggcgatacaggcgaaagcgagcacaccgggaggttgcacaggacgaggggagacgagccaacggctcggattcgccgggggatgctcgacggtggcggattgcggcggcggcaaccggcggcgagggaagggggaaacggcaacggcgcgatgggagaccgattcgggcgtgctagagcatctacgcgactccgggaatccgttgctagcgtcggattgggcggagctacgccgagcgaggccagcgacgagcgggcgctacggagcacgggcggcgacggcggcgagcacacagcgagcggcagcaacggtcggggcggcgccagcttgctacggggaggctactcgagcta

SEQ ID NO: 58599 - DNA, 17236 bp, Oryza sativa
  unsure (1)..(17236): unsure at all n locations
aagaagccgaggtcccaagaagacgacgatggtgtcgagaagatgaagaagaaggggatcttcatctcctccacaccaaatgctccaaaggtaactactagcacggtgtgcgtggggtccatgatgtcatcgtcctgtagctcggcctagctttatgaaacagtgcatttaaagctcctagacttttcttttcatggaaaatttcatttctgatcctagtagtagaatatatctagattagctttctgctcttgttagactcctaagcaagataaagttaattttagtatagatatagcttggattagtgatgggcgtgaagctagctagcagtagtagtagtgaactagtgattgattgctgctgttttcatgtttgggttactggggtgcagtgtgttccacttccaccaacacactagtggcctgaaacttgtgcaatctgaggctaattggcttgattgtttgcgtggtttgattaattagtacacatgtgtaggtgcagacatgactttgtctgtaatcttatcttagggagagcgttatatttcatgtaacacgtgctactccctccattccacttaatcaccctatagtttttttagttattctcaaataatcatcatattaatattattttccaagtctattcattatatgtacataggagtaaaaggatattgatatatccatgcacataaccctttataaaccaaaatacaatgttttgatttgtggtttgctagaaaatagtatggatgcatgtatacatcaagtttgttactgaagttaaatgtagtatgaaaagttattatcttttcttggactcggccaagaaaactcctctacccaaaaattagttttttttttgttggaacagactaattaacttggagctgctaaatacgcacctctacgtacggattatgcagtgaataacgtgttaagttcttggatcgtacaggagcataaatacttaattgctgccattattattccatgcttaatagtagtactcctgtatttagtttgcaggagatcgatactcctagatagtactcctcgaattaattataattactccttgttcacagtagaggagaggaatcgatcgaattaagttcacagtggcactctgcagagtcgtactaacgtggcgctagctgcgtgtaatactgatggatgataggacagaaggcagtagctgtacatgacaagtagcagtcctagtcttcattggtactagtgtgcatgcgtacctttgctgtaatgcatcttgatcgaagagttactgctccctaaatttccgtgtccaatgtttgactatccgttttatatgaatttttttttataattagtattttcattgttgttagatgataaaacatgattaatactttatgtgtaacttgtctttttaatttttttcatattttttttaaataatacggacggttaaacgttggatacggaaattcagagtttgtcttttttttttttggacggagggagtacacttgtgagtagcattaattgttttatttttcttgttttatttcatctttaaatctttttagtggagagtcccttgatcatagaatgcttctagctaagtacccatttggccatttccatagggattctctccctatttttacatacagaggattagaggaaggcatataaatagagaggtatggagtacaaaatatagacacatgactgaagtagaaaataataattttggggtcagatttttacacttggtactcttaacaatttaagttaaaggcgacgctgaaaaatagaaagcgatgaaaaagaattctaaatttggcaatttagatcctctacagtactgctcagtgacatatgggcctgaggatctatggacccgcatatcagtgagaccttcactccaaatttggtggtgtcttataagcaaatgagttggtaagtacccaccattcattctttttttggtattgttttataatgctgcaatgtaacacttgaaatctttaacacactaatatattaaattgttaaaatttgatatgtaaaaatggcataatagatttgtcataaaaaaaacttccatgcaattaataatattataaaatataattattaaaagtaatggtacatatatgtattatattggagagattgtcaatgtaataaacgatgagtaactacaaaatggaggggatatgtggacactccatgcattaaattttcaagttattggcttaaatgagaaatctcttgcagttggctaaataaaacagtattgtcgctttttagatactaaaagcgagtctagaggaaagtgagctgggcatatctataaacaatatatgcaacaattccaataagtgggttagtgtgtgaagcactagtccttccatgcagtcaacctttcaaaattttttattactcatatttatttatagaaatacctgaatttatccatgtggatgaacagcatatatataataatctgtaaaagcgttcccatgtcattgtgtgttcaacaactttttttaacatataatataactagaaaacatttgtggccaacggtgtgtattagactgtgccaacgtcactactatagaaatggtcttcggaatcggtggcaggtaatggagttgatgggccatttgttgtactggctgaaggagctctagagcggtgatgggccagttgtggcttatatataggtgcagctgtgctttaggcccaaatgctagtggctagcgcatgtaaatgggcgaagtctaaagaccgaagaggtcatcatgagtcttcacccattttatctgaacagctccattgggggtatttcccggtgggtaaatttcttgattttctcattcattggacttttggatctgagatgtatgtggatatccaggtatacatacatctcagattgaacagtgcctacatgatacatctccctgtattatctagcggttatagcatcattaatccagatttagcaaatgagtagtataacttatgttattgacaagattgacaactttgtagttgtcactgtttttatttgagagcatttctgcacccggaaaaacatgtattggactggacttcatttttggagctctctggattcatgcaaacttgattcttcattgtttctctttgggagtcctagaatgcatccatcccacgtgaaggaagtataagaagcaattaaacaagattctattaataaattgtgcaatgtaagtgtcctaggaaatagatattgatcagtttcagtttttttctctcaatgaaacaatgggaccggctgatctgactacttaggtacattacaatagaagttgcagaaaatttacaggaggaactttgtatgaatccacttcctagtccattctgaaaattgactcaaattgagctcacttagtttgcatgacaagcagaactaagcttctaactctattgctgaaaatggcataaaaaaaacctggttataaataggcaaaatttgctacaggacactgaaagattgcggtctttgctgtgagacacccaaagatcgtgaatctttttgtggacactgtaaaaaagtggtaattagctgctggacacttctcccattattttattatttccggtcaaaatggagagggaaagagttgtgtaagtaccaaaatacccctgctctcttttctttcttttccccttcttcttcctcgctgagccgagcagaggcgcgacacgcgcggccggcctgagccgagatagctcggccacggcggggcggcggcgcatcgccggggttcaccaccgacaacgaggatgcacggcggcatcccggcgcatggcgcggcgatgcacggtggcaccgagctctcggggagctcggcggcggcgcaatggcgaccgggccggcagggatacggcaggagctcattgatagcgattagggtgttgttgatgtagcagaagccactggccttgcacgcggacgcgtggtgcatgccgccggaccagttgatggtgatttcgaaggcgccgtcgacgagcgcgcgcgccgcggcgagcgacacgccggcgtagccacaacaatacttccatacttccagaggcggtcgaaggtgggcaaatcatcgtcgccgccgagtaaaccaatgccgtggtcatcctccgccttctgccgaagcgcggtgtcgttgacgtagctctccggggtgaggtcgtggaggaggtccgatgtcgccgccgcgtccgacgctgccgtgaccgccgcgtaggccgtcgtcaggagccctgtgatgagcgtgccagagtcgatgaccatgccgctcgagaacgccgacggcgggatggcgagcggtgccccgccgacgctgatgccggtgagcgtcatgacgtagaacgtcggcaccgaggggatgcagcgcatcggcgtgaacgagaagccggctgctgtgttgctaccgttgggcgcgccgagggcgaggaacccagtgccgccgctcgtcggcgagaggcagtacgagaagggcccgccgaattgggaggacgtctcctgtctccgacacgagcaactccggcgtgccaccgagaccgaggaggctgtcgaaggtgaacatcggcgccgcgttcttgaacctggccacacacagcacgtcgcccacgcagtagcggtacaggccggagtaggtggtgacgacgagctcgtactcgtgtccgagcttgacgtcgacgaggtcacagtggtcgggctccggggtggcgacgtcgttgccggagttgatgaggaggaactcgaagtagaacactgttgggatgagggtgtaggcgacctcgctgggcttgcacagggggttgaggttgagaacgtgctggtggtcgacgcagcactccagcgttccgctcggcaaaagcgtcgcgttgctgtcgaagaagaacagagaaagagaggaagaagaacggagaaaaagagattgacaagtgggtccatgggtaaacttgtcttaaaccaaaatttctctctccgttttcatcgaaaataataaaataatgcgactggtgtccaccagctaattaccacttttttagggtgtccatgagtaaatacacgatctttgggtgtcttacagcaaagaccgcaatctttcgatgttctgtagaaaattttgccttataaatatagtgctacattttaaagtttcaagtgaataggcaattctgacaatccgacaagattgaaaagggacttccaagtgattgcatcattgtaatatttcctgacctaattatagtgaccaaaacaaccaagtctgtccgtccatgcagtttttaagtttatgctgtgtaatgatgcagtgatagataccatatataaagatatagtgactatgttgcaattatttaatctgcatatatgacttaaccctcatggtcgtgcaactttccaggtttcagtaaacaagttacatcctccttctccccagacatttcaggtacatgaaagacaaaaacacatcaacatcgagaatatgaagatgtatgattttgaaatatggaagccagagaactctgctaaggtcccgaagaacagcattctgagaaagcatacaaagcgctcctctttcactgtcagcatcaacaaggagaaatgcagcaatctgaaagggtcagaagccatagagctaagccacaagttggggaagcatgttacattctcaggggtggatgacatacatattagaaacaagctaagttccacgttaccccaactgcaaaaccactgcaatgtgtactcagacaagtctaatgaagctgacagattagtatctgcaaaaattagttctcatgagaacaaggaagcctcaggtagggatatatacgacagatggacttctgaatcaagtggtgcaaaggacccaattaacttgattgatctgaatcgcacgctcccatgtattcccgattttaatggcgcattcatttctggttcagaggtgcctgatcttgagcatacggagaatgcaacttctgatctccaaatacctggtgatgtaagagaagaagctgttcttaagcacaatcaagacctccattccaaatcaccgcgatcgcagtgtgaacttaacagttgtgatcttgggagaatcattaacttaagatcaatagcctcactgttgcctgatgaagcaattaacatttctgacagaggaatgattggtcatccattgaactcaacagaagttaataagttttatgctgattatgagagaagttcagtaagagatgatactatggaaggaaaggctccttacatattgcctcagcatacagttcagtacacaagtcagtttacggagaattggtacaccaatatgaatttgggcaactttcatcatgctggaagagaattttcttcttgtccatgtgaaaaccagctgaattctgagaaacccatgttacattctgaaatcaatgtgcaacatgagcatgcagttatgtcacaacgtaccatgcgtctgatgggaaaagatcttacagtttccacaacaggtggcaaatgcattggtgagacagcaaaggtgcatgtgaactcctctgtcagctgccatcatactactaatattttcttagagttgccacgacaaggtcacccgtttctgtcactgcaatcccgaagtttttccaatatacaggtagatgccccaagcacaagccatgattatgttggatacaaaatgcataatttaaagcgtcgttttccggaagctgatgttttctctgggaatggaatcgaatgcgaagataggttgagggacttttcatatttgcactgtggccaaaatgcgcttgctggattttcacctcaaggaggaaaatacaacacaagatctgatcaaaactcactgtctgctacaacattcttgcctaccttgataccacatgccaagcagtcagcagtttaccgtgccaattcaacttggaaacataatccctatcctgcaaacttactagttcatcctcctgatggtacaaattttagaaaggatcaaaaccagataatcagaggagttgcagagatcccaagttctgtaaacccatgtcaagagatactgtttggaagacgagaaaaatagacgtcgacaattctaacatttcttctggtgtcaggtatatttcaaggtctggtccggtgaagctccgccccggggcgaagcatgttttggagccgagacaagacacagatgatggcaattatccacctatgtattcatgtgtaccgtttttcgttataagaaggggtggaaatattttgtctggtcagactaaaagtcatagaaaggtctaatttgtagcccatcagatgaatcattcggattatattttgtcccaatcaatggttatggctcaaacttttctcaagttgatgaacagtgtgcagctagttctggtcttctttgacccatagtttgctgtactagagccctgtgaaaagaggactcaattgatttgggaggttcttacttttgcgtcgacgcatcaagcattacatccatcaagtttacttcaacagaatcctggtggcaagttaccatttccatgtaagtaattactaatgagattgcaaactttttcttgctctgctggtactaacttggttacagaattttgcagcttgcctgatgccctgatgaccctgcacctgctatcctctgtgcctctctggctatatcctcctctgaactggaggtttttgtgttgaattatttaggttcagagatttagaaacatttatggattgggatagctttggcataatacaatttttgtgtagtcatttcatggactgattgatgagtgcattgtcatctactctctccgtttcacaatataagtcattctaatatttttcacattcatattgatattaataaatctagacatatctatctatctagattcattaacatcaatacgaatgtgggaaatactagaatgacttatattgtgaaacggagaaagtactatgttccttctcaccattttccaaaagttgaggaaatatactgtggtggtagttcactatctgtcggcctatttctgtcattctctacccatagctatgactccattgcatactcctttcctttgccaaggtgtgatctagccacatgcctggctaacctgcatcacttccaacttattttccctggaatagttttgtacaggtaaatttgtggttgatcatgtctgaaatagtggtaagctggtcggaaaagatcagattcgaaaagctatttgagctcgctccaatgctctttgagatcaaacagcttgttatacaagaactctctccgattataaatattagatgtttgggacaatatttgaaactttaactatcaataatttgtcaaatatttagtttttttaaaagaaaatggtatatgtagatttgcgttaaaaagtactccctccgttttacaatgtaagtcattctagtattttccacattgtctagattcattagtatcaatatgaatgtggaaaatgatagaatgaataatgtcataaacttgttaaattttataaacttattctaatatagaacaagtgatgaaagtttcaaactgtacctaaatcttgtcctatacgttcgatatttaggtaatttttccatcctggagtctcaagtatcagggagtaccatattttctagtgcaaaatttggtacatccaaataataagtatcttgaggtataaacaattttaatgtaaaaatttagatactcgagattctctctctaggatcatcaaatttcttgaaatatttatgatgagacggactacatcacagcttgcgtaagcaatagtacatcacatggtttggtttctgccttctttcctgcatgaacgctgcaaagaaatcaagttaaggtgcattgagccaatggagctcccttggggtgtgaaagctgaaaggaagaggaaacaaatttgtatttgtgaattggcagggaccagcaggtccactgctgccattgatgtgtatgtgctacatcagtggcatatttcaccggattttatcaagaacagcactgaccaaatccatgtcctttcgccgtcgacccggctgtcatcgacttccgtgccaccaccgttgattggcggtggacggccgggaagacgggcggggtggccgtggcagaatagatctttgaacggtgactttgagttgaagtcacgaatttctgatttcagactatgcgcagttgatccttaccaggagtacaatagagtcgaagccggcacggagatgctcagataagcaagccctagaagaaacccaccagtcctggagccagttgccacgaggaggagagagggcagcccaatcagaaggcgacagtatacggagccagacctgcggagcgaatgcgtgttccacatgttgctggtatacgcaagagaatggtagtcaatgtgtggggtatctgattattctcgtcaatgcgcgacattctccataacttaactaatgattcactattaacctttaaattatcgtaaatctatagatttaaaatgatgtatcaaactatagatttatcaataaatttatcataaaactatatgtttaagactaagtatcacaaacttacagattatgtagattaagatttggtccggttcttttctccaacaagagttggatgaagattaagatttttgtagtacgcttttcaaactgttaaacggtatgtttcgtgtgaaaactttctatatgaaagttgctctaaaatatcatattgatctatttttgaagtttgtaataattaaaactcaatcaatcatacgttaatacaacatcgttttacgtaaaaaacttaatcttcatcttcatcttcaagagaaaagaacattagtataataaaattatcacaaaactacatattctggggtctaaatcctcagcattaatgaatatgttgttttgtggtaactttgttactaaatctgtagttttatgatattccacattaaatctatagttttatgataaatttaatgctaaagattaccgccttgtttggtagagctccaaacttcaactcctaactctaaactccaacttcaatgggagctggcttctatagtagctaaggtgggtacaaaaagtgtttggctagatttatcagctccatgccaccacgtgccttgtagccatttcgttgaacacctggagagcgtcaccttgccgccacggtagcaaccaccgccgttgccggtcagcctgcgagctgccacaacatgtgtgtttccctgccgttaacgccaccgcccgggtcatgcctatcgacatagctgcccgcgcatcgcctgccgacgccgtgcgccgcctatggacgccatcgtcctactgccttagccaccgcccaccgcccaccgccgctgctgccgccgcctcccgggccgccacctgtcgagaccgccgcccgctgtcgtcgggaggaggatggggaggaagatgaggaggagagagaacacgaggagaggggataggaaggtgtagttcaatggcatatcacgtaattacatgaaaaatttaaagggtagtgggtattttgggatagagtgcagctgtgaagcagcaacaatctagctccacctccgtagtacaaatttgtggagcagctctactagctctgctctaaaaaaatggagaatctgtattgtttggcacagctccagctctatgtaagttgaacttaggagctagacctgtgctaaacggggccgtagttttatgatacatcatattaaatatataatttggtgataatttagctaaagcacttgtaatttgatgaaattttctcttaactaaaatattttgactattcaatttttaggtagtgtccggtactactagttctgtaatagttgccacatattttgcctttttttttcccatcttcccagggccacatacggaacaaaaacttgggattgggcctagaaacttaggtccttttacacataaccagattgccacatgaagaataagttcactttaagtcccttatcttgacttgattttgaattgcattcttaaaaccgcaatacatgatataatttgtttctcaacttctaaaactagtgtaaatgaggtcatagtttgaatgatagttttgactgatgtgatgtctacgtggtttgtttgacttgatccttattctatatggcactagaaacaatattacagaattaaacaaaatatatggtgcccatatatcgatcaaataaaaagataaaaaataatggaaactgcatgtgaatcggtcccacttcctccaactaaccatgtctcctctctatctcctgttggcgtgccaccattcccttcttctgtctccctacctagatgccggcaatgggtggtgggagaggagctgggcggtgaccgcgcaggagatggctacgggcggtgcctctctttcttccatctcttctgcaggcatgggtcggcagcgatgctccagtcctatttgtgtgagctctttcggcctcctccgctctctcctcggctccacctagcctcttccgctcctgctgctcctcctccacccaacctcattcccttctcctgacaccaccactactagagaaaccatctttggttggtcgaccaaattccccaatagtctcggttgcaataaaaaccgttcaaaaggttagaactattttttatctttagttccgattgggaacactaaccgggagtaaagatcatttttagtccctattcaaagaacagcaggcggtgtcagacccctctattatctttagtcccgattggtgttaccaaccgggaaaaaaagatcagtatgcgcggcggagaggccgaggcgtgcgcgagatcgaggaagaggtgggatcagttaataagttctatctcctcctccctcacctttatctcttcctcctcttcacccccatttcttcctcttcctcctcctctcctcactcttcctcccctctcctccctattctcaggcgcggccgggcggcggcggcggcggccgggccgcggcgaaggtggcctcgtgccgcggcggcggcctcgcgcggagggctgcgcccggcggctgcgtggattttttttctttgtttttcttttttccttaatgtgtgattcgatttgtgttgaatgtgtgattcgatctgtgttgaatgtgtgattcgatctgtgttgttgttgtaaatgattttgagaatgaactatattgttgtgaatgatttggggatgactattgctgtgaatgatttgggataaactacattgctgtgaatgatttgatctgagatgatttagggaaatagcaaaataacattgaaaaataaagagaaaatgaaaaaaaaaagaaaaaccctccaaccaggactaaagatcgggtatttgaaccgagactaaagatagcgatctctaatcccggattcttactcctagttggaaaaccgagacgacttagggggttaccaatcgggagtaaaaagggtttctccaccagtgctcgttgctctgtccaaagtcgtgctggggagccctgaaccgcccccaccttccgagctccactccttgccggcgtgctcgatgcatcgagctccagaggaataaggggaagagatggagagagaaaagagagagaagagagaaggagagtgaggatgatatatagggtacatttcacataaacgcctagtcagcatgaatggattggattaacttaccatgttagtgaaactagccatctatactatgagaggacctaatttaaacttgttttacaaaacgaatggattaagattttaagatgagagatattattctccacatgaatgaacaagtctagtttgcaaacttgcgaagcataaacgtggatcacacaagaagttcatgtgatagaaagaagagcagtttgatttggtagccattattgccctacaccatgtcatcgaccatcaatctaccgtccatccatcgtcgtgtcaatcacactccagcccagtcccaagtacgtaccggagtactataatcgagagtggtgtgacacgcgtcggtcgcaacatcagctgaccatcgcacttgagcttatatatttcagtacacaagattcgtactactcagggcaaaaatataaggtattttaggtataaatttatttataaatattaagaattttagagtattacttgtcccatgcaaccgcactcatcattaattttcttttctctattccttaatctctttgtattgtctggtttataaattattgacctatgaactttctgaagcagcatgacaacggacagcaccatggcaatatcatcttgattgaaaagacgagcaaatgttctgctgatagaggtggccgtaactgaatatccagacatcctacgttttatatatcttcataaggactggaaataagcactggtaaatttttcatgaaaagaaaacatcgatttgggacatatgtttgggttggatagaatttgtagctagccaaataatcccaaagaaagagaaaatgaaaagagacggtttctgaagattaggtcaacaatataagcacaaacgtgtagtcgcgcgcgtacaccctctgttcaaaaataaacccatttctgaatatgaatgtagacatacactgtatccatattctttatatctagaagtacttaatttttactccctctgccctaaaatataagtatttttggagtctaacatggtctttgagatgctattttgaccaataatatctataaaagtaagatgttttaaataaaaggagttacatataatgatgatagtttgtctaatgatgaatgtagtaacatcaattttacatgattgatttttttattattaatagtcaaagttaaaatattttcacttgtcactatgttaaaaatgcttacattttagaacggatggagttttttttttaacggaaagagtataccatatctcatcacctcatacttgacggtattaattcgacaggacacgtaccaagataggcttcgatcttgccagttgtcacaacatggacaaggaacaatcaaccggttataaatctctgggcgtttggtgtgcatcgatcggatcatggatgtagtataccttacctactgtccaatgtggataacactgctctgcataaaaagattgcattttatgacttcactcatgcatcatgatccattcatgctgataattagtactagtactgctctctctttttaatacatgaaggcattaattttttgaaatatgtctgaacatttattttattttcaaaaaaatattattataatttgttttgttgggacttaattaatttatcattaaatggtatttcttaattttttatgtttgtagaaaaaaatcaataagacgaatggtcgttaaacgttgattaacaagttaatagtgtcatgtattaaaaaacgaaggtagcacaatgaaccgtcgccacataaaatgctatgattatcgtcccagaagactttgttttttctaggagtttggatagactttttttggacgaagggaggaatcttttatatttctataattcattgggctcatgacttgtataagtactactccactggcctggttacatgcatttaatttcacagtgaattttatcttgaatagggccatctgacatgcatgcccacctgccatgctcacattgncatgtaggggtggcagtatgttgcactatgaatggcacttgtgctgaatgtgttcagacattccatttgctatagtcagaaaattgctgggagaccgagactattaatttagcttaagctattagtaggttttaagaaagatatgaaagtggtagagatgaattaattaaatgtactgctaaacatagatatacaaagcagtcgcagacatgcacaaaaaaaaagttgttacgcgcacaaaattcaaatttgaacacaatcgtgtgctttctttgccaatttgatctttctacctgagttattcccatatagacatgaaaatgtactcctaccatacccatttcaactctcctgcatctgctgcaaaaaggagatgatttttcttaccagaatgtgatatccaacctccgcatgcatataccatgcaagtaaaagttaatttgcaccaagaaatccgcattatattcattcttgatctatacttccacatgtgaaaaacagaagtactcacagatgcagtaactggaggagagcttgcattgctagttagttgtaacatatacacatattcaagccttgatggcttccttgtaccaaccaatcttgatcaggagctatcacctgatgccaaagcttcatagcctccaacaatccggccagctacactgaaatttcatcaatgcacagttagctggccattgatgctactcatcaaggtatatagccagctagcacgcacgccaagaccgatttttcgacatgtcacgaccggttgttgatcagtgtaaaagggtgcatatatatacatctatttatgtgtatgtatatgtaatttccctatctatgtgtaaatgcatgtgtatatatattgtcgataatcggtcatcggtgatgactggcatgaattgctgattggctggttgggcccaatatgccgggaggagaagggactaacgaaggggagagttcagagttcagaattgtgaagagttgtactactccttatccttagcatccattggcatgcatgtgtgggtgtgtgtccagcaaaaatgggaaagggtttgtgcaggcctcacatgggcaggccatacagtcatacagagatgtgtgagcctttcagcacttgtattttgctgggagatgaaactaaaacacagtaatgtaaaatgtaaatttcaacaatgtgctccaagttgtacttggctagattcgttctgaaaatagaattggctagttagcttgcagcttccatactttcactttaattctggtgatttggagtgatgtgtatatgtagagttgtgactgatgacaagagcatcttcagactaacagcatggttggatgtgtctaaatgtaattcctattaggattacgtacagtcctgagtattattgcacacaagaaatttattactccatccgtttcataatataaggcacaactacttttttcaaatgttccataatataaggcgtgcatgcatacatgcaattaattagtacatcttctctattaaaatatgattttttttaaatcctccaccctcaagatctctaattctattgggtgcatgcattttatttattagagtgatacaaattagaaggtgataataattgtttcttcgtctttggagtaagggtggttgtgcctaattatattttggaacggagggagtatgtgttttaacatgtttggcaatttatttctaatgtatttttaatttacattcttgtttcttgataatgtactgtttaatgaaggacaataatatatagtatgccataatggtgcattggtgcatacccaattttattttattattctatatttttgcaatgggactttttcatatttgtaagcatgcactaagtctactcaactgaatcacatttaattactaccgtttgtgcttttctagattttccgattgaccatactagtataagattaatcaagggacctatgcattaagtgccgatgcacagtacgtaaaccgaaattatcattttttttggggaaaagagaatatattactcctcacaaactatatgtgagatgaaattacaactgttctcgggccaaaattcagacatagactcatatcgtgccttcttctttttagagtattaaataataataatgtcggttgacatcgtaaccaaaattgtgtaaaccgatattatcatttaatactctaaaaaacgtaaaggatatctacgtgcggaaaacctccttgaaggtggactggaattgtggctatcaatgtaagtttcctatggtgcttccatttatccttttggaggatgcatgttatggagtatattgtttttgctcacaagatctttaactaacatctgcgtgttcgagaaaaaaaaatctttgactgatatttataaactacaaattactccccccgtcccataaaaaccaacctagaaccggatgtgaca

SEQ ID NO: 58600 - DNA, 13296 bp, Oryza sativa
acggcaatggcgcgggcgaaaaacggggaagattgggaggggaaaaaggaagggagggtgcctgggtttatagggcagcaatgtcggtttggaaactgaccttgggcggtcaagggagcgagccagcgctcggcggtcgcggcccaaacggcgacagggggggagaggatgacgccggcgggaggctaaagggaaaaagggggaaagaaagggtgcttgcccccttgccactttggggaaaaggaggagggagagagggcgatgcagcagagggggggagctctgcctccgtcccttggaagcacgcgcgaggagaggcggggccgagtcgatgacgacggcgatgacggcgggggcggtttggaacggagcggcgacacgggcggcaggcgcggacaggcgcggcagaggctaacggcggcagcgaccaggcggtcggccaccacggcgtgcgcgcgcgcgggcggcgcggcgatttgggcggcgtcggcgggaatgacagcgagagcggagagggagggctcggcgtggctcacgggcagagcggggagagagagagagggagagagagagatggggagggagggagagatgggccgagaggaattcggcccatcgaacctgagggaggcaaaatagacttttgcggagggatttgatttgggacggatcgagattcgggattgaacttgacgatagattggggatttgagatccggaatggcacggagactgactacgagcgaggaaacaattttcgcaattaaggtttttaagagatagttttcccgctaggcgccacgacggaacgggcgctacactttattggcctagtggcggtcggtcacgcctagcggcggctgatccggtgctagccttctcctagacgtgtgggttggcgatgtcggcgtgtgggtggtggtatattttttcctttttctggttacgactctccagagttgtaatcttgtaattttttcctgctctatcaatagaacttcgcaccgtcttgtgcgagtcgttaaaaaaaataaagaatatagaaagtactactagtgtagcgctgggactgcaagcacccgcaatggtaaagcaaggtgttttctataaaatatgtacatctcagcaatagactagattaatagtaaaccacctcaatagtatgtctatatgggtatctatagctctctaattcattgcctcgtttttctctatagactatctccgggttagtagatagttttgttctctctctttatttaatctcttccatgtaggaaaatatactgacatggatctcttatagagagagcctatagataaccattgtgggtgcccttactgtcaggttattgggagattcaaagactataaatcgctcttaaatagcatgttcaagcattacgccttcaaagagaatgccaacaagattagattaagctcgaaaaataaaatacttaatccatatttttatcgtacaatatactgatctatcatcaaatacaacaaaaaaaggactacaactctacaagttggaagtacttgtcaccaacttcttcagagttcagagttcagaggccgcatcagttatgcgcctatgcggcgaagcaggcgaaccctggtgcaacgatcgtgccgccgccggccacggcgtcgcagccaccacggtaggaggccacgctggagtcgaggacgtcgctgcacgacaacgcgtcgtcaagtagcggtggcaccggctggtcgggatgccagtacagcgccctgaggaacgcgtcgctcttgcggagctccctccaccggcgcctcatggcgcgcgaggtgcggcagtgggcggccctgctgatgtccttccaccggtcgccgccgccgccgcggaggcggaggtgggcgagctcggcgtcgtcgtcggcggtgaaggggcggtggtagacgtcgcgggcgaggtggtcccgccacctgtcgcggcactgcttgggcgagcggcgccgctccctcggctgcatctcctcggcgacgcggcgccagtggcggaagccgtaccccctggcgaggcgctccaggcacgcgtcctcttcgggcgtccacgccggcgagagcctaatgcggaggatgatcctcatcgcgctcgacggggtcgccgccacctccgttgtagaagagaaatcagacgaagaagtttccatgcctaggtgaactgacgcaaagcgcgtaggcgcgctcacaaatcacacaatctcttctgatctgacaggggtgtgtacgcacgctggcgcagccgctaattatgtagatggcatgcgtgcgttctccgattcgaagtcgatcttacttcgcttccatttcgaggaagaaatttaactcggactagtccatcataatactaccccgccgtccgccaatgcaaactcgatccgattagcataaggagtgtatggcagattggcaatcgcgtatggattgtttcgctttgttcgtcgagctccacgcgcatcttccgcgcgccgcggagaagcccgacgccacacagtagttctccggcgtcgggccgtctcacccgtgacgctccgccgccattagttgcgcacttgcgcttcctcgagctaatccgctagtaccactgaaaatttcgagaggaccgatagatccgaaatttcgaaaaactacgtaaatttcgggaaacattgaacacaaggacgggacaaaaaaagcggctcacagctgacattgcgtcacctcggagtggtatttgaagctttgagctgatacggcgggctgaggccgagcgcggtctaagtgagagggtagggccgatagggccgataggttgaggcgtgcatgatatatcggagaattcgattccgtctgccgagtggcttaaggtttgttcgggattgaaaataattaattacaaacctcaatagatgtgaaaatattttccttcaaatcccccgtcaattctcttgtgagagtgacgaacaagatagctcctctccacaacggctactttataaaatgggaatgctaggggacgggataccgtcccccaacaggatagctcctctccacaacgcgattcttatccatacactcactcgccgccgtcgccgtcccttgccgccaccgccgccgccgccgccgcgcccatcccccaccgccgccgtcgctgtcccccgtcaccgccgccgcgcacatcccccaccaccgccgcgcctgtcctccgttaccgccgccgtcgccacgcccgtcctctgccgccgccgtcgccgtcctcgtctacaagggatggctacagggggcgaccgcgcgtgtcggggtgctcctcccacaacgagatgcccagctatatctagtaagaatcacctgatacctggtaggtatcatccgatacctcgcaagtatcacgtgatacatggtagaaatcgtctgataccttgcgagtatcacgtgatacgtggtagaaatcgtctgatacacggcaggtatcgcatgatacctcgtgagtatcacgcgatacgtggttgaaatcatatgataccttgcgagtatcacgcgatacgtggtagaaaatcgtatgatacctgataagtatcacatgatacttgtagttatcacctgaaacgtgtgtagaatcgtctgatacctgatatgtatcacacctgatacctactcgggatcatcctgttgtgtagaatcgtctgatacctgataggtatcacacctgatacctactcgggatcatcccgtttgaaaacaggattccgttatatagcagtccccttataaaatcatctcagtcaatctatatatgtagcaccagtgcaccacctgatccaactgatcttgtcctaacctagtttccatgtgtatcttttacattagtaaagacaaatggggttccgtaggaattaatgttcaactttgatcaaccttacttagtcacatgctttattttttttttaaaaaaaagaaggtttaaaataggggcgatctaatctaaaaggagtgattttacagtttgggagatatcatattttctagtgtaaaatatgatacctctcggtatcttgggtactagaagctacggaaattcgcaataaattttttggtacctctttctccatcttcaatataattcagtgcttgcctaattcctatcatgacttcggctgtgtttttcacaccaaaaatgaaagtttgattgaaattggaacgatgtgacggaaaagttagaagtttgtgtgtgtaggaaagttttgatgtgatggaaaaattaaaaaattgaagaaaaaatttgcaactaaacacggccttcctgaaggatcgagctcaaacgaattgatgtgagactggaataatcgatttgaatgaggaagagtattccttttcctttgacatgaggaggtatcatagatactagcagtctagcactacaaaatgtggcatgattccagcagtgaatagatactagcagtctagcactctactagtagtagacggtagtacaaccggaataacgctttgcttgtagagggagcaactcatatgttctaatacacattcttatttggctatatcaccatgagcccatgagtgtaaccaagcttagagcctatgttaaattgctaatcaacttgagtaaaaaagaagagcgcgttaggaaccggatgccttgcttgcgatagcaaaagacgtcaagcaccatgcatgcagaagcatggtagcacaagctctgaagctcccaataaaaagcaaaattgagatatgagaatgattgcaacctggcttcaccagacaccaagctgaccgatcagaccagcggatggcaatggcatcctcgttgatccgcgcattggattgcacggctacgcccggaacacgtggtgctccagctccggtcgccccgcgtcgccgcgtcgctcgtgttcgactggcgccgcggtgccagtggaggcctctcaccgcgcgtgcacaggcggcggcgacgcagccggacccggaacaccaggcgcccgcgaatggggggccgtcggcgtttcccacgaccgcgctgaaggtgggcgccggcgtggcgctggcgctggctctgggtggcgcgtcgtggagggcgcgcggcgggagcgccggcccggtcctcatgcaacccgccgcggtgtgctccctcaacgtcgtcacggacagcgcgtcacgcgccaccgcggaacggagcgccgccgccgcggccaccatgaggacgagcgtggacgcgctctccgactcgctgttccggcgcgaggacgcgcccagggaccgcgccacactgatggacctcgtctttgagcaagtcaccaaggaggtcttcctgatccatcatcccgatccatttcttgattcttcatttctcatctcaatcttagctagatcaagaaaatgtgcttctaccaactgcgtgtctcttgtcatgcgcagcaaatcggcgacaggggaaagctgacgagcttgctgcagaaggagtggtcggcgtcgcgcgattccgagaggaagcttgacctgggcttgctgctcactgacgtactgatcaaccaggtacatttctatgatccagtattaactcagtttaagcaaagtaatccggattcactcttaaaactttcttgtctcaactctaacttccaagctctgtaagtgatctgaatcacctagttagtagtgatactatgtttaatcctgtagagagaatggcagagggcaaaagaagtttgtcagcaattgactggccgataccaacgtgactcgaggccttacctgcacttggtaatgatctaaccaacttattagtcaagttttgttttggttatctgcaaagcttgtgcctaatgatgcttttcttcaggctgtcatcaacatgatgatggcagtggagaccatgctttctcctgaaacagccaatagtgacgacattgagaagatgtcaaagaatgccatggacgcgtggaaggaattcaagaccaagtatgagcatgccaaggggtcaactgattccagcacctgactgaccagtattatgcttgctttcagacaaatctttctgttgagtgctgacaactcttgtgatgaatctgtcttacccacttagttgcttgtgaagtttgccccaatctttgtgacgtaaatgttctcgattctcattatgcatacctattttacaacctacaattatttaccaacatttctagttgtgtttatcccttttgtatatttacaccaatgcaatcttcagaagaaaaaaaaaatgaaacaacgaactgacaaaatttccaaagactttattcagtagtctccccccacatcttcagaaggtatctctcgcagctgctccctgcgatgtctcccgaggatgccatcctggtgatgccctgcttccctcctgccccgccattgccacgctttaggttgtgccggtactcgacggcgatttgctcgaacacctcgacgtcgaacatgttcatgatcaccttggggctcatctggtcccggacataggcgaaggcgagctggtcgcgcgggttgaacgcctccagctcgttgaaaaggaggcaggagaagagatcactggcgaggccgtgcctcctgatgatgatcgccgtgtccggcacatctgcagcacaacaaaatctcgtgatcccgtatccctgatctttgcttggatggcgttacattgttcgtgagttgtgacacactatcatatcatgtgtcagcaatgttgacatgctggctaatcgcattttgttcatgttattggcattgttcagatgtcagtttcagtagcttcgtacgatagctgtttgtttgtttgatcaagcaagaaaccaaaaactgaaggcgagaaagcaaattctttctgtgctatattgcaatacctgacggatatggaagcttgataggggaccatggctgcaggccgttccggcagtacgtctccatctgctccctgatggaatccacgtcgccccacttgcgccaccgcgccgtcgcgatcgcctcctccatggtgtggaggttgaacgggtgcttggagaccgccatgtccgcacccttcccggcgacgaacgagtgcaccagcagcagcgggtcgacggtgagctgcatcttggcgtccacccagacgctgaacctcgcgttcgggaacagcctgtgcaggaggtacttcacgatcacgcaattcatggccgggttctcgtaggggagccggtggtcgccgccggcgccggcgacaagcctcgccacgcgccacgcaccgatcgtgccggcctcgccgcgctcgccggctaggatgttgtggctcgcgaggactctgtgggtggcatcgtcgatgaacatgaagaagcacaccgtccggagcgtctcggagccgagccccttgggctgccggatcttgtcgtggtcgttgaagatcgccgacgccaccaccacgccattgcacttctccatggccaatctgtctaaaaccaacaacgtcttcacaaagatgataacatcgaagtgtgtagcagtgtttcttgattattgcaccacaaaaggcttgagttgcatatacgcaaaagaacacataaaaacatctggcttgcaactcaagggattataatgagttttcagctcaatgatagtcatgctcacgtgccacaagaattttctcctctatgaaaaatgcgaattggccaaagaaatcaccagattctctgacggggaattccttgaagaacccacatggaatttcaactgcgctatcagtgtggttgaagaaggatctccgctcaacggtggacaaatttcccgcgaacgagttcctcctcccattctggtaccgcaatgctggttttgcataaggagacgccgagaggttgcggcagaatttgttgatctcttctaagaccgtcttatagtctgttccaagagtaaaatatagcacttgtgaatttcttatggcattcaaattccagaaattcaaaaaactgatcagaaaacactgaacgaaaacaagaaaaacagagctgagaaacaggatcgtccgcatttgttgcgtttgcatgcgaccatggatcatgaaaagagaagcagagacatccgttacgtccttcccggacggagagggatcgacctgagaagacggcggggtcggagcagagcgcgcgcgtggcggggatcgcgtgcttgtgctcgccgtactcgcgcgggtactcgaacagcgccgccgacgccgccgacgaaggagcggaggaacggaaggggaggaagacgaggcagcgcgaggcggcggaggccgggtcggagaaggagacgtagagcgcgagcgggagcgtggtgaggaggtagagcagggagaggcagagcagcttcgactgcatcaccggcgggctccgcacccgcacccgcatccgcacccaccccatttcgccgtctccacgtccaccgcggccgcggctgcttccccgcacgtcgcggttgtgtttttgaccgagcttgatcgatccgtctctccccagtgggcgcgcgggcgcgcggcgtcgcactcgcgtggcggtttcggactttcggttaggacaatgtgggcgattgggcttgtggctcagtggctcatctcacctcgctctggatcgagcagggtacgaagtacacagactgagtgtggctgtgtggggccacatgtcagtgtcagttgcccggcccgatcgacgacttttcggttgtaggtaaaactggttcaggttcagttgagttgacaatcatctatgaggataaagaatcgattagagggcaaaaaactctgaatattcatcactgctttatcgatcggcaacgcgtgtatcgtgtaaggtctttttcattcccgaaactacgggtggactctcgactgtatgtgatcgcgtttgtaattggaaatttaccatgtggccacactatcgacctggttgacctgctactgcctcgaatatcggttgcatacttgcatttttgaatcatggctgaagcaactaatgaactgcatttcctgcttaattaatcagatactccggtatgcacttggaagtgtcacagaaaattagtttattttctgcaagaataggaaaaagaaaaatctttcttcgaaacagagctgaaaaggtatatatattgatgttccccgttaaatcatgcgttaaaatagttgactaaacagaacttttattgttgttaatctcgatacgcacgagtcacaactcaactacatactttacagtgcaaaaaaacagttcactcgagcagtttagggctttaagatgccattattcttccgaccaggagcttgaagattacactagctgtgcgatcgagtctactactccggtgaacatttgaagatttggaattgccgcgcgctcatcgcgttacatgtcggatgcatccttcgcgtcgaagagcatccatatctcgttgaccctgccgctgaactcgaacggcgagttgtactgcgccaccgtgtacgacgacgtcgggtcggccctgcgcccgtcggacacggcggcggcccacctggtcccctgcaggctggcgtcgagcagcgcggcctgctcgccgacgtcggagtcggccacgaagccgccgaagcggcgcacagcggcgtacctggccccggcccacctctgcacgtgcagcccctccgccggcggcgggtccggctggttcttcgccggcacgtagaagctgaccacgaaggaggagacgcagaacggcccgtcgctcggcgccacctgcgtcagcaccggcgccgtcatctcgatcgtctcgttgtacgcgttcttcccctggatgtagttgaacaacctggcccatcaaagcccagggttatctcaagcccaaacatttttgtggcccatgtaaagcccaatagaaaaaagaaagcttcactggtactactagcctgtgatgaagcttttccatggcgagaagagggagtgtgatgagtactgacgacttactggaggaagccggtgcgggtggcggcgacgaaggagatgtcctcgatgggggcggtggaagcccacatggcgtcgctgtaccgccggatctcgaacccgttggcgctgtccaccacctcgtacgacgggcactcgatgcgctcgcacgacggcggcacggccgcggaggcgacagcggcggcggcgaggagtagtagcattaggccgctccggcgagccatggtggcgggtgcggggatgcgtgcggcggagttggggaggtgggattgcagtggggctcgggtgcgtgcggttggggatcgatcgatcgatcgggttggataaatacggccgcgctttgcgtttgctcggcgcaggtgcctccacgtcgccaatgttcgttcgtacgttggagacgcacggggaagagggaagcaggcgcaagaagcgtcgttttggtggtttctgagattttccttgccaaaattagtgacagtcgcgtcggcgcgtgtgctgtattcacctcgttttatattcttgtgtctgaaactctgagggttgttttggtctgatgtcaaaacttgtcctaccaaccagtagtcaatttaaatagtactttgtagatgttttgatgccaatatttactatagctaatacaatttatatagttcaactctaccaaaacattggtagtggtgctaccaatggtttggtagtgcatcaaaccaaatcagccctaaatgccgattcatatttgctcttctccattgtcaagtctgaactgagaccttcacctcatccgactttgttgttgagttggttgctcaactttgactgattgagtaatgagcagttacttcaagtaaaagatagagacaaaatttttcttgcatgagtaaatttcagaaaactattgattcaacgtaaaattattataaaattatatatttaaagttaagtatcgcaaaactatatatttaatattgaaattattataaaactacatattttagagtttaaatctctagtgatattgttccggttaaagctataaacgttataatttgatagatttactacttaatctttaatttttatgatattccatgttaatttgtagtaagaaatttcacggtaatattatatctttttaccacaccttcaatctttagtttgaacgaagtgtaatgttgtgaaatttaattttcttgaattcattgtttcttgaaggaaaaaaaatagtgcttacgaggaattaattcctcgcaaccgtgtcacccaacttgccgaaaggatcaattctacaacgaagccctgccatcctaatcgtggtttcgaccccaaaacatagtagtatcttttttccgtcaaaaaaatttgtagttattgctttcattcaaatgtactcgtcagtttcattttataagtcgtttgactttttttaatagtcaagtttaattaagtttatagaaaaatatattagtattttcaacgcaaaacaaatatattatcaatgataatatatttaatgttagatgttgctaaattgttttataaacctaatcaaacttataatatgaaacgggtaatatggaatttcatccgcaacatttactgggtaaaatagcacgtgcagtatcatacacttcaatgtggttggggcttgcttcatttactgggattcgattttccgtacaaattaagtactccttctgtcccaaaataagtgcagttttagcactattcatatccaacgacagcactgttcatatccaacgtttgaccgttcgtcttatttgaaaaaagattatgattattatttttattgttattagatgataaaacatgataatactttatgtgtgactaatttttttaatattttttataaattttttaaataaaacggatggtcaaaacgctgagcatgcatatctatgtctacacttattttgggacggagttagtaagataggagtagtagtagtagtagtacggtctatgcatggtgatggtcatggtagcatggtacacgaacaatcatcaaattaagtaagatcacaggacatcattaatcatgttccctacagtacaaatttatgccaaactcttcgcggctaaaagggtcacagtccgttcaatccgtctatttagccataaatttctcaccagcaacatgtttaaatacgacagctactcttgtctgcgaatacaactgtagatggagtaggaattataattacggccaagagaagattttcaagtctaaaatcatgaacatcgttcaggtagtcatctacttctcgtgatgctactgtaaggttcacaagattaatccccgcttgataaaacagacaaaaaaataggataggtgacacacgagtataacgctctcggtgaaaaaccggagcagagtagtagtagtaatacagcagccgtgattttatttagaagactaagtatatcaattaagagggtagttaaccttaaaccccgcaagaaacccgcgtcaccctcacttggccttgccgttgacggcggtctccttgccgttggccgctgctgcggcggcggggaccttgcccttgccatcgtcctccttggcgaaggcgtcgacggggtaggtcctcccgaggccggtgggggtcttgaaggtgatcttggaggcgtcgtccttgtcgatgaacatgtcggagagggagacccagatgaggagctccttggtcttggccccggtgacgcgcttcatccggcggtcctcgacgaaggcggtgacctcggcggcgaacgagacctgcctgctgatctgcttgaaggtgtgggtgatggccttcttctggcgcagccacacgaaccccgtggcgcggttgtagccgacctcctccatctccgccagcggcagcaggcccagcggcatgtggatctccgcgaggagctccaccgccttctccgcgcacagcgccgccccgtggtacacctccgccccctccctgtgcgcctctatcgcctgcgaccccatcgaacacgaactccaactcttggattcgacactcacaattcacaaatgcacaatgcggtggtgggatactgggaatctttgggttgcgttgtttgtggggaaaggtggggcgctggatttataggggaggagatcggattggtggactccgtgagcctccgagtaggagaggaggcggggacggttggggtgggggaattaaggcgcggggggtttatttattactactcctacgtgacatctctctcgcaactcgcgcgagtcagaggaggccttgatgcagattggggttgggggggggggggt

SEQ ID NO: 58601 - DNA, 51286 bp, Oryza sativa
  unsure (1)..(51286): unsure at all n locations
aaccgcaaacatggacggaatagttcatttggatttgtccattcgtggaaactgatttttttttaaaaaaaattaaagctttcagtctttgcaataactaataaaacatgagaaattttataatatttgagatgtaccaaaatctttaatctaaatttttatttatcggaggtaccaaaatttacagtatattttttgtaccgccttaaaaattataaaatcattcgtaatacatactattatgtaaccataattatttttgtcactaagattcaaaccctgacgaatgaagctgtacgtgcccgattccacgccgcatgaatggtgcttcacataaactgataaattcaagttgcgttttgtttgtttccagagaaaagaaataatcaaatgccactgtcagccacgtattgttttgttcttaattagcaaagcgtgtaaaacacatcccccgctaactaaatgccatcgaaatttctgttcatgtgtttgactgccgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaatgcatgggccggcccataaatgggccactccaaagcagaccggcgctcagaggtccatcctgatgaatgaacattcatgcaggtgaccggcccaaaataattacagaaacccaaaaattacagaaaaactacgggttgttcatgttataccatttcagaacataccatttttttaaagttgataaatatacgtatccattaagttttttactaataaatacgtaagaaatcctgtcaaaacttggcaatattgctaaattgttgccaaaactttataaggtttattttagctacaatctaaacagaccttatgtatttgctaaaaacttaaaaaaaagtgcagaaaattaggaatttgctcaaaaatatggtaacagtttggaccattagataagcttaatgatttattctagcgagagattcttgctggatgtatgcatgtaaatatattgtaattacaccgtaattatgctatagttatatttgaaatatttttatcttaaagaactgatatgttatatagctacttccgaaaactagcacggaaatgcttttttgaaaaaagaaacatatgttctcctttctgtgtgaataaagcacgagcagttccagttgtatatatatgcgtccaaatatactgtcccgtggtttattcatccaaacgacaaatccttttttctaaaaaaaaattccaacgcattactttcttcccttttctctagcgaaaaaaagaaagcaccgaccaaagtggctcaaaaatggacgcgtccaaagatcgcgctgccacatgacaacggacttcgatgaaattatcgtcaatttttatcaaattccgatcaaatcattcctcgtcggcgtccatcccggatactataggtggacaccttcgagtcgcttctctcttctccggcgacactgccactgccacgcgtccctcccttcctccccgcccaacccccacgtgtgcgtccacgtggcacccgcccatctcacctcctcctcctatatcctcctctcctccgccattgccgcacctcatcacctcctcgtcttcttcttccacctcgcaaatccgatcaacacatcagcttgagaaacaatggacgcgccggccatgctcacgaccaagcacgtccccgaggacgtcggcctccgcaacgtcggtgagtttgcgtgtgtgtgtgattgatttgatcactgtgtacgacgccgtcggcggcggcggcggcggcgacggcgaggttggtgattaatggtgggggtgtttgttgcagcggcggcggaggaggaggggggacaggggcagatgcaccgtggggaggagaagcagcacaagccggtgctcaagaaggtgaaggagaaggtcaagaagatcaagaacaccatcgccggcggcggcggcggcggccacggcgggaacaacggcggcaggcgctagcggaagcagtagcagcagcgaggagggcgaggacgatgtggcggcgcagaggatgggtgacgtggaccagcgcgggtaccaggaggacgtcgaggaggacaagcccgtcgccatggagtccgatcccgaggtccatggcgctccgagtaagctcctgctccgttgatctctctccctgcgtgcggtgccgccgccgccgccgtcgtcgtcgttgtcaggttttgagaacttgtttggttggttgcagtgtacgactcggcgaggatcccctcggtgcaggaggtggagggcgacggcggcgcgccgagggtgcggctcggcgacctcggcggccccgtcgtcgaggacccggcggcgccgcgctccacgacgcgcgtgccgcgggagggggaggacatcggcacgacgcccgtcgtccgcgccttcgagtcgatgagcgtctccgacgacccgaagcacgtcggcgcggccgggaagccggacgccgacgtgcagaacgacccaatgccggtgtcggacgccgccaccgccggtgaggagtggaaggacgcgacgcccgacagcgcagctgcaggcgcgacgcccggcgcgacgtacaccgacaagatcaagtcggcggcggcgggcaccacggagtacggcaagaagctggccaccacggtgtacgagaaggtcgccggcgtcgggacggccgtggccggcaaggtgcggcaggtgacgcagtcggccggcaccgccacaccaggcgtcgccggcggcgccgccggctcacagtcgcaggacgacgtcgacgcctccaccaccctcgcctccggcgagccggcgaccggggggcagcagcagcaggacaagggggtaacagtcaccggctacatcgccgacaagctccgcccgggcgacgaggaccgcgcgctcagcgaggccatctccggcgcggtgcagcggcgcaaggacgacgtggcgcagcgcgttccggccgtggcgccggcggcgccgggcgacacgatcgccaaggtgcgggaggcgcccgcgcaggtgctcgccaaggcgcgcgacgccgtcacgtcgctcaccggcggcacccatgtctccgacaccgtgcagcccaccaccaccacaggtacataaacacaaacatctcaaatttcacttgccattttcgcagccggatcatgagctgatgatcgagttcgttttttttttctctttttcgtgtgatttttttttgcagaggcggatggcgcggaggtggaatcggcgccggtgattcgcggggaggagatcggcgagacccaacgtcagccgaacgtaagcatgacatgaagcgttgtagaaatggatcctctcgtgtgtgtctgtatgttgccacgtatacacgtgtaagtgtaagaaaagtgtcagtgtgcttggaataataagccgttatgtacggcttttgtgtcgatgtgcagtttttgttttttgatgtcttctgtgtgtatgtaagcaagcccgttttgaaaatggccaagttcagttgaaacttgtaatggtttgtggacttgtgatacacactgtttgtttcaactaattgctagtacaaaagtgttcaccgttttcttcctgatcactgatgaaagttcttcagaaaacacactgggaaatttccaatctttgcagctagctatttttcacctgctgagtggcgcccagaagttcattgacgttaatgtccccttttgcttctcttccgagcgattcagaccggtcatctccatgcattgtgtgtgaaagaaactgtgaacagctaatcaaaatcaaggtgcacgccgaaattgccaaatgtaacagatgactacttactccctccgtttcatgagataaatcattctagcactttccacattcatcaagttattatagcccttcttatatttatcacccctccgtttcaccgtgtaaattattttagcacttttcatatttatattgatgaatgtagaaaatgatagaatgacttacattgtgaaacgcaggaagtagcttacaagtgccatgaatatttcgaggtgcgagtgcgacaacgatatcgtgttagatcaccggacgattgagtaattgactaccaacatctccggttcttcctgctgatgcatggcctgaatatgaagcaggaatgatttggatttggacgtttggtccaaagtggcaggacgaagctagagccgtgtgcctgtatgggagtcgagacacttgggtggttgactgtctgaccccatgattttggaaacaaccttctttactgcgtctctttacaataaataatcctacaagtgaattttaacatccgatacataattccagatcgatattgaagtcctataattagtttcataaaaccatattgttaactatcttgcgagacccaatttttcctcttcttttttgggactttgagttactactatagcaaatagcacagataataaatgaaatgcttaccttgttactgtggccaaaataataataaaatgattatcttaagtggctaaggcttacaatgaattgaaagaattcataaatttaatttaactttagagcttatggtggatgaaaaaaagaattagtcgatgacgtggttttatgaaactttagaatcataataatactatgtttattgttacgtgtcaacttttatttatgtaaagagttatagtactaggctaatttatttcctcaccattttcaacttctacctttcgtttttcacgcgcatatgctttttgaactgctaaactgtgtcttttttttctttgcaaagttttaggtattccaatataggtacttctaaggaggttcgctagtactcagaaacccaggaggccaggcagtgaaacgttccgcagactgctcacccggccacacctcggagccgatgaaggctggcaatacaagcatcatatagaaatgttgccttaaaaaacatattaatctaatttttaagtttattttagttaatacagtattaaattaatcatgtgcaaataagttgtttcgttcgcgtgcgcgtaggattaaggtccctacatgttttgtccaacccagcctaagatatttctttttttttttgtaaaagtgttttctaaaagggcttaattgtgaaaactacccaaacatgggcctcgtagcccaacacaagataccatttcggcccagacaaaaaatcgattcgctaccagtagcggcccagtacggcgccggcggtgccgaagccgaaaatttccatccctcgcagtcgcagcagccacctctcgccaaactccctcttcgcgccgccgcccgccattgccgccgccaccaccaccgtgcccgagctcgccgaccaccaccccgccgtggctcgcgcgagatgcgttcacgcgagcccctgagcgctccctcgcaatgaacccgggcgctcgcccgcccgcgttgcagacgctctccgcccgcctctggccgcgcaggcggctctgcggagtccacgcggggagccggagcgggggcgaggggcctggagctagggagagtggtggtggtgacgttcgcattggaaggggggaggaggaggaggagggagggttggatggcggacgcgtcccgcaggaagtgctgctccggctgccgacgccgcccggccgggctgagaccgacgacgatgatggcgaaaacttgtcccctggcgcggggtccggttccaggaggaggttctttgaggagctgaggttgaaggcggataggattgtcaagatcctgcttcaggatggcccggggttcaacacccgccaggcgctcgacgaaatgcgcccgagggtgtccaatgcccttgtgagggaagtgctgctcaaatttgttgtctcgatcgatggcgtgaaccgcgctaggtacccgaggctggcttacaagttcttcctgtgggcggaggaacaggaggggtaccggcacggcacgagcatgtacaacctcatcttgaagatctttgcggagtgtggggagctcaaggcgatgtggcggctgcttgaggatatgacagataaggggctgcctgtgtcttcccggacgttccacctcttggtatgcacatcggggcgggctggattgaggcggaggctggtggagaggttcatcaagtcaagtaatttcaattatcgcccatttaggaattcattcaatgcgatactgcacactctgctgaccatagagcagtattcgttgattgagtgggttcaccagaaaatgatcgccgaggggcactcacctgatgttttgacatacaacgtggtgatgcgtgccaagtatatgctcaggaaattggatcagttccataagttgcttgatgagatgggaaaaaatgggcttgcacctgacctctatacgtacaatcttttgcttcatgtgcttggtaaaggagacaaaccacttgctgctctcaatttactgaactatatgagcgatgttggctgtgtaccgactgtgctccatttcacaaacttgatagatggtctcagccgtgctggcaacctagaagcttgcaagtatttcttcgatgagatggtcaagaaagggtgtcaaccagatgttgtttgctacacagttatgatcacaggttatgtggcagctggggaattcgatgaagcccagaagttcttcgatgatatgttgctgagagggcagcttccgaatgtgtacacatacaattccatgatatgcggactttgcatagtaggagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactctagcacatagggttccttatctatttattcagtacagaaatgcaacactgtatacttaaactgttttacgcactaatggaatgggataggatggggtggcctggcgtgtcctaaatcctaaccgactcatgatggaggagttcaaccctgatttactagtcctaaataggaaacccaaccttagttctgttgcaatgtagtacacaatatttgatttacttccacttctggtctcctgaaccagattacatccaatcttttgttttcaatatactttttacagtgccaagaacttatgctcaacaaaatatggggcatatcattttgctaaattacaacagaacttaggcttttgattcggttggatgcaaagcacaccgtatttctctcaattctcatttctgtcaaccctagcataggtttagcttagtggattatatgtcatagatcagataagatccatataaacattgtgcattatcttgcagcactaagagatgaaaagcctatgcaatcttgtcccttaatgatgctctttaggtcattagcatctctcgtcacagattgcttttatcattatgcatttatgtaatgtatgattaaaaattctcagtgtcttaaaaagatagcaacaaattaacacaccgttaagactgcctccagtcacaaataagtgacatttttggcagcgacaaagtctccaaacacagccacaacttctaatatctattgtgatatattatacacacggtaaaatgctatataaaatagaaatatttaagcaaaatatacacacaccattttcgcatgtccagtttaagtatttatagagatagcgattgttaagctcttaatgtttggttgcatctaccctggcctgaatcaccactatcttttactggaggggatattaaatattgtttaagtcagtttcaaccttggtatctctgactctggtcatccattattttttgttggaaaaaaatatttgaattaatcaatacgataggtacaggcctgcaaagattcatcaaattagcaatgttctctaagttcttttagttgccaaattgactttggcatcataaacataaagcattaaagttgatgatattgtcatatgtgaagacaaattgctgagttacagcgtgttgatgttaatagagcaattgacaggttgtaattttttttttgtaactgtaagcaatattacttacgtgtaccaatatgttctttacagtattatggtacagagtaatttcacataaaacatcgatcaaaagtccaaggtattggctgtttcacttgcagatgggagagacactatgcaatggtgttatatatttcataattttatcatttcttctcttctttcttttcctctttcttctcctccttcttctcttccttcttctcttctttcttctcctctttcttttcttccttcttctcttcttttgcaggtccaacagacacaatgtcaatcttcccaatcttctttaacttctttgcaattgccactgtgtccatttcaccgatgatggtcatcttattgtccttcaaatctgcagctatggaatcgatacctgtacatgaaatgaggtgtgtaatgcattagattttcttgttgacacagtaatagtttatcttacaaaatacttctttgaagatccaatcttgcatcattacatgttcagctgataatacatgatgtggagcatccagttcttttgtctaacctttagaaactaatgtacagttgttcaccgcaaacagcacatattaataatcccatacataggggggaaatcattccgtatgcctaactatatcatcgatcgtcatcttcattgtgttatgtgatgtaacaaacaatttccaccttacatgatatctcttatcaaacctctgcctaaaaccatgctaatgcttccaaatgtgatttgcagatgttttttgaatcagagatcaaaacatatttttcaagtttcagcagccaaagaagaaaggggatggtacagaatgttaccgtagatgtctgcaacggcttcaatggctttctgcttaatcttgtcgtcggtcatggttggaaccctcagcaccaccttctgctgagaattatcatccgacgacacgaaggcgtgaaccgccgaaggaatcagggaattgaaccataaacaagagttgcacttgcttacctgagccatctggaagctgtgaatggagtggaggaggggaaaggcttaatgttctgctgaggtatgaacaatgagaagaaaccaaggctggtgatggcaccggccgggcacctttatatgcaaagggtgcaagtgtgctgtcactattctggaagaaaccatatcaccaattccattcagcactggtatttatttctctttctccacccaattggtgtttggcgatgagtcagcagccaagccaggccagtttctgtttgctgcaagtgaccagtttattcatccgtccgtctcgtcgatatctgatgcgttggagatgaggtacgcaaaaatactttcaactctttcggccgctgccagtttcaattggttcactcatccctggcttttctttctgatcaaaattgttgtgatgtccctttccatccattcctgaacatgcctttgctacgtaggattgcagggtcggtcagtgtcctggtgcgaccgtgggacgggtcagtgccaaccgccacgccggcacccggcgcgcactgacgcgagacgacgggattctgtccatggagagaagtggtggtggactggcgtgagagtgcgggggcggcagctagtgacgggacggcggcggcgtggtggcgacgacgtccagacatctctagtaaagcggcaaaagcgggtgaggatcatctaccataatgtcgctatcattataatcactgaatacaaaaggacgagaaggttgcagcggcttggaggttggaagaaaaatggcagggctgttcgcctctcaagtctcaacgttggttggtagtggggcagtgaggctcaggagcatcgagcagacatgcgaccgtgtgagtgacatgatccagaggaatttcttcgcttcttttactggaggatctagaagaatttggtttgtttggttttggtgtttggcagtattggcacagcgcatgattgaaactaaaagtgttttgtgaaaaggatggaagctcacaactgatccctttcaggcttgagtacacgagaacgtgcacaattgggccgggcgtgtttttgttggtgggcctgttcttgaacctgatgggctttgctggctgggctgggctaccacgagttcatgagtggggtgatatacagggtcagtcagtcattgtctcctcgttgcattcgttttatcttgtgaaactatagtgccaaagaaagattcaacggtacgaattccatggcgacatgtatgtatatgtggtttgacaaatacacctcttcatggacgggtgcaaatttctgctccagcattacggatctgaaagtgagactagcagttttggaaatacagatttttgaccaactcgaaatgcaggcaaaacttggctatcaagtttgcccccccagccaacttggctcccaagttttaccggaccgaagacacgcaatttgcaaataaggcggtggttcgttgggccttttctgccgcataatcagttttctgtttgcaccttttaacgcataacctcaaattatttgtttccactaggatacttaaaaaaaatctctctaacaaagttctcaactctttgatttacgagatggtgggggttatagggaatacaggccacatcagcgttgagttttgttttttaaaaaaatgcacctataataagtctataaccacaaaaaaaaagccacattttcgtaacttccacaatgtccacctataaagttgcaaaaatatggtaaggtctcactcaaatcatacgtagtatgtctttgtatttttatttatttatttataaaataataactcgttataaaatttggtaatacctaagtagattacttttcgggaaaaccaaacataccattatatttactgatcggatttccctcaaaaaaaaaaatactgatcggatatatcaatcccagccaaagcctacctcgcagccgcagccgcagccgcgcggccttcgtctccgcgagtcgcgaggagcgccgccgccgtcgtcgccgtcgccggtggcaacgccgccgtgtctttttctccacacacacccctttcccgatcgattccgccgcctactccgatcaagcaaggtaattaattagtgtgatcatgcctgcatccatcacaaaaccgtcaataccactttgtcatccgattccaattgatacttccgtttccgactcttggaagcaagaacgccctattaatttgggagaaggccactccggccggcgacgcgcggggctgcttccatctcgctccggaggcaatgactatcaccggcgccatggagaaggtgagtgctcgtataatatactccctccttccctaaatgtttaacgctgctgacttttttaaacatgtttgaccatttgtcttatttaaaaaattatataaaatatgtaaaactatatgtatacataaaagtatatttaacaataaattaaatgatagaaaaagaattaataattacttaaatttttcaaataagacgaacggtcaaacatttttaaaaaagtcaatggtgtcaaacattttgggatggagggagtattagattagaaatttcttgtgggagtgctcgtatgtttgtctggtacgcaagcagtaagattgaatggcttaattaataatacctacagtacacacaatagattaaaaacaaacaatgtagcttgtatttctgcgttagcattgcgctgctttggttaattcctcgcaaaaacagctctttgttttggtctgatgcatttgatatgatgttgtgtgttggtggcttggtgcagccactcgatgagaaggagctggaaaggaagctgaagaaagatcagaaggtactcactctagtaggattgctgttatgtacttctgttaacaattcaaaggaatcgtgtccagttcaccagttgtttggtgtatgaataagtgtgttatgtatgtaataggcaagagagaaggaggagaagaggctcaaggcgaagcaaaaggaggcgattaggctacaggtgttaaaaataatccctgctcagataaatgtgttttactgtcaattctttgtattgatgtggttgtctgcaggcacaagcagcatctgatgaaacaaagaagagcgacaagaaacaaaagaagaaaggcacaccggatgagaatcctgaggatttcgtcgacccggatactcctgctgggcagaagaagctgcttgcttctcaaatggccaaacaatataatccagctgctgttgagaaatcgtaccgcctctcttgctttattcctcgatttaatttattttcaatgaggatatatctttcatatcgttagaaccttaggaattcataacatgaaatttctcacttatctgtccttttttccggtatgttgttttcatgtagatggtattcttggtgggaatcatctcaatattttgtagcagatgcgacgagttctaaaccaccatttgtaatagtaagtccactataatgcaaagagtgcatgattatatatttgtattcaggataaatactttatcatgattactgtgtgagtagtatgtcctatatgaaatacacaattgaagctttatttctacttctcattttgcatttgcaatgtttatttttccagatcttgccacctcctaatgtaactggggtccttcatataggccatgcgattacagtagcaattgaggtatttattgattgattctcctgtttattcattggccatataagcatcagtattgatgtctttttggttgttgcatcgtgaacaattcaggatgctatgattcgctggcggaggatgtcgggctataacgctttgtgggttcctggaatggaccatgctggcatagctacacaggtctgtcatgcatataacatatatatggtatctgtttctaacatataacctctacaggaattattgttaacttgaatacaaattgacttttgctgaaacatcacattgattgttaaccaactttctgttttagtttttaagggtagcaggctttatgtaacaaaatttctcttcatatcaggtggttgtggaaaaaaggcttatgcgtgacagaaacctgtcaagacatgatctggggcgtgataaatttctattggaggtaatcatttttttcttacctattgcatattgtattaacttcacagttagtttcatttttatttatttttttcattcttcaatcttcttggcaggtcctccaatggaaagatcagcatggtggtaccatattgaaacaattacgtacacttggagcctcacttgattggtcacgcgaggtataatttgttttgatttcccctaaggttgtagacagccagaggagagcaccatttatatctaagcaatatattttgttgaataaatatgacaaaactccagacattatggttcagattgcacaaaaccacatgttttttggcatgttgcacataaccaaaggcattatggtcctataattggttaatggtgtggtttagtgaaatcttaataccataatatttgtggttatgtgcgatgtgccaaaactctgagttttgtgcaacttgaaccatacctggggtatataaaatgtattcatatattgttttgctttgttgttaaatagtattgattttcttgcaacttgtttcagtgttttacaatggatgagaagagatcaaaagctgtaacagaagcttttatcagactgcacaaagaaggcctaatatataggtcagtgtcaaaatatcgttgaatgtgtagtttaactttctatatttgttctgcttcagtaattttctattcgaattgtgtgtttcttagtttatgttttcttactgcagcacatcttactttgtaaattctgtatgatttacttgcagggataatcgcattgtaaactgggattgctcacttcgtactgcaatttcagatattaaggtatacgatacttctaatatgattaacattttgatttgttgatgaggaggattgtatttttatgttttgctcgctacttttcaggttgactattgtgaacttacagaagagactttgttagaggtccctggatgtagcactcttgtccagttcggtgttataataaattttgcttatcctctaaaggaagggttgggtgaaattatcgttgcaacaacaagaatagaaacaatgcttggtgatactgcaatagctgttcatcctcaggatgaaagatacaagcgtttgcatggaaaacatgctctccatccctttaatggccggaaactcaaaataatttgtgactccaagttagtggatcccagttttggtacaggagctgtcaaggtaagtgtactcactgaaggagtgtctcgtatatcttaattttattttccatacctggattgattatattcatcaatcagcaagctcttatttcttttttctattttgctgttgtttccatacagatcacgccagctcatgatcttgatgacttcaacactggcaaacgacataaacttgagttcattaatattttcacagatgatgggaacataaatgaaaacggaggtccacaatttgaaggaatgccacgtttcactgctcgggctgctattattgatgcactaaaggcaaaggtattattagattatttagttttccatttccttttctaattaattcctcgatggtattgtagtctctcacaatttcagatggtttattatcatgctttttatggaatttattttacatttatcttctctctctctctctctctctttctctctctctcaatggtgcattgatgtattgtcactttgtcactttattagtttctcacaatgaaatactattgttctctatgaaaaacattatgatattgggatactgttgagtgttgctattatgttctgaaagcatctagagtatggttaagctatgaatataccattcagctttgttcttgagttggcatactgattaatcttttagttttatttggaaatttcatcttgttgcctgcttaactatctttcatgtgccaccagtactttcctgtattctattgtcttagaagaaatgccaaattacaatcatttacaccttttcaattaagggtctatacagaggcacagaaaataataagatgcgcttgggccgttgttcaagaactaaagatattgtggagccaatgatgaagccccaatggtttgtcgattgtagtactatggcaaaggcagctcttgatgctgtgaaaactaaaaggatcgagatcattccaatacaatacgagcaagactggtataggtatatcctattttcttttctttaggaaaacataattggtaaatcgcaacattggatagtagaataacccattcacttctactgttctgtggtaacagatggcttgaaaacatacgtgattggtgtatttcaagacagctttggtggggacaccgtataccagcttggtatgtaacgctagaagatgatgaggagaaagacataggttcttacattgatcactggataattgcaagaaatgaaagtgatgcaatcctggaggcaaagcagaggtatccagggaaaaattataagttagaccaagatcctgatgtgctggatacatggttttcatctggtcttttcccattgtctgtgcttggttggccagacagcacagctgatcttagttcattctaccctacttctgtacttgaaactggactggatatcctcttcttttgggtagcacggatggtgatgatgggaatgctacttggtggtgatgtgccatttcagaaggtaatatttaggttatttcattcttaaatagttcttggtcaaatctgttagattctagtgatagtgatagttcagtatgattgccttctaaaattatttgatatcattttaagtttggtaacttagcttttggtccttgtcgaatcatgttaacttttctatgctaaaaatgaatcaatcattaacacgcggttagaaacttcacaagtactagtaatttttaaaccgtgactcatgactgcttatctgtctcaggtttacttgcatccaattatccgcgatccacatggccgcaaaatggcgaagtgcctaggaaatgtcattgatcccattgatgtaataaatggtatatcacttgaagatctcgggaaaaagttggaacatggcaatcttgatccaagtgagttagaaaaggcgaaagaaggtcagaagaaggatttccctaatggcattccagagtgtggtactgatgcccttcgttttgccctgatctcctacacttctcaggtaaattttcccaccagcttttgttgttccttttactgttagtaaaaatttcttgtagtaacatttcttgtcttgttcagtctgacaaaataaatctggatatcaagagagtgcacggatacagacaatggtgcaataaactgtggaatgccgtccgttttgccatgaacaagcttggagatcaatacactccaccagcggctattgcgttgtgttctatgccacctctctgcaaatggatactctcagcacttaacaaggctgttggcaagactgtttcatcgatggaagcatgtaaattctccgaggccacatcgtctatgtactcttggtggcagtaccaactttgcgatgtatttatagaagccgtaaaaccttacttcaatcaatctcaagagttggaatctgaaagaggtgcttgtcgtgatacattatggatatgtctggataccggtttgcggttgctccacccgttcatgccttacataacggaggagctttggcagcgccttcctcagcctaaagaggcttgtaggaaagattccataatgatatctgagtacccctcagttgttcaggtaaatacatacttcgtactgactttggaaaaaaaaatgaattcttctagcttgtaacttttcagagatcagtatggtagagtcctattgcataacgattaaaagcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaatggagactgtgttggattctgtgaacaagctaagatctcttcggccacatacagatatacatgaaaggtatgcttatgttcaccagatgtatattcttttggtgtgcttcaagactgtcacttcctttttatagttttattcttattttgattcataagaatttgttcattttgaagctaataccttctgccctattttcatctggacagacggcctgcttttatgctctgccgtggggtagacattgctgccattattcagtgctaccaggcgcagatttcaactcttgcttctgtttcatctcttaaggtttgctcggtcttatacctctctggctctctcaactcggccactcacctcaagtcactgtttatgaatgccttgttcttgatggataatggcataatttctatttctatttcaattcaattcactcgagttttgtctacagatgtgcttatatttttgctaatatattttatgtctaaaatgcctaaaaagccaaaaaaaaaggagggaaaaaactgattcaaagggaacttttgcagatactgacagaggatgatccaactccacccaactgtgccacaaatattgtcaacaaagatctatccgtatacctccagctacgaggagctctaaacactgaagctgagcgtgagaagctaaggaaaaagcgagatgagattcaaaagtaagtgccctgttaaaccatctgaacataaatttgaacgaaccaatttgaacataaatgaaatttgtagttttgttagtggtaagacgttctatttcccactgtaattgcaggcaacacgacaccttgtcgcagaaaatgaatgcctcaggctatcgcgagaaggctcctcagagcaagcaagatgaggacatgaaaaagattgctgcattactggaggaacttgagatcattagagaagccgaaagtgaactagaatcaaacaactgaaagggttttgatgtatagctttttaatgacctactgtgacttgtacgaacgcaggtgattggcatattttatgaactcaagcaagctcgctttcagcttgtagggatcaagaaacacttccactttgtaaatccattcgttctttatattttaaaggaatgaaaggaaaattttctgttgatgtccatcataatttggccttctcttgaccttttgtttaaactaggtctaggtcacgcgcttcctcttctccccctccccatccggccgtttcaggccttgttaggttacatggccaggattcgttccgggccggaaataatagaaataatagatataacaaaaaatttataataggtagaacaaaagaaatttatagtaggtataacaagagaccaggatttattcatggtcggaaactaatatactcatattaagtacaacaaaacatccagattagttccatactgacatctaggccgtgtttagtttcaattttttttttcaaactttcaacttttctatcacatcaaaactatcttacccacataaactttcaacttttccgtcacatcattccaatttcaaccaaacttctaattttagcgtgaactaaacatagccctagattagttctatacgcgtgaactaaacacagccctagattagttctataattcttggctagtggatgattctttctatacttcttagctagtggattgattcccgttctcttatttcttgctagtcatttccggcccgaatttgaatccgggcataaccgaacaaggcctagggatccctcgccgcgtgtccttccgcagcgtgccctccggtgatgccgccgcatgaagacaccctcgatgccggcggcggcgacgtgctcaccttcaggctccaccccctcgccgtcttgaaattatccgaccgcatccgcgagttccagtaccaggcggcggcggcggcgcgcgtcagttacagctcctcctcctcctcgtcttccgggacggcggcgccggaggatcctcctcctcctcctactcggatgtctgggtgcgtgatcggggttcggcgtggtgggacggtggatgtctccgacatcttggacatcttgatcttgcacggccccgaccccgcaaccttcgaccgcgccttactggagaaggatcaggagatctgtaactaaagctgctagctacccccaagtcctcccgtcatttttaggatccatcgattataatttgtgggtggttaatttgatttgtgtttcttgcggttcagacaagaaggccttccccgacttgtccgttctcgggtggtactccattgggaccaatgtgcacgccaccgacatgggaatccaccatggggactacaccgacatgcaaatccaccagacagtgagttttttttataaccatttaaatcaactctatttgttcgagtgctaaatatatcacactctcatttggcttgtgctttagtgtttggtcttattatgaacaaaatgtggggtattcgggtgtaattcgctgttagtatacttaccactagttgatggtagttgagatgttcagtggacaacaattctgatttaatgagtggagtgtctgctggaaatcctgttgcgagaacacccttgccccgaaacgccacgtgtccgagtttccctttccgagtaagggcccctttaaatcacaggattaagaaaatctagaaatagaaaaaacgtaggattttgataggaatgtaagtgtaaaacagatgattgcaaaacacaggaaaaacacaggaatgaccgtttgattgaaatacaggaaaaacgcaggaattggatgagagagatagactcaaaggaaagttaccaggaggttgaaactcttgctaaattttctccaaaatctctataggatttccattccataagaattttaaaggattggatatgattcaatcctttgtttcaaagggcttcataggaaattttcctataggattaaaatcctccaaaattcctatgtttttcctccaaatcaaaggggtcctaagctttgttagacacgtgcttatctacacgtagagaaagcagctattctgttgtctagcatgaccatgcatagctttagcacagctttagatgagttttcatgcatttttttctaccttatgaatatgtagtctgatagaaagtaattgtgtaaaagttcttgatatgaatgttccgattgctgaatacaattcatattggaagtcttttaaggcatcacccaaagctaactggctacctgctgaaagtttcttttcatcctgttggaaatcgcctaatagaaagtttccccgttgaatgtctcctagtagaaagttttaccattggaagtctcctaatagaaagtttcactgttgaaagtctcctaacagaaaattttcttctccatataaaatgcattttttaactttgatggaaatctgcttctactcttttcagaaccctaagtgaaattgattgattacacactaagaaaaagcaaaataaattattttccatgcaagccaagcagtgaatttgtgtattaaaaaaaatcccagtggctactggtttgaatgcaaacaaaaaaaaaaggcgtatcatgaacttagcttgcaacaagaggaaaatgataagagttccttgctcatgcaaacactcacatccacgtaccatatttttattcaatccattatatttcgcatatttatacttacaacataagttgataaagtcttttagtgcttgtggaaggttggggactccctcattatagtatgcgtaaagtgcatagccggtccctaaacttgtacgactgagtcatttgagtccccaaactctcaaaatgcatatatccaaatcccaaaacttgttaaattgtgtcaatccgatcacaaactgccatgacacctccaggatcctacatggcatgccacacggacgatgatgtggcagcatcacaaattctacaccaactgacaaatgggccccaataaaaaactttttttaatatccttttctgttcattcccatcttgtcctttcttcgtttctcctcttttcttcctactgcattgaccgtagccatggcctctggtcgagctgcctcttcgatgacatgaacagcggtgcgtccatgggcaagaaggcaccggcgcgacagccgtgtcgacggaggcgctgcagcgtgtgggcagcggtgccagcgcggtgatggacgcggttgtgtcctgggcatcgaggagactccggccgggagcggcgcgactgcgtgtggctcggcacgtttaccagcgaggccgaggcggggcacgcctacgatgttgcggcacggcagttccgcggccatgacacagtcaccaacttccgcccctcgtcaagtctgacccgaaggctgccgtcgagctctgtttcttcgcctcccggtcaaaggccgaggtcatcgacatgctccgcaagcacagctacctcaaggagctcgttgttgagctcgcgacgacgtggcggcggcggcagcagggcgagctcgtggcaggagcgcccgtcgcggtggcgacggcggtgcgaggcccacggcggtggcggcgtcagccgtcggcaggagctcctggaggtggtgctgtcggcggcggtggctgccgacggcggccgcggtatccggagcgtccacagcggctcacggccggtctgggtgtggccgagtgttggtcggctagcaacgtctgttggcgacagcggcggcggtgtggtcgtggcagttggcggcggcggttgctagctgcttggtggtggagggcgacggcgcagcggcggtttgcggaggcggtggctcgcgtcggtggcagcggcgacggcggccatgactgtggaggcagtggcgatgtcggcggcggggatggtgacggcgaggtggctgagcgttcggcagcagcggctgcggtggtggtgaccgtgtctgcggtcatcagaggcatggcggcctcggatggcttgccgagggcgtgggagacggctgcaactggccggcgcggcatcgtttggtggaggggtcggagaccggcttggcgcagagaagcgcagccgatggcagcggaggccggctcggcacgagaggcgcgggcggcggagatggaggccggcttggcgcgagaggcgcggccgatggagggaggccggattggcgcgagagacgcgtccggcagaggaggctggcctggcgcagataggtacggccggcggtggaggaggcgacctaggtgtgaggaggagctgccggtgggtgtggagcagtctttggcgcacgaaggctggccgccggggggtgctggtgcaggggtcccacatgtcggcagagctagtgttgtggtggagcattggtgcgtcagtcgtggattcgcaggtggtgagcggtgggtgaaaacctagtccggccttggccggaccgacaacgatggttcattccccctcctgagggcgttgtcgtgctgtctcacccctcaagggtgtttgccgggtgaaagcccagtcttggctccttggagtcctgatggacggctgtggcggtcttccgtcgcttctcttcttgaagacgtcgttttggcatccccttgggggcaatctcatctgtgtccctttgttggtctagtggcggtcggtcccgcttagcggcggccgttccggtgctagccttctcctaggcttgtgtgttggtgatgtcggtgtgtgggtggtggtataattttttctttttcctggctacgaccctccagggtcgtaatcttgtattttttttccctgctctatcaatagaacttcacaccgtctcgtgcgagtcgttcaaaaaaaaaacaagtgcgccttcacctccatctcccatcacctgttcgacaagatggtgatcccgaagcaaccagaccccgaagaggccacgtcgccgcctgccaccgccgtcggtactggtgttgcgcatggtacacggcctgctcaagaacggcggcagtggcgttgtcgtcgccgcgagggtggcgaggttggtttgccgttgcgcttgccgtcggcggagccgttctggccgaagcttagggttattgccgctggctttgacttcggaattcgtcgccatcgtcgatccttatccgaaattgaggtctctctcatcttctccatgccaaactccctccttcccctctcctccccgtgccgtcctgctgttggagctcaccggcaaggtacccgtgtgccgcggtgccgcctacctgttcggccgccattgtgtcagcacgatgcgccgccgctaggcgtccccgcccaagccgagaacacctccaggctccagctccaagttgacgccctgatgctcctaggcagccagccgtgcccagtcggaagctcgccggagcgccgctacttcgcatgcccccgccgcttgtacaacaaaaaaaagagagagaaatagagaagagaaaggaaaaaaaagtgaaaggagaaagagaaaaaggaggaaaagagagtttttaagtgggtcctatttgtcagtcaatgtataggtattgatgaggccacatcagcgtccgtgtggcatgccacgttagcgccatgtaggatgccggaatggtggtggctatgttggaccaaaatgacatactttagcaagttttgggacttgaatctgtattttttgagttcggggacccagatggcacaatgacacaagtttagggaccgggtatgtagtttactcttattattgatggtcggtaaccacttgccataacctaatcaatgtaaacacattttgcttctaataaggttgtattcaaagtttaacatttgaggatacaatgttcactcctgtgagaatgaaaactgaaatttttgatgaggtaacatggcattgggatatagttttagcattagtttaagttcttggagagtctgagtttaacaagtatgcggaatgattacggctgatgaaatagccagcaataattgttatgttgggatgtacactgttcttaaactttatgtagagctctagcttgttttgttggatggatggaatggtggaaattgattttggctgagaatatatggttgagagaatatttgtcaaaatggatgtttgtttgatctaattttactccctgcataacctttcccttgtactatttttatgtagttgatggatgctaatggaacagccttttatcttctattaaatcctgcaatcaacttttcccagaaggatatccctgtgactatttatgaaagaggtaagaatcattgaatgtatcacaatgtccctgcaaaaaagaatgtattgatttctcttgatccttggttccaccctgaatcagttatgatacttgagggggtttatatgtgctgcattgactgtcaaggtttgattttgcgtatgtatcagatatgcatgacttttgtgaatctttcctcgtgtgtaaactaccaagtttagcattcaacatcttagtgaattgcatgctgattaactttattgtttagagcagcaaatgatagttatttagcgagctgaagattaactttattttgcttctgcaatttcaagtgttgtgccattccaatgggagtcccccggtcatctttgtccaaggaaactatacagttgaagtttgtattctccccatgtgtttgtttagttacaaatactacttacaaacactacaagcatgttttattgaagattgtaggggtagagaggatatctttagaccatgctgattttgtctatccaagtccatgcgtagttttcgatgttcttgcgccacctcttggaaaagagtaagtacaaattttatttccttcctatgagatatgacttgaatcaccttacaagtaaatgtgggatataaaacttcacaaacaaaacaagtttaatactgtggggctgtttggtaggttcagtgttttgggctgtgttgcacagccccaccatttggctagagtaggcatagctttgtgctcgccatttttgaatgcgaacaaacgctgttgcaggtaactactttgtgctggctacagccgctttaggctctgtaaatatagatttgtttcctcttcttgtcacatatgccttgaatctacggaaatgctatataccgggatcccgtcgggatgggatcccttcgtccccttgcctaatccaaagaggagtgagagctgagcgcacgcctgagccatgaggaggaggtggctgcccgcgaggacctccggcgagggccggggaagaggacccgctcgacgagaggaggacgcggccgccagcgacgagccctgcgcagtgagctcgaggaccttgtctgggtcgcgtcgaggcaatggcgcgtcgcggccgagccagtggcaggggagacatcgacgaagagagggagggcggctgcggccggagctacgggaggggcggctgcggccggagctacgggaggggcagcggcggtagtagccggagttgggaaagggagcggcggcggcagtcggagccatgggagggaggggcggcggtggtggtagccgggggagggagcggcggcggtggtagccggagccaggggagggagggacggcggtggttggagttacgggaggaaggggtagggcgacggcggtagccggagccgagaaagggagcggcggcagtggctagagccaggggagggaggggcggtagtggttgttggcgtcagcgccgggtaggtgtccggcttctgatacccattagaaatcacctgatatctagtaagtagcgcctgatatctcataggtatcacttgataagaatcgtatgataccttacaggtattacctgatacttcgcaagtatcacatgatacgtgataggaatcgcctaataccttataggtatcaggtatcacctgatacctcgcaagtatcggcttatacctaacatgtatcaggtataaccatcaagtatcaagcaattcctaccacgtatcagggatacttgcgaggtatcagatgatatctatcaggtatcatgcgattcttaccacgtatcaggtgattacttccgaggtatcagatgatacctatcaggtatcatgcgattcgtaccacgcagagggtgatacttgcaaggtatcaggtcctgatacggtatccggtatcgggtgatacctaccaggtatcgtgcgattctaccacgtatcaggtatcagacgattcttatcacgtatcaggcgatactcgcaaggtatcatgtgatacttatcaggtatcgcgcgatttctacgacgtatcggggtgatacttgcgaggtatcatatgatacctactagatattaggagctgggcatcgaggcgtcgttgccggcggccgcgtcctcccctgtccacgctccacaccgaacccgaacctcgtcgccggcagccgcatcctcccccgtccacggtccacatcggagctcatcgccggcgaccgcatcctccgtcgggagctcgtcaccggcggccgcgtccgtcgtccacgccttagccggcggccgcgtcctccacgccgaagctcgtcgccggtgccgttgccatcaccacacaggatcctccaccgtccacgccccacgtcagagctcgtcgccggcgccatctttatcaccaacaggatcctttgccgtccatgcgaccatgccccacgccggagctcgccggcggccgcgtccgcgccgccggtgtcagcctcgtctgcgctactcccacggaggcccgcgctctcgcgtctgagggaggtggagagggagcgatcccgttgggacagtatcccaacgggattccggtatatagcagccccctgaatctaaattactaaatttataaaatcgcaacaaaacaggctaatttactaaattactttggtcttgtacttgcagaaaaaatgcatttaggacgatgctgtttgaaaccccttcgggatttgtaatgttccgtgtttcagatgttttgtttagatatcctgaggtatgtataacttttcattcaccctagtgtgatgcataattcatttttcttctgttacatttaggccctacaccttatctgattttcctttccttttgtaggacatatggtcgagttttactgatccacgtaccgcacaccaggtacattttaactcctaaatttcctttcatgctttttgtttgtttatatctatttatcgatttattgttttttgcacctttactatctatgtacatcctaaccattactgttttatttttttttgcacctttactgtaaaagtacatcctaagccaactaattattgctttattattttttgcatcttaactgtacatgtaaatcctaagcctttaaatgtgtttcatacaattctatttgtatgtcatttgttctcttggttttattaagatcctaagcctttaaatgcatctatttgtaggctgttcgtaccattggttttattgaggttggtaacaaatctcttgtatgggataaggatattggtcctggcgaggatttagaacaatttatcctaaaattcccaattacaaaatcattggttgttccaaacgcacagcttaaattcgttattgagaaaaaacttggaagtttacatctaccctaatgtattttaatgttgatgtttatttaatttttttgttagtgtggaattattaatgtttccctgttatatatttcttttttcagaacattggctgttggtttaatgggcgtattgttcctgagttgatttggggactaaattatgccctggatgaatttgtgcctcaagagaagggcaacctatcaaatgaatgccattttccactgagcaagcaattgcatgagcagttaaaagcatatggatttagtatctcaccacaattagtatgttttctcctttgctaatattgttattattctctgctgaccatccttttattgttttcttccttggtctgttgtgttaccttatttatttatttattgttttgtgttaccttatccttttattgtttaatcccttaaaatatttgctactgtactatctgttgggttaccttacccattattgtttaatcccttgcatatttcttgctattgttgtgttgccttattattttatccttttcattttagattaacagagagtttataaccagtttcggttacttaaattatctggaacgtacttcgaagaacatttccggggatttacaccagaaatttgatcgtttcttttgtggacttgagatgtctgagggagtgtttgtaaaagttgttgcggaccgtctctgttccatggaggtcagtagatttgctaaaagcaaatagtactaataattaagtggtggctactgatgaacaatttattttctttgttttctgtaggaagtggcatcaacaccaggcagacgagaggcattgagcaacgctgaatttcttttgacggttcctaagaagaagtataacacattatctcgtcttaagcgtatggaggcagaagttaggggttcagggccttgggttttcgtagctgtttttgcagtggccttcggggttatggaaggattgcgcattgcaatgaagcgagcaaattagaactgggtaataggaccaatgaggctaaattaggatccgtatatatggtgacaacttttgtgatctaaagtgaccagtaaacaagtactgttttaccaccagttcatatattcattttttttttgcataaataccaacacgcgtcatttactctgagaaggcgaaacgtggtgcacatgcagtgggagaccaggaggaccggtggggaaaccggacaaaaaaaaaggaacggttccattgctcacccaatcgaggagtttctgcacctgcatagtacatggcacacctaccgaggagccgaaaaaaaattcaaaaaacagagccctaccaggctttactatcttattattactctagtaccatcctcttttgacactgcaaatgctaatgaaatttcagaaatcatgtaggtttcagaaaatcccagaagaaaattcataaaacacaggggcaagactgtaatgtagtagatgggtttaactaatatgctctattttttctagatttctgtaacgtaatgggtctaactaatctgatctctttttctagatttgtctactaattgctgatacaacagcatgtactgatacacatactgtaagatggtcaacatgaatcaatagaccgttcactgacagttcttctgagcacatcaacgtagggcaaaatcctctctacatcaggcccataatacagcgagaatatcgcatctgcccgggcgaatgcagcagccgcgcttgcgccatctcccatggaaagctcgatggagacgagcttgatcaactcgtgcgcgatgatgatgtgcctggggtggtaaagcttctcaagaatctgcatcatcacaggagagggtaactcagaagtcagaacaatgaataacagatgtttctatagtccctagaagggcgagtgagtgactccgagtgatgatttgaggaaaaggagaagattattaccttgatggatgcttcacagtgttttcttgcttgttcttgatctcctaccttagcaaaggcctcagcaattgtgtcgtgtgactacagatttcaatatggtagtaaaaatgaaagaacttagatcattcttttttacatcaagtgcaagaaaactcataattaaactagtacaagcaccaaacctgagcaagagtcttgctatatgggtgccttaacttcttaatgcgttctaaggattgtagtgcttctgcaatgaggactttagggacattgtctagagatggaagctccttcaatctgtcagcataattgtcaatttgtatgtgtaaagagcacagacaatggaatcaaatccagcaattcatgtgcaatttcacaggaatataggatatacctggttatctttgatgttgctctatctgacatagcaacagcagaagacaagtcaagttgggatctgcaactcatacagaatccaggatctatgttgaacatggtatcactcttgaaaaatagttttccaaccttcactatatcctcatcaaacttagatacatcctgatgcaaaaagaactgttataccaccaaattactaacaagaaacttttgagaaaagaatatgtgaggagaataatcttacaggtaatgataatgtacagacatgagattctcctatggaaacatgcacaaaattctctttgtgtctatgatgaattaattctgatacagcaccaaggcaattactttgcggacagcaaaatgaattcatgacaaggtctgatagacttagtactgaacaacttgaacacccacaactgaagtagtaattctcccgaagtgacttttgtctctctggaagatccatctcaccaacctgaaaacgagaaacatagacaatgcagaaaatatatgtgctacacgtgatgtcagtatatcacagagggagggaggaaagatacctgtgggccgtatgacagctcgattgggctacctgcttttatatattctgtagaccttagaatgagagtgcgcgaatgaaaatatgcatgtatgttgggccggcacgagtggttgaaaaagctaccagacatgtaaatagcttgagcaaccctgacctaacaatgcaaaactaaacacaggttatagatggtcaagataataaatgagctgcggtgcgataactcaactaaagcaaagtaagagtaatacaatactgtgcctgatattgctatttattgcaatttaagattagctacatgttgtcatgtgtttgctgaatttactacaaagaatttttcaatttccaaattgctatttacctgaacatgattcagaaacatactatcctaaataatgtactcctatagaaacaccatggttggcaacaaatatcaaacagcttttatagggtgatgttactagagaagataagaagaggagacaaacctgttccacactacacataacatcaccactaaatccagaaaacccctttgtcagcgccttgactccatccatggatttcatatgaacaattgcaattgagttgactttaatttgacatatcaaaagaaccaactgcagatatagttacaagaattagcttcttcttcagtaattataaataaatatgaaaatagtgttccatcagttctctacaatctacatcctagggggcagaagtatatggcagaattctgaaagtttaagaaatactccctccattccaaattgatctacatatagtatttttgaggttattcctaaatgatctacatatttgtgttcattcattaagcctattcgttatttgtgcattggagtaaatggacattgatgcatgcatccatgcacacaagtataacccacatgcaatatcttgatttgctattggctaagaaatagtggggatagtgcatgcatcaagtttgatgctagagtaaatatagtatgagagagttattaacttttcttggtcttagtgtacctatgaaatatgtagatcaatttggaatggagggagtactgagctaatataaacaataatgtcaaatctgatatccagaacaatccaaaaaatctgactaaagcagccatcaagctcaagccacagttgtaatgaaacaagcaattgaaaatgtaaacatacaaagggaactcttgaggacaaatgccacatatacctgtgataaagaatcctctgcccacgagacacctgatttataatagctctggaggcataagaacaggacagttgcatatatatgtgactcaaatttgctagcagaagaatcttgatcatagtggtgaacgagatcctgcaacagtttagttcattagttcctgatgtaacagtacttatgctataacatttgagtgcttgcagacatgaattctcttataccagatttggaccagagatggtagatctctttccgaccagcaattgtttctctatgtactgtgccattatccgcccagctaaaactatatcagctggcaaaacagctgcccaacaggcacctccacattcatgcctatgttcagcaatttgtttagagtctggagtcttgctctttgtagaagttacactcaattttgcaatatccaccacattattgttagattctagatgagtattttgattacaagacatttgtcctatagccttctcctggcacctgtttgaacagtaaatgggtattgtacatgaagggcagactacgacatctgctggagcttcactaaagcaatagtggcagtgagtatcccggcaagatttcatgataatctggcataccnaaaaaaaacccctttgggtttaaacccaaaaaaagggtgttttaaaaagagcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtgaggctggagaaatatcatttggagacgacattcctctacctttgttgggtgtagaggtacattctagaataaccttaggctgttgctctgccatttagccatatcgttcacttagtatacatacgtacctaacctttttgaatactaaattggttgtctaccatcattaccgacctgtatgtggcatatctgcattgatgcaattgctgcttgctgtcccaacttcattcacattttgatgcttttgtaaaatcaacttcaactcttgttctatgttactctttccagaagaggttacttccatgctcaaagcaacctccaaatcatgtatggaagatgaatagttcctaaaagatgcatttaccatcccccttctgtaccatgcctgaaacccataaacagaaacaggtgaaatcatcagagtaacttagtttccattctttagagtgaaatcctgcaaatagagacagaacaaacaacccaagcatataagatgcattcaacaaagttcccaaaccgtattgctaccttagcataattaggtgaaacagaaatggccctgtcgcaatctcgcagacactcttccaaaaggcccaatttctgtaaacttcagaaacatgatcagaacgcatgcactatccagtaatgaggtcagatggcaggaaaaaaatccttagatacataaaagggaataagctgaatataacctattcacaatgcactgtttaccatgaaacaccaccaagaactagaacattacatcaatatgtccagaatgcaaacaggtaaatgaaagactcacatgcatggtagaggcacggttgacatataatgtggctatcaagcttgcatccgttccatcaggactaatcgggaagtaccgtaacgcctgtaacaacagagaaaaacaattagctatcatcaagactgatagattgaatatcaataaaatgggcattgtcccgtgccgatttgttccaaaaaaaaaaagacagatagattgcagtccacacacataaatgctagtactgaaaaggagtgaggatcattttcttttgcaatatcaacgcatcactctttaaaaaacagaacaggtgaacaacaacaaacttcgaacagtaaagttacttctgacttctgaacttgcactcatttttaccaatcgaatcagaacccatcacttcatcacctacacaatccaagcaatcaagaggaagaagaagaaaaataaacgagtaacacaacaaatcaacctgcgagtagaatccaagcgcttgctcgaactctctcttggagaagcacgcattccccttccccttcagctcggccgccctccccttgtccttgcggcacagcgcgagctccgggtcggtcagctcaccaatcacctgccctcacaccaacacgccacgcgaacgataccatcaaatctagccgcacccccccatgcctgggggaagaggaggagcagcggagcaccgagcgacgggaggtggttacctggcggaagagagggagagcttcgaggaaggcgagcaagcgggaggtggtggaggggaggtcggccgccgtgccctcgccgacggctcgccggagctccgccggcaccgccgacttgagccgctccatgggcgagggagagtgtgtgggctgtgggcagcagcacgcggcgctcgggctttgagcccaactggatgtattgagcctacgtgggctgagatgtgggcacagtatagttgggccttttgggcagaggctattcgtcccactacgacggcccaatgaggtgtgcagcgtagtttggacttttcatttgggcccctgaattgacaagtattctccatttgggccactgttgcattttcctactttgctaccttgcttggatgatggatataaatatacagaaaacctacaccacgggcttccgggacaactactatcactaaatatctagcatccttatcctcttctttgtctctttcccttccttctcccttctctctctctctctgactaccagcacgaagatgacgatggtggctagctgtgcggggtggcgcgttgggcgtggaggacgctcgtcggagccagtgcccgccgttgtccccgtcgccgtcgccccaccgccgcggggtcgaggcgacgacgaggagctcggcgataggtgcggtgaataagagggagagtgggagcgggacgtggaggccgctgctggcgccggggacggcgttgccgggcgggagcttctcctgtcggctcaagacctcggccgccgaggaggacgacgacggcgcggccccggcaagggtcgccctcaagctcgcctcccttaccgcgctgctctggctccccgccctcgttggtcttctcatcggctgccccaccttgacgaccatcggattcgccgctgcctcctcctccacactccgcctcgccgaccaccagattcgccgccgcctcctcctcctgctccaccacgtggctgccttctcctctctctctctctctccttctcctcctccaagttaccaggtaccaggtatcacggataccaggtacaaggtattaggtatcatggtaccagataccaggtaccagccggtaccagatttcaggtatcaaaggtatcagtcggtaccaaaggtaccaagcaccaggtaccaactgatacccaaggtactaggtatcaagatggagtgcacgtggaagcggagaggagtcacttaaattatcccgttacaacgggatcccgttttgtagccgctctcataaatatattataattataaccagtctcttatagttggattacccaccatggattagtctcttgtagttggattattcccccaccatggattagggtgattaaaccggacctcttgttgtgcaggcagtaaaaggtggttgtgtgcttgttgtgacacaacatttacccccaaatttagctctcatttgagctcgtcagctaattaaatatgtgaagatcaagttgctgcagttgatgattttgaattatggatcattcaatcatgggaaagagacaaagaatggtacactggtaatgatcggactttgagccgatttatatatgaggatcatttaaacatgggaaagagccaaagaatggtaagctggtactaatcggattttgtgagtcaatttatatatgaaaatttctgcagtggacaaaacacttggtactgctgtcataggagttctagaggccttcaagagcatggtttctggtcagcacggtagatttcatagagttgtggtgcagaacattctgaaaaacctatgtgcctatgccaaaccagacagtgactgccaatactccatgcagaaattttctgtagacaacatctcgatggtaagaacacagttttgtacctaataatttagctaaacagattaagatttgatagttgtgttgtttgatgcatacaagggactaatgtttatgctggttaatttgtaggcacttagaactatgtatcagacagacaatcttataggggaggacatggaggcctttcttggccttgttttgcagttcagcaaacttctctgtgagaccgatttcatcgaggctgtcaacggaaatggaatcggcttaaggaattttgtacagaagctgaaattaatcctgaagcaagcaaattcacatagaactgaagcaagcgtacaccctggaatcagaagatccgcaattgagcaggtcatatggatggcgcaactgaagcctgaacctcactgcatcgaccatttcatcgactgctaaatgcgggacgatctggtgatggcgcagcagacagccagaagggcatggcaagagaatttcaagctttcatctggaggcgtctctgtcctggagtacgaagagtcccttcgctctgttgcctcgagggcactgaagctgatcctcggtgtagggatgaaaacggtcggaaacggtcggaaaaaccctctaccatttccattttcattttattttctcgaaaatggaatcggaatggcatactcggaaacggtaacgatatcggtaatgtcggtatatcggaaacggaaccgttggaacgggaatctaccgatgtcggccagaagtcgaaaattcatgtcggaaacagcgaaccgtggtatcatcccacatttaactatatatgaagatggccttataatttcacctttgcatgatcacgctgccacaccccacaacaccgttatatgatgattaataagttgacaataaggtcgacaaacaatataaacaaagttcaacgatacttcaacatcaatgtggctaaagcatacaatgtgggttacatgataggattacagcataactaatattgtccgactttttttagatatagatttgagtcttcgagaacacggcttccttcttcggaattttgtcggaaatttgacggaaattaccgataaaaaacggttaccgacaaaacggtcggaaaaaagcccatatcatttccgctaacatttccggaagagattaccgttttcatttccgacaccgacaatttccgataccgactgaaacggtcggtgcaaaccggaaacggtagccggaattcttggatatttccataccgttttcacccctacctcggtgagcacaatgcgccggtaatccgcccgagctttctgccatgtaccagtagcgaccactcgtgagttcaggggaaatttcaatgcaagccttgttctgtttttctttgaagaatgtgttgaagtttaacacgaccggggcactctggttatatttgtgtttggagtaaacattgtaagccatatgtgctaaggttgttcaatttacatcgtatcgtcgtgtttcacttgaaaaaaaaaagagagagcgagaggaaaaaatagatctaacttctgattgctcatatatgaaaactcagcaagtgcacttctaggtcgctatcacgaaccaacacaatcacaccaaatttctcacacaagtgccaccgatatgttgcaaatccactcaagaatacaagtgctcaggaatacaatcaagagagtagaatcagggattgggaagagtaatatagggaaggcagaagcatgagattggaattagagaaatagaatcagaggaggtagagttggaggaggaagagagccatggcaaagccacaagttgaatatctgttcatcaatacccccaagaactgcagtgtggcttggttttatactcctccttgctgtttggttgggcctagagccagcccagcccatgtacatgacagtcgcttcctgaatacctgcatagtgttcatcaatctgggcagatcggtgagcccaacatctcacagtgaaccaagcctgaatctatttggttctcgttgcattgcatcaaacaactgctcgcaggatcgccggccacaggatcgagattagagagggaggccattggggaatgagagcaaccgggaggtggttgaaaggaagtagcggagccatcataagcgaaacggtatatttgtgaacgaaatgtaatttataagtaaaacttttatatccgtgttcttagcaatctaaaagtaaaagctaaaaaataaacttcgatgaaaagacctcaaaatcagcttcaaatttaaggttaaaaatttaaattttactccctccgtttcacaatataagtcattctaggatttcccacattcatattaatgttaatgaatcaaatatatatttaaattttactccctcgatttcatatatatggtaacattaatacgaatgtgagaaatgttagaatgatttaaattgtgaaagggaagtcgaggcagtctctcgccgtgccctggtcgagcttgaggaagatggggctgggtggctttacgtgcggcaggaaaatcggcccagtggtgttagatttcttgggctggatgtttctggttttttaatgcctgtttgattcgttgccgaaatcgacctcgccaaatttcgttaaatgcaaaaattagttaacatggtgaaaatgttgtttagtttgagaccatactgaaatttgatatggattggcgagtggaaggttcaggaataaccaaattttgatacgaatttataaggttatgagttatgacattaagagtttgtttggtttactgttataccaaaagtaattgtaacacctcaaaccagatacctaaattcaaggaaccctcacatttggctctttgcttttgggttgctacgaatggcaggcaacttcctccgtttcaggttataatactttctagtattgtgtatattcatatatatatatttagattcattaacatatatatgaatgtggacaatgctaaaaagtattataacctgaaacggaggtagtactatttgtttgggtggtcgttaccaacaattaattaatatcgatcatgtatttttcatttgggcccttgtttggtagtagcgatcatgaatgtttcatatggcctctagatttcaaccagtatttttcatttgggctaccagttgaatcgctatcagtggtaacgatgaagtgtttttcatgtggaccctggtttggatctagtataggtcgttaccttgttgttttttttttgttttttttttactccctgtaaattttgggggcttggatggatgtattacatgtgcaagaagccaagaactgtgggggttttggtggcctaaccgatcgtctcacacgggcaccgtgttgttaccggtcgataccaaaatatgggaccgatgtgggatgtcaggtcgcacagatgacggacacactcatgtaggtgaagagaggttgtggagaagcatcaagactcgggcattgttcggttggaagaggaaacttggtactgttctgggaggatatctggataaatgggtcatcgatttgttagttggcgccttccatctatgatgcggttcctgcgagatttcgcaatcacaggacagttgcagaagcacttctcaacaaaagatggattcaagacataactggtgccctgggaatgcaggctattctcgagtatcttagcctctggccagtgatgaagtctatacagctctcggaccaggaggattcgctgcactggagatgggagacgtcaggtgaatactcctctcggtcggcctatcaagcacaattcctgggtcgcattcgcttccagtccagcccaatctagaaatctttagcttcaccaaaatatcggtacttcatctggcttgttgcccttaacagatactagacagcagatagacttcgaaagcgaggacttccacatcctgccaagtgtgtcctttgtgatcaatgcgaggagagcattgatcacctgctgatcgtatgtccagaatcttgccagctttggtggatggccctcaatgcgattggacatgcaggatgcttgccactttcagattcgtctttccatctttggctatgtgacagcacgatgaagcaatgcaaggaacatagacggggatttgacaccattgtggctctggttgcttggaccatctggaaagagcgaaacaatagagtcttcaatcagcagcaaagatcctacatgtggccagtgcaatggcggcagaagctgaactttagcgacttgcaagattggcagtgccggagctgcgtttgtcggacggagacatttggtcgcaccatcagttgcgagattagctcctagtctttttattttcatgtaccttgtccccttcattgttttcttaatttccatgtaaataacttttattccttccaaagatgcactccttgcatattcccaaaagacttgggcattgtgcgaacgcttgaggaaatttttggatagctaatggaagtgttgtcaaatttttaaaagtagtggaggtgggtaatgttatggcactaaggtgctgtttggttcggtaaaattcagcccgcacccgattccagcgcaaacagatccggttcccgttgtttgtttgagatgctccgtaattggataccttggaacccattacgggcccagttcagaggcgataccgctcgatcaggagcgataagcgttaacgatacggagaggcaacacgagaaagaatcaagcgtcgcctccgccgctcccctcgacccacgtgtgagaaccaaacaaaatctaagtttgccgtaatctgattactatcacagtgctatctgatgtccttaccgtttacgtttgcaatctccaaccaaacagcacctaaagtttatttggtttgtttcccgtaccaaaacactttaaattaaatttaaggatcacgcatctcgtttggggtgttgtcaatggtagccaactatatatttagttgtctagagtcgctaccaataatattcatgatgtactagtcatttagggcctttgtttgggtcgttgttaatggtagcaatcacgaacatttcatcttgcctcagatttggactggtatttttattttggcccactagttaaatcactatcattggaagtgtcgtagcaatttcatgtggatccccctggtttcaatctagcatgggcaacgacccagtatttttacattttaaaactattggttttgggtggacttctaagcggtcatgtcacatggtacaaagttaaaacctattccgaaatggaaaaagtacgaattacccccccccccgaactattgcggtcgtccgaattacccccctcccgaatcacaaaaccgggcatttttcaccccccccaaccatgcaaaccgaacgaattacccccctcgacccaatccgcggtggttttagtccatgtggcgtacgcgtagcagtccagtcagtactctatttattaaaaaaatgtgggacccacctgtcatctcctcatcctctcttcctctctcttctctctctcactcttcctctctctctctcaaactggtcggcggaggcgtgggggagagacgcagcggcggcgtgcgggcggtggcagagcgccggggacggattcctccgaccactggtgttgtcgttgccgaagtttaggatctcgctggtctccggcatgaagaaaggcggtgccgcggcaccgccgttggacgcgaaatcagagaagttgagctcccggcggaaggggccctgctgagcctggctgctctgctgctgccactgaggcagcgcggccggctgcgagggcgttggggcgtgcaccgacagaccggctgggattctccgtgagcgtgctggggcgcgtcggtgagccagagcacggagggatcggcggcggcgtcggggtgggggggccaggaggaagcagctgcgctgaggttgaagagggcgcggatcctggggatgctatccccggtctggaagggacgtcggtggaaccgagctcgaggacaccggtggcgagggggaggcagaccatggtgcggaggcggaaggtgtaggcatgcctggcggggtcgcagggggcggtgcgaagccggtggcgatccaggtgggttgggcggcgaagtgggcctgtcaggccgcccgccgccgccgcgtcctcccccgcacgccgtcgccgaccggtttgagagagagaggaagagtgagagagaggaagagaggatgaggagatgacaggtgggtcccacaattttttaataattagagtgctgactggactaccacgcgaacaccacgtggaccaaaatcaccacagattagatcgaggagggtaatttgtccagtttgcatagttgggggtgaagaatacccggttttgtggttgggggtaattcggacgaccgcgatagttcaggggggtaattcgtactttttccttccgaaatataggactaatatgagatatgcttaaactggagaagatcggttatggagaagcatcttgtggcattatgcggaccatggatgaaaaatatggatgacgaagggaagcattatcaatttttctcatagtaaagatgggcaagaaaaaaacaaatgctttgaattcaccaacatgaactagcaagtaccaagagtagagaaaaagagaaatctgcatcagatcagccaacggtgtagcatccacccgtcgcctccaccttctcctgcatcacatcagctgagcgctgcatccatccgacgacaccatcgccttcatcagatttgcctccttgcaagcctctacctcagccaccacatcccagctgccgcatcgggtgcaaaaaatagccggcagaggagagtgacgggtggagcaggagggagtgggagaggggtggagcaagaagagaggtgctaggagaggtggagtaggcaggggaggagttagagcgaaatggagaggggtgtcacatgcttgctttactctgttttagaccaaatttaagctgatgtaggtgcttaagtttgcactgagggggtgtacatatggtgaaaaaagatgtaactatagctaaaaaattttcttgaccggagcactccctttggacatgtagctccgcccctaggagcaggagggagtgggagaggggtggagcaagaagagaggtgctaggagaggtggagcagggatggagatagagatcggtggagcgctgctaccctgcgtcgataatgagagagggaggaggcagagggtgaacgagatagagagatgcgagaaggatgagagactgggaggagataagattcaaccatgtgaacgtgaggaaacagagatgacttggtccttctagttcacctaaatatagctgacattcaatgcttctagtgttttgagcacaagtcatttttttttttacaaccgttccgtcccaatcagtttatcctaggacggaggaagtactagtaaactttctgtcactattaacaatggtaccaatcacgatttgtcttatttatgttggctcttacatctagaaatttagaccgccactggttgaatttgaatcgcgtatagcgatcaaatgtttttttcgttgtattgacagtttggctggcagcgacacctgtatcgtttttccattttagtccctacattagattagatcgctatattggttgcgatccaaaaaaattttcattctagtccttggtaatgaactaatggtggcagtgtggcactcgctccgctgctctattcccccctcgcgtccgccgccgacggcgatggccacctcgccgccgcgaccacttcatcgtctcccttcagatggcggcgcaagatctcgtactggtgagcaccggcaggggggcagtagcctcaagacccccccctccctcccccccaccgcgcaacgagaggcgcgcgccacaggtgttctcattgctctctctctctctccttcctaatatgagtatctctctgccctggagcctctagccctctactcgttttttgtgggggaatgacatagaagggttattggcacattgttcctcagaagaagggggaaaaaagaaagaaagaaggtttttgacatagtttctagactcgtttttagcacgcaaactaattcctgtctgtgaaattttcagtaaccaggttgctgcagttgataattttgaaagagttgatcatttaaaccgtgcaacgagcggtacactggtagtagtctgactttgtgagctcaattgtccaattgatatattagaaattctacagtaggataaaacaataaaatcaggtagtagtgaaaaaaaagagtgatattctaatatgcttctctgtcagttgattttttacgacgaatattgaaatcagggattcaattatttttaccagtgagatgctttcttgacttccataagatcatcatatatcagttaaccataagggatggcttttacaccatcttagtatttatttgggtgttgaaattaattcctatggtgcatctgtttgaattgtgcaagcacacctggaatatgaagcattattggaccacgaaaccatagaattacttcgtactataaaacgatgtattggcttgtctgtttatttctaacatgaatcaaaccagataaggggtcctatcattcccattggcaataagttcgctgactattggcaagctaagtaacactatgacagcaatatactaaatcatgacattaaaacagagtattttattgttccaacagacaagcatgttggcttgtcaatggttttaaatcatgacattaaaacagagtattttattgttccaacagacaagcatgttggcttgtcaatggttttgttcttgatttttttttcttttaaaaaaggatcacaactcagcaatttttttaccaagaaaaacttgagtagacttttcctatttctaaaccagtatcacgtagctcctggtaggaatcactcgtcagaatagataaataggagacaaggatttaacgtggaaaaccattacaggggaaaaaccacagacacacaaaatgatcactgtgttgagaatgtttacattggaactcttttgccccctttgtttggtgtttcttgccctaggcctgcagggccatatttgtgtgttacatgtagaaatagactacgagtatgaccccataaaaaccaaaattaattcagttcattttttaacaacctaactgctttgctgcaataattttggaagcaaaaaagtggagtattatctgatattctgatatgcaggatttttatttatccttgtggattccaaatgctgctacagagatgttggtggtgcattactccggtcttaatgacttaatctcttgctgactctgataagacaacaactttgcagttttcaagtttcaacttgtaaccaatgctgtgttgctagagaatgattctctgtaacaaacgtaaataagatgttgatgcgaaatacaatgtagaaacctctcgctctagcctctaggattggaattctttggtggacgttagatgccaagttaattagcccttcaatgatctccagtagattttgttctaataaagttcaatgttcagcttcattttaaacatcaaaataaggtatctaatcctccttttctatttgatgagatttgggtggggagttcctacctttcaaatttataccaaggttgacagttatgtaaagactccttggcacattgatgtgattgagcattattcgttcataatttccaaatagttggtatactttgcctaaacactaacattcatttccatatgagagtatgacttgattatgtttgagtgctatccaacaactttcagttgaccttgacatgttcttctacttgactacttatactgctatgttttccaactacaatggttcctgcatcctgaccttcacttttcttgtgtttgtgagagccaaacttgtaagcagccagtgctccttcaacggggaggttgcattatcatcttttatgtgtatattaagtgtgtattccttattttaaactttgctacgtgtttcccataaacataaaatatattcttttgtaacaatgaggatttgacactctttaaaatagcatcattaagataagaacaattgtttttcttcttaaagtttgtagctactggaccattgactgcatcacaattgattggtcaccgtttctgataacgaaatggtttggcacctagctcacaagtcacaacttgctccacttgctagaaattgtgatgctttcagctttgtcctagtttttgacgactgctgcttttgcaggaatctacggatcattcagttttgaccagaacccatattgcaatgggtgttctacacacccctctctgagattctcacgggaggtgattgattccaaatcctctgtagtagcagataagtcaccaaactttagggtggagaatgctccttttgcttatcaggaaccatggcgctgcttgaagatcggtcagccattcctatatccttaggtgcatacctcaagctgcagtgagggaacatatgacattgtagtcttgtccggatagagatcaatataccttagcttgcaactgttctcaatgagtagtcaacggatggcgggagagggaagggggaggtgacgtacgagcacacgagggaggcggtgagatcgctggatcaggagaaaggattggtgcgaaagcacaattttaccctcccaccaacagaacacaatcggtacctcctttcgcggggacgcggtaccaccaggtatcgagcaattccagccgttagattgcgccagatcgagtgccaggatatggtacagcctcccctcaaggattgtaaaaagtctcctagtattatttatcagatgtttagtatatgggttatcactctgttaattgcagtttgaccttgacaagttccaagtctcctactgatattttctttttttctaacattttcacagttctactatttaacagacccctttgcatttgaagccatccgttattactgattgagcattacaccttagtattgccataccttgcctttacctatacctcaaggcactcaatcctttcaatggctgatgctgttctcccagcttttctgcaagtgctttttcagaatgccatggagctgttgaagaagaaactggagtttgcttgtgatattgataatgaggggcaaaaactcatgtccaatatggaaatgattcaagctgttcttagaggaggcgagaagatgaagtttaatgatgagcagagactctggttttctgatctgaaagatgctggctatgatgccatggatgtattggatgaatacctctatgaagttcagcgacgtaaggtgatccatcttccccatctgcgtaaccatacattaagttctgctttgaatccttcacgtcttaaatttatgagtaatatggaaaggaagattaagtgtatagctggtaaaattgatgatttgaaaaataagcgcttaaccttccaagtagaggtccatgattaaacagatcaacaacatgaaggaagtatgtgtaacgggagtacctctcttcctccaatttcaccctgtggtagagagaatgatcaggagaggattgtaaatatgcttctccaacgtgatttgaagcccaacattgcagtattgcctatactgggtgaggcttatattgggaagacaactgttgctcagctaatcatcaatgacaagcgtgtatcaaggcactttgatgtcagaatatgggctcatgtatcacctgatttcaatataaaaaggatatctgcatctatcctagagtctatatatgacaaatctcattatgacaacctggacaccctccaaaaacacatacaaaagcggctacgagggaaaaggttcctgcttgtcctagatgactattggacagagaactggcatgactgggaggaggtcaagcgtccattgctcaaggcttctgctggaagcaaggttatagtgacaacacggagtggggcagtcgcaaaattgcttggtatggatctaacgtatcaattgaaactatcaattgaaacctctatcaagtgaggactgctggtcattgttccgccgatgcgcccttggtgtggaagtcaaagaatataattctggagatttcctcgataggtaccctcttcaatcttaatctctccgttccaaaatataagaacttttagctttttcttagagagattaaggttggatgaaaaagattatgatgcccctcattaagtgagggatattttttggagtggggaagggtggttagggataagattgggtgaaagttaactgaggagtaattggtgtggaaagtagtactctaaaagtccttatattttgggacaaactttgaaccccaaaagtccttatattttgaggcacaaggactgagggagtaactagtactagcataagtaaattttgggcacaaatgctaaaacctcggcacctgatgccccatctctggtttttttagatgattgtcgtaacagaggtttttttaatataaaagttcatacagtaacactccgtattaataaatactataatcatcagatgtcctgacatctgatctcttctttcacccgcagaaagatgcatcaagtttcttatagggttaaagttaaactaatacctacttttctattcaccttttacagagtttatctctaacgccgtatacctttttccctctatcttaatgaaatgatatggagatctcctgcatgttctaaaaaaaactaatacccacctttctatccatcagtttttccttctttttttttctataacatgttctattttagcctcaaacatttctatgtatttgactattgcaacattgttcttcaactgttgcaaaaatggctgttttgcagattgaagatggaagttctacagaagtgtaacggtgttcctttcattgcggccagcttaggccatagattacaccagaaggataaaagtaagtgggttgctattctgcaagaggaaatttgtgatgccaatcccaattatttcattcgggcccgtcaactgagctatgcacagttacactcccatctcaagccttgttttgcttactgctcaattattccacgggaattccagtttgaggagtggcttatcaagcattggatggctcagggcttcattcagtctaagcctgatgctgtagccactgggagttcttactttagaactttatttgaacagtcgtttttccagagagaactggttcaccatagtggggaacgacaccgttatagcatgtcccgaatgatgcatgagctcgctttgcacgtctcaactgatgaatgctatatcttggggagtcctggcgaagttccagagaaggtccggcatttaacagtattactcgacgagtttgccagccaaaacatgttcgagacaatttcccaatgtaagcatttacatacacttctagtcactggtggcaacgcaggttatgaactgagtatccccaaaaatttactcaatagtacattaaaaaagcttcgacttctagaattggataacattgagatcaccaagctacctaaatcaattggaaatttgatacacctccgctgtctcatgctccaaggatccaagataagaaagctgcctgaatcaatatgcagcctgtacaatcttcaaactctgtgcctaaggaactgctatgatcttgagaagttgccacgcagaataaagtatcttcacaagctaaggcatatcgatctgcatctggatgatccttcccctgatatccatggattgaaggatatgcctgtggatataggattgttgactgatcttcagacactgtcaaggtttgtcacaagcaagaggaacattcttgacaaccacagcaatattaaggagctagataaattggacaatctctgcggggaactactcatttcaaatctgcatgttgttaaggatgcgcaagaagctgcacaggcacatttggcttccaaacaatttctccaaaagatggagctctcatggaaaggcaacaacaaacaagctgaacaaattttggagcaactgaaaccaccctccggaataaaagagcttaccatttcaggttataccggcatatcgtgtcctatctggcttggttctgaaagctacacgaatctagtcactttgtcactctatcatttcaagagctgcaccgttgttccttccctttggctattacctcttttggaaaatctccacatcaagggatgggatgcattggttaaattttgtggtagcagttctgccaatttccaagctctgaagaagctacatttcgagaggatggacagtttaaag

SEQ ID NO: 58602 - DNA, 5529 bp, Oryza sativa
aatatgtcacatccggtcctagattcgttttttatgggacggagggagtacagcacaagatagttgaaggacattagtattatatattaaaggagcacactcatgatcctaggcagaatttaaatatatattttttgtgaggattaacagaaaatatatacccacaagttcaattagctagtatttcaatgttacaagctaagttcagcaatcaagtatctttccagtttctacctactttcccaaagcaagaactgcagagaacagagaccaagaaataggcctgaaataatttccctagcagtttgcaggtcgaagcccacaagcttttgtgaaaacttgccccaaattacaagctaatggtgcaatgccatgaggtaaattaacctgtgcagtgatgtcacacaaaggtaggtaaaataaggcaaaagaattgattaaaccccatgcaattaatggttacaatgtgcaggtaggccagccaagaggggaaaggaggaaagttcaggaggaagaaaaacaccaggggcaatatatagatggactctctccacagctaccaccactccatctcatctcatccttccccaaccattctcttctccttgaacacacccctctcttcctcattataatctcttctttgattagagaggaattagcaaacatgcacatatacaaagagcaggaggctgaaccatccactggcctgatggtaattgtttttcttggcttggaaactcctaaatttcctcttctctttcagtgtcattttgcaagagggtttggatttcttttttaattgtatgcatatgggagctttgggaaagtagaaaagtagaatcatggctgctagctgatgtgtgagaatagctagatggccatgaagagggagagatatagctagagatctttagtctttaagcaaaacaagaaaaagaagaaaaaaaggtgaaagaaaggcacaagatcaaggagattgatcaccacaggaccaaagatctctccttttttttcccctcaaaaaaagatctctcctttttccttcgatctacaagaattatacaactcacaaaagggggctgtagttacatatattgatttttaagagagatgatggccatgatgtctccagcacttcttgattttcttgccaaagatccatcttccggtcttgcaatttcttgattatgttggctcatgctgtgctgctaagttcttacatagaggactgagtcatatctctggaattattttgtgactcaaatttagatgccagagccagcacctgttgcttcccccggctccggtggctcaggtggctcaggctcggtgggagctgagaagattgggagcaggggaaagattgagatcaagcgcatcgagaacacgacgaaccgtcaagtgaccttctgcaagcgccgcagcgggctactcaagaaggcgtatgagctctccgtgctctgcgatgccgaggtcgccctcgtcgtcttctccagccgtggccgcctctacgagtactccaacaacaggtactgcattcctcttcctctcttcagctctagaaacctaaattaatccatgtgatatatgttatcttgtcctaattggagcaagttagttgctaccttttcttgtgacaaggaggaggcatatatatggtgatgtgcgtccatctcaccttcttttctgttactacatatatgtgcttcagttaattaactgtcttgttgttacttctgtgctttcttgggggtagtagcaactagcaagtgagaaagaaattgcaggagtttctttgtgtgtgtgtgatgatctgtgtgcttgctgatgtggtgtgcacatttctggtttcttttgtgtttcctgtgaggtgagctagatgtgtagatagattcagcacaatgcatactttgtgaagcaagcatgagcatgtacatgcattcttgtgagcttttctatgtgtgtgatgggtgtctgtgactgtgtgtctgtgtgtgttgctttggcttggtggtcctgttcttttattgctccatttatggttctttcctttctctacctctgtctggttgtgatgaggcttgctttagatccttaatacctcactgcatatagcggtcatatattatattttctctattggctatgcatgtgtgcagtaacttgtaactactagtaactagtatgcaagattgtgggcatgtgaggtttgatgttttttttttcagaggtaaaaagtggtgtacacgagtgatgcacacattgatcattcatgattcttttgcatcatcttcttcaattggaggttagttagggttagggtttcatcacatcctccatctctctctctctctctctgcagagtgctgtagatgttactgttttcactagtcatttctctgttcatttacagccatgtgtggtttcctgtattaacaggatgccccatcacgagtgctctgggcccctagctacctatcctctctgacaccggcactgtacttctcatgaggtaccgaacacagtgaagtcagcagtaaataggaaaaacagtgcatgaattacccttttttttctccatctataaggtttggactttcatatgtatttttgttactacctaaggtttacagattagtaatttgtgcaatatttttagtagagaatcttaaggatttgttgtgcttctttttccttgtgcgattacagaagaaatacacgcacacatgacaccacacacgcagaccacactcacacaagtgtgtgcttagttatgcctatagttgttcagccaagaaaggataaagagtaatttatactatataatcaggatgtatgccatgataatacccttatgttctaaatcctaatcccatgtgaaaaaaaattatgaaatgtgtgatcccctgtgagtctgtgactacacatgaatgaactactagtagtagagatgagtaactagtactagtagcaaaaagatctagaaaaaaactctaaactagatcatgtatgatttgtccttcatttttaaaattacgttttaataacccgtcttggttaagaaaaaatatctttacttaaacaattaaacttcatactccaaatgttaataccctgcacaacactatctagcttagactctagtatcatatatatatatatatatatatatatatatatatatatatagtaaatttgttatatatatactcctgtattatcttgttggattacgacggactggtcaatacgtacgatagagatattttttgtgcatttcttaaaagtgatttataggactcccattaatttaacagtgaattttccttgttttgatctattgagtaataaaaaaattggtttaacaattgacgacttgtttggacaagaagcaaattctttgcacagcagcagcagacaaacacactctctcagtacgtgtgcgtgaggctgcaagtgtaaaactgtacactgtactgtgcagaagcaaaaattaaccaatggcacggtcagtagaatacgtacaaatggcagcgtttgcatcgggagactacaaagagaaaaaggctggtttacccggtcagaatggttaaggtccctgtctgcctggctggctggctaggttggaccgtagctgcttctctctcttgcattggctctctctttctctctctataagccattggtcacttgggtactcatatgattcactgtttgcagccagccaatcatgatcatgctggctatgtttagatccaaactttagatttaaatttctaactttttccatcatatcgacctgtcatacacacataacttttcagtcacatcgtaccaattttaatccaaactttcaactttggaaggaactaaacacagccgctgttgtcaataggatgctcgaagatattaaggttttgtaattcgttggtaaacattactacaagacaatgctaataaaatattcatttaggaagaattttagagaagtgttgctacttgttcacacatgctccatgttaatttgttccaatgagcttgcatctttgtatttttctttaaaaaataaattgttaagaaaatcattgttggtcaaatttgcttggaccatgatttcttcacatgttttttcttgtttaaaaatgtatccaataataccgttcctatgtgtgtgagagatagacagaagctgacttgcattgcttttatattggctcttgggaatagttacttggcactattatacgtatgtgacgtgacatttgctctgatcttgcctttgagaattcatgtttggtcttgacgaggaaagggaaatgatatgatagttttcttggttagatttttgtatggccctttattgcttatgggcatgcctgagattgacaaagtgacaaagtgttggagtacgaaatgtggccaaatgatcttgtctgtcaattttcagcaggagtacgtctttctataggaactttgtgatatcctctttggtttgtactctgtagtagtctcgatcagataggggtgtaaatgattaacccgtgacctcactcataagtaaatatataaaataagttacttatatgtcaaaataagctgtttattttattgacttataagtaggtttgtggttagccactaagtacacccttaatctaggacaatatcaaaggaaaattagttacacatattttgtactatttcaattagatgatgaacgtatatatactttgcgtatagtagtagtttttcttgtatcaagagaggaaaggacgttactctgagtcctttcttgaaacgtgtacaagatctatgatcaaggcatatatgcatagtttttatgttgttagtagaaaaaaatggctaagtaattttgcaaaattttttttggctaaaataatgaagacaactagaaaggtagcccgcgcacatgcgcgggcatcttctcgtataatgtgaatgaaattttattatgaatatttatatgcaggtggctttttattaaaatttcttgtattatattctaaactaaaattaaacttattttgtgtgctttgaaagctttttctatttttataattacccttgcaacatataaattctaaaataaaattacttgagatcatgtggttttgaattgatgagaaactattgtgtcgaaacaatggaggtggttcctatgataaaatttagggtattttaaatcgccaaaaggatagcttacaacctcaaaacaaattcaataatatcattttttttgtttgattgtattttaatatatatatatatatatatatatatatatataatatattcattctaaccgtccttgtaaaatgtttgaatttttctatcaagtattggttttaaatccaacaaaatttgttcaattttcaatttatttcatgcccatttttattttttttcttttggatagttttattctatgaatcatccttgaaatgatttgatctttgcaatttgggacaaaaatatcagaacacataacctagtatggggtaaagg

SEQ ID NO: 58603 - DNA, 5786 bp, Oryza sativa
cacccttgctcgtgaggggcttgttggaggtatactgcgaaaggccttcggccgggcctgccgaaaccgaaaacttgggcgacatgttcaaaccggaagcaagcggcgaaggtcgaagagggataccataagggcgaaagccatggctcgggaagtacgcgtgcttcgtcggacagggaccccgtcaggaggccacgcaggcgaagatggtgaggcgaaaagcttcagcccgaaggcatgggtttcgccaaggtaccataccccactgtgaggaagcccagcgggctgttgcgaccctgtggggattcgccaagatcaattggccgagccatttagcccaattggggccatacgtgtaaaggacactgtgtacccctaatcatctccctatcataagggtaaccatgtaaattctcctgtaaagcctaaaccctaaggggagagaacctgtaataaggttataaatagcccttctaggccatgtaatgggggatccccaaaaaaatttttactaagcaatacaattgccttacttttccaacaactgtttagagaaccacgcctttcggtgtgacgctgttgtctattcgacaacagacatgtcataaggaaaattggaacatcttcaatattgtaataccccaacctcggcgacgacataattacctactccctccgtttcacaatgtaagactttctagcattgctcacatacatattgatgttaatgaatctaaacacatgcatatatttagattaatttacatctaaattaatatgggtaatgctagaaagtcttacattataaaacggaggaagtttgtctcatttacccaaaagaattggattatttgtgtggctgtacacatataatctgaaaaactctttttcaatttcattcttgcaactaataataggattaatcaaatcctatactgtctcacatggtcacatggtcaattctagacaaaacagagccactgtgaactcttctgttaatatatgtattatttttatatgatatgctatcaaaaatattagctatacttaacaaagtagtctgataattccatacagagatatgaagtgccttcaatacacgagaatagatcgtggaacacaagccgtctaggagatggaaaaaatcgatgatcctatctgacccaagcctcgatcaatttgatctcgcttcgagaaaaaaaaggcccaagcaagacttgttttagatccacacatcagaacattccaggaacgctttggaaaaaccaaaccgatgaggtagatgatacaaaagattaaattctttttcatggaattggatgtttttttcctgaaaccgatgaggtagataaggtagatgttttttttcacattgcacagtgctaaaccggatttttttttataaacatgaggtttttaatgcattgggttagacagttttttccgagcgattttttttataaacgatgattttttctcgtatggagttggatggttttttttatctttttttcgcgtggattcggacggttttttcaatccatttttttatacacaatggattttatctcatgttgagttggacgtttttttgaacctgtatttttataaaagacttcttttcctcgtgttgagtcgacagattttttcgaacaggtttttttataaatggcgttttcttgcttttgagttaggttttttctctttttttacagacaacggaaacttggcttttttttctcaattgaaaagatgcccgtgcattgcaatgggaaaaggtgtttttttccattggtacaacagctattaggagttgaggaataaattgaaaaagcgttacctcctacctagggttgtcaacggggcgggtcaggggcgggttgggctggaacgcccccgcacccgctccccgacttctccccccaaccccggccccgcacaggtgatcgggtgggaaatatccccccgtccccgcccctgcaggggacccgtgggtgagcggggctccgtaccaccgacggcaaacgcgagatgaggaggaatgcagccgccgccacggtgcatgtgccgcccttgacgtcgatggcgacgccgacgcggttggccgcacccctggccgtcaacaccgctgccgctgcaagctccatggccgttgatgccgacgcagatggctgcgcttggcagccgccgccgccgcccgcgccttaaccgtcgacgccgtcgcccaccccttggccgccaccgctgcaagctccaaggccgtcgacaccgacgcggatggcggcgcttagcagtcgacgtggatggcggcgcttggcagccgacgccgccatggcccgcgcctggccaccgccgccgcctgcgccttggccgccaacgccatcgctctccttgtgatgggagaggatattcccaataggcaatatgacactgaaagagatgggttgttaattttgaccatgattcagttattagatttaacacgagtgctcacacttacagttaattagacacctgaggagacttcatcaatctcaagttatgccggtaaagagtttcaaatgtgttaatagaagtaggatgtgtgtatatacatacacaggggtatgtgcacgcactgtatccttttctaaaaaaaaaggaataagttcaccggaggtccctcaacttaacagcgagattttttgaaatcccctaaccataaaccagaaatgtgtgcccctaaatttacacaagccgtgcacacaaggacctatacagtatatatgggtggtttcactgacgtggcatcctagtcagaaaaaacattttaaaaaatacatgggacccatacactggtggagaaaccatctttcgtcggtcggccgatttccacagtagtcccggatgcaataaaaaccggggctaaagatgttctttagtcccggttcaaaagggtaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatccccggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaatttgacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggattttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgt

SEQ ID NO: 58604 - DNA, 12166 bp, Oryza sativa
tatgaagtattaaatataggctaaaaaataactaattgcacagattacgactaatttgcgagacgaatcttttaagcttaatttctacatgatttgacaatatggtgctacagtaaatatttgctaatgatggattaatttggcttaataaattcgtctcgcagtttataggcggattctataatttattttgttattagactacgtttaatacttcaaatgtgtgtccgtatatccgatgtgacacgtcaaaactttacacccctgaatctaaacacccccgaacagaacatatttatttctcatataatttgaaaaaaatcataaatcacatctgagcatgcaatacatgtatggctactgggcctctatggctctatagagttgagaaaagatgtcctcggtaaagcgcaacaactgtagcaggtagaatgacttgtgatgtaaaatttgtactagactcctgttcagactttttcaacctctccccggaccggtggatttggcattgttcttggagacaaacagatgaacacaacaatggtatatacagtacagtgtttgtacagtactatgacactcaatcttactggcttcctgatctttttgcaaattttattagcaatgactatatgaaagttagggggtgtttggatccagggactaaactttagtccctatcacatcggttatttgacactaatttgaagcattaaacataaactacttacgaaactaattatataaatgagagctaattcgcgagacaatttttttaagcctaattaatccataattagcacatatttactgtactatcacataggctaatcatggattaattaggctcaatagattcgtctcgtgaattagtccagggctatgaaaggagttttgtcatttgtctacgtacgtttaatacttttaattagtgtccatacatccaatgagatatatatggactaaaaatttttagctccatccaaacagcccctcagagtgacatttttttacaaccaaacaatgctttagattaaacattaaataagatcatgccacagttgttttattgtttagaaaatgaaaggtggcccaaactgccactaactccccttttttttttgttgatatccttcaggaaaaaccccatgttagtttgaagatttgaacttagacatatgtataattggtgaaaaaaaaaaattctagaagaaacttctataccgtggccaaaacttcgtagttattcttacttccatggacgtatgtgtgcaagtaaactaactatttatgtgtgctactatgcacaaatgcagcgtgaaggaaactattgagaggtacaagaaagccaacagtgacacctccaacgccagtacagttgcagagatcaatgcccaggtaacatcatctgaattctcaaacaaaaaaaaatcatctgtcagtacaaatgcagcatgcagtagttttctctggagcttttatcattcagcaacaatgcaacattccttgtaattaaccaatggtttctatgctgtaaaaaatgagttctctgaccaaaatcttcagattggacatcctgaatagaagctacagtgctttacacaatggaaattccagtgatgctatatatatagtagtagtatatagttttgaccaacagacatactcctatctgtgtttgtccactggacaaagttcttcatgattccatgcttgaaaattgaaatggctcactgcatgtttttggcacttttgtcattcattcatgcatatgcatgcatgcaggttgattacacagtttaatatggtatgatttgatgatgcacatttgaacaaaataaacatgaagagtcaaacattccagttagcaaactgacacaacttgtcatgattttaactaccagtactaaaaaaaaaatcaaattacaaacttgcagcactaccagcaggaagctgctaagctgaagcaacagatcaccaacctgcagaactccaacaggttcattatttcactcagctgcttagaatttttttcaacttgacaaagtagttcatctggttataactaaattctccattaattaatgaattaggaccctagtaggtgataatatcaccaccatgaaccacagagaacttaagcagctggaaggcagactggacaaaggcctaggaaagattagagcacggaaggtatattaattgtgtgctacatttacatagaattccaagttgaaaagggcatattgttaattaattcatctaatttgataagcattccatatcctgcagaacgaattgctgtgtgctgaaattgagtatatgcagagaagggtaaatactatcagcaaaataccactgttttctttctggcaaaattatttggtctagttaattgacatcataagataacagcacgagtataatcttttcaggaaacggagctgcagaatgacaacatgtacttaaagagcaaagtaagtattctgttctacattgcaaaaaaaaaagaatgagattcgctttcaaaaagagattagcctagctacatggtaaatctgaattgaagttactgaaataacctacatatatagcaaatcatacctaattgactgaaattctacgtcatcatactaattaattataattattattgtgaaggttgctgagagtgaaagaggactgcaaacagtgaacatgatgggttcagcatctacgagcgagtacgtgcaaaatatgatccattatgatccaagaaacttcctgcaattcaacatcatgcatcagcctcagtattatcctgaacaggaggaccgaaaggcctttatgtcaggtaaaaaatattctcagtgtaacatagtcagagttcatagttcaacaaatgaaatttgaatgttcattaccttctcattgtaagcatctgagtcgtagttagagacatcaagtttttcaaaataaaaaaataaaaaataatgaagagttttcttgggaggattatattgcagggtcagaaatgtgtagggcttatctcacattctaggtattgtttggatttgcttgcaaccataagaattataactcaaatttcccttgcatcaaattatagaaggaattcggaggcataagttatagacaaataatgtggtcgagacaagtttgtgcaagtacgttcagatgcaacgcgtaactaattttgttttactgtttacattccttgcacttgcagatgaaagataaatatggatccgtatcatgcaactatctcaatcatgcatgtgccttcttcaaggagactgatcagttagatattacactgtgtcagtagaacttttatgtgtgaactcttgtatgcatgaataattaactttatcccataattcaggcttggcactatcaaggtgatgtacctaagtattggttcaacctgtgaaattaaaatacttcatacccttcctatgtttatatatgaaatattggtgataatatcttgtgtatacatataagtgctgtttcgttagctgcggttttttcaggaatcacttcgaactctgaactcacgctctctgaatttgctcgttctgactcttttcttttcagacgtaaacagtaaactgaagaaattaaccgaaaacagaaagaacagggcaaggcatggtgttgtgttgagctcgttttcagtattttcttctctttttaattcaaacccaaaacttggctcttacatgaaattatattggtggcctacaaaagcaccagttcatcaacttcatgccatcccatgatcgggcaaagacgcgaagaagcaaagacgaagaataatcactgcctcgatcattgtttctggcgttaggggtgggcagaataagaccgaaccgaaaaaaccgagaccgaaaaattcggtctgtaattcggtctcaactactaaaagaccgaaatatgttcggtttattcggtcatgggcctcaattaaccgatttgaccgaaataaccgaattaggcccaatagatctagttggcccaataagcccactaataaaaaccctaggggcaggtgcgtcacaggcatcgacgcatcatttcatccccatccatcctggagcggcgccgtcccgactcccgtctccatcccatccgcgtcctccttcgctccatcgccgggcgccgcttccgcctccagtcggtgcgccgcctccaccgccgggcgccgtctccagccggcacaccgccacctccaccgccgggtgccgcctctagccggcactccttcgcctccaccgcctggtgccacccccagccggccctacgccggctccaccgccgggcgccgcctccactaattgttgatttgctttgcttttgctgtttttacatatagttttgttgatttgctttgtttttgctgttagttcggtctatgaccgagaccgaaccgaactaaccgaagaccgatttgctcagtcctaagatttgttggagaccgatcggtcttgagattacaaagaccgaattttcaaaaagaccgagaaaccgaaccgaatttttcggttagaccgaatgtccacccctatgtggcgtgcgtgcatgtgttgtgaagaggcagaccaacactagctacgttgatgcttgatgcgggatgatatgttggattttcacaacttgctatacctaattttgatggcccatcactactatgaggaggacgaggaggagagaggctgggggggggggtgtcccaccctacccaatggatagatccgcctctcgttttaattgcacaatggaaaactaaattatgcaaataataaaatggaatactgaagtgtgtgcaagatcacaattttcactgttacgattaaacttgaattaagcttaggatagcttattagatagacatatgttgaaaatgtaagacgctacctcgccacggtccacgacggcagggtgcaagatgtccccaatgaatcagcttcgatggccgtggtgctagcaagatctatgtgaacggttgatttataactcagttaccgtccgacgttatctgccgctttagttcggcactagtcattaatggtgacgaacgcgaaatttgatcggcacaatgatcagctgctgatttgagaaatacaaggactactatgcacaactcgctagccactgtgcagatttttgccaaccatagatatatagaaatttagcaataggtgttatctttgtctttaggctggtatttaagtagttttattgtttttaattaagttatgattttgtaattcacagtcgttcaacctgtaaactctataataactggttatagctaggttcttacaagcgaagatggataagtctgttattaagaaaaggaccacgtaacacatatatgaatttaggaaagaaactgcgatcttcatttcaacatatagtaatttaggatgggtctaacaacatcctaagttgctacattttgaaacggagggataccaaaagaaaagatatatagctcatatatatttttttatataaacttctttaaaaaaatgtagtgcttattagactatagtgcttgaccacatttacaggtgtgctaagttctatactcggctgagttctattatctatatttttcatacgcacgtttcccaaactactaaacaatgtgttcgtcgagaagaaggacaagaccaagcgcatgtgtgtcgactaccgtgctctcaacgaggtcaccatcaagaacaagtactcgctaccccgcatctatgacctgtttgatcaattgaagggtgccacagtgtttctccaagatcgacctacgatccgggtatcaccagctacgaattcgcgaggaagatatccccaagacagccttcaccacccgataaggtttgtatgaatgcacaatgatattctttgggatgaccaattaatgctcccgcctttttcatgaacctgatgaacaaaatgttcatggaatacttggataagttcgtagtagttttcatcgacgacatcttgatatattccaaaacagaggaggaacatgagcaacatctgtgacttgtgctggagaaactcagggaacatcagttgtatgcagagttcagtaaatgtgagttttggttgtcaaaagtgaagtttttggaccacgttatctttccacaaggagtggcagtggaccccgccacggtcgaagcagtcaccaagtggaggcagcccatcacgcagatccatagtatccttgggctggcagggttttaccgccggttcatcgaaaatttcttaaagatcgcttggcccatgacccagttgttgaaaaaggaagaaaaattcatgtggaccctgcaatgtgagaaggcattttttttgactgggatgtgagaaggcatttcaattgctcaaaacgaagctggcatcttccccggtcttcgttctgctagatgttaacaaagactttcaggtttattgcgacgcgtcccgtcagggtttgggttgcgtcctaatgcaggaaaggcatgtggtggcctacgcctcgcgacaactgcgactgcacgatggcaactaccccacccacaacctcgaattggccgccatattgcatgctctgaaaatatggcagcattatctcatcgggaaccggtgcgaagtttacaccgaccacaagagcttgaagtacatcttcacccagccagacctgaatctccgacaaagaagatggttgctgacggtcctcaaatcataatatctgactgtcaatacttgcttataatgaaataaaatatggtatccaacttagtactagggtttattactaatcatttccactagtattggtgaaatatgtgtatgcaggtactttaaggagaaaacacacccgttatgcaacaaaatacacctctggacaatcaagacgtgtttacacagattagggggcccatacatcaaccaaagccacttagaattggtccaaaaaatagtacatgatgttgcgggcccattaagcaacctcccgaccaaaggagggccgggaggagggttttttggttcggccgaaccaccagtccagccgatcccgttctggcatagttgatcaccatttttacacgtgtacgctcctgattacttcctgatgacagttggaggacatttatgacatttcacatacttgtaaccgtcatttggagcctataaaaggaggtctccttcacacttcacaacacacaactttgagctaaattacaagaggctctattgtatcttttatacattagaaatatttagagggtgaggggaaactctggaggagtgcccggaggtttggcactttctctgacttctacctcgacgagtgtagctttctaggaggaattctagaggagtaccggagttgtcggtacactttgctccagcttcggagaaacttcttctattaaataagcattcgtgatcctttcttatgttatttaattacttagtctaagtgagatagaattccatctttgcgtgttcattgtttagttttcgtactaggtgctctagtactaggactttggataaagaaggaagttcctgcgctagtattagagtagtaattaaaaacttaggtgtggtgtctacgttagagattacctttgtttgttgtgtatctcacggatttgtcagaggtaggcgacaggtgatgacagccctgaatcccgtcctagtgatcctccatgttcggatacattatagagccatagacggaaccacgctggcagactagcaggagtcggtgcccgaagcaataggtaggaaattaccttcaacttagcgtagataattaaaatatatagaaagtcctctctagccttgctagcctactaacggttgttgtccttggatagtcttagccttaggtagattacacacgttccctgagtttgatatccttttggagtcactcgaaggtgaagtgctacaacgtattccatgctcttgcggatttgtctgtggtcgtaagaaataccaacaatggttggaattgatcaaggattatgatgaacaggaagagtgttgacggtccttaaatcataatatctgaccattaatacctgcatataatgaaataaaatatgatatccaacttagtggtaggggttattactaaccaattctactagtgttggtgaaatatgtatatgcagatatttttaaggagaaaacacacccggcatgcaaggaaacacacctccggccaatcagatgcaagcacatggattggagggcccacaagtcaggtgaaaccgcatggaatgggtcataactgtcataagcaccatcagggcccaccagtcagtgtccctgccaaaggagaggccaggaggtggggcccgtggtttggccgaaccaggggttcggctgaaccgccactggcacctttgatcctggccttccacgtgtacgctgtggatgacatcccaatgacggttgtgagcgttatacctgaagaaaccgtcatgcacacttgtcaagagaagagaagagatgctctttggatgcttaagcatctccacattcccagggtatctctagacctataaatactctctcctctccctcattcacacactctttgaagcttgagctgaattataagtggctctattgtactattttgtatgctagaattagggagagagtagagtagaagaagtcggaggaattctggagttgttcgtagtccttctctcgtttctgataagtaccctgctttaattgaatatcattccgagtatttaagatttattctgtgagagttacctcttagttagttcctaatcaacgtacgggatcactgatcactataatccattaatatatagtggttgctttagtgtttagctagcattaaagtagttattaaactgcgtagacgtggtgtctgggtagttaattttcagtgtttgctttgtatcccacaataggtttgaggtgggtgtataggtagtgatatccctcaaaacactgaagtcctccctatccgggtacgttgtagagccatatctgggagcagtgggctggccagcgcccgaagtacctttttaggatcaaattgagctttctgtatacatcgtctctcactagtaaatcctttctaccgttagcctatcttagcttcgtgtccttagacgaacctggtgaagagctgacacacacgttccctatggaaatcaataccttggaatactcccgaatgaagtgttgcatcggtatctttcatgtgcttgcggattctatctgtaaggttaagaaataccaacaaagagctattgcaatatgactcacgcaagcccgtgttcagcaatgctatgcagggacatggaaaggttgaatcttcacatcatccaccaaggctctctgacaaccttggaggtgaagcctctgctactagatcggatccgagaggcaaaaaagaccgacccagacatgaaggaattgcagaagaacatgagaagagggaaagtgtgtggcttcatggaagacgaacatggcaccgtttggaatggcaaacaattatgtgtcccaaagacccgaagatcaaaaagctcatcctgctggaagcacacaagagccaatactccatccacccggggcagcaccaagatgtacctagacctaaaggctaagtactggtgggtcaacatgaagcgtgagatagcagaatttgtggccctgcgtgacgtgtgtcaacgaatccgttgatgcaaaaaacacacaccggcctgaaagatctgcttaacttcagtgcaggtccaaaatcttgcttttaggtttgtgagcgtgccagttgatttgatcctgcaatcaacaagaaacaaagacaaaataaaccacggttaaatccataaacgatagccgatcggccagccgccgatgacatatcatttatcttcaagccgatgtcatatgtgaatcgatcggcagttgtaaataagcaagataagactaaatctactcgatcggctgtagatattaacgctatataattcttctatcgatgtatatttaaaccaagtgatttggataaatcggtcaccatgccgagacagtataaatcacttagatcgaagtatacattaacataaagattataagcgcttatagcatagccgatcagatagatctagcatgtatcggctagtactccgataccactctacattaagatattaaaacagatagaatatatcaaagagaagcctaatatactttattgcggtaagatcttaatataaagggcagatttagcatatcatttaagcatataagacataaaactaaaccaggaaagatcggctgaaaccccgatactatctctgttaatgatcataaaacaagccagatatcacaattataaatattacttaatagatcgaactcaaccgatgcagcattaagcataaagacaagtgtgatatctaaacaggatgatgaaaacctacgagagatggtagatacacgatacaatctagattaataacaaaacgtaactttaccgattgtttcctaatgataagaaccagccgataacaagttatgtagtgcaactaacatagattgaaacatgtatatgataactcgacggattacataaacagggttaaagtatcataaagatggaagcattaaccccgataacgcaagccgccataacaagctttacctctagttgaagatcaaaatcgatgcagctcaacccgaaagtaagaactcgtcgaaataaacgaaagtaaaaagggtggcgatgcgccgagattgtattgaacgattgttaattgattacatgggttcgggtgatatttatacccgagatacaaaatatgtccttgccggacacgacacttatctctaacaaactctcagataccataagtctttgcggtagacttttgcccaaacatatctctaaggaaattatatgaaatatcctaattaatagatacaattgcctcatccgagagctttatctccatcacggcaatcctcatgaagcactttgaacgattcgggaaacagctttgaaaccatcttcatcggaatcggctacatcatctttatcggctgtatcggctgtcttttgtccgatccatctcagccgatgcatactctgttcttcgaatcgatctctttcttgaatctgcctcgatcccaatgtcgaacctggttcacaccttaccaaatttggtcgtcaatagaatcaaagcagaacaccagaggccagcagggctactgcagtcgctccgaatcccggagtgaaaatgggaagagataggaatggacttcatcaccagcctttgtaacaaccctccctcaagaaccgcgtagccctgcccaactgacgggcgggccaacttacacacaccaccccgcttacactttcgtccttgataaactagcaaggtggtactaaatatgcgcacacagctcacatgggccacacaggcttcatcctaattcggccaagatgtcatagccttccccgcactcaaggctgttatgattccatttgggtcgtggtgaaccatgtgaccaaggtggcacacttcattcctgtcaagaccacttaatccggcagtaagatggcataactctacttcgcccgcatggtgtacccaataacaggtacccagctcacctctatgttttggcagaaactgcaataagagcttgggactcgtttgaacttcaggactgcttatcaccctcagaccgacgaccagacatagagcattaaccagatcttagaagatatgctttctgcctgcttcctcgattttggaaagacctaggacaagagtctcccatacgcagagttctcctacaacaacagctatcaatacagcttgtagatggcaccatacgaggctctctacgggcagaagtgcagaacgccgctcctctaggatcagacaggtgagcgacaggttttcgggactgacattcatcagggaagcggaagcgaaggtcaagaccattcaaaacaactagaaagtggcccagtccaggcaaaagagctatgccgacaactgccgcaggtatctcaccttcgaagtcggggactatgtatacctgcgtattactccactccggggagtcagaaggttcaacaccaaaggaaagcttgcatgcctgcagg

SEQ ID NO: 58605 - DNA, 7757 bp, Oryza sativa
ggggtgttacgcaggcgccgcgctgtgcgcgagccgttgcgtagcgcgcgagtcgcgacaccgcacgacgccacgcgatggtttgggcggtggtgtgtgcaggtgggggttgggcggggcacgggaggcgtcggacgcgcgcgatggtggattgattcattgattgggtccggcctttcgccgggtggttggacggtttgctctacttgtggatttcgtgttcacgtgtcgtgcaggcttgcggggtgtgtcgcgcgcgcggtagccgtttcgaataggaacggaaaacctccttcaacactacctggatttagactgtttctcgtgaaatcgtcacagaaattcgttactatattcttgcgtctcgaatcgaatggggactcaaagagtcggcatgcattggacacgcctgtgctgactgttgtagaaaccaaccgtaagatattttgagtttagatgacgccatagcggtcatgacccacattttaaatgcaacaattaatcatgcgaacccaaccacagcgctcgccgttttctgtcgtcaaatcgtggactgtgcgattgattaggccatatttggtcactggtacaactagttgtcaatatcttgccacgaaaaagacgagcagttgacagaaaacataaacataatctcgagttctttgcctccgaaaacaagagtttcacccggcagctgctgcagcacagctcagtccagctgctaatttaacgtacaactgtgctatggcaagcaggacacgctggatggaagcaatggaaagcgttagaatcttcagattgaagggtgatatacagctgcaccattcaatggcgtacatgtacaaggtgcaaggtgagcgtatcggagttaatgttctgacctctgaaatgtgtagctgatgttgcatgtggcatcgtcaattcgtcatgcgtctttgacgttgcaagctggttctcgggtacgtacaaccacctgatttaacgtgcaaatacggcaacaacataaaaccagtacagttcttcacactacttcctctgtcagaaaaaaatacaatctaaatatatcataattcatcgtacataatatctcattctatcgcaggttaatttatttttaacagacggaatacaaaataaaccaaagtataccttacaatcacacgcattctagcttctaagcagtatactcattgctcggctcgagtatggataagaagttgatttgaaaaagaaaggtactgataagaacaagtgctttaaaaggtgccacataagtttatacttgaggtggagaagagaatagaagccacccctcgtagaagggacaatctccacacaaaactccaataaaaataaaagaaaataaagagtcgattgaacaaacaaataaaataaaaatattaaggctagtgtgctatagttaatatagattagcttatatggataaaattaaatgtgacaattgtaccttctactatacaacttgcccaagaaagaatagtgaactagttgagctatgcaattgtacgtgtccgtatgagcatggtttaattatatgcacccataagcgagtgcatgctaatagagaccgttgatgtaatagtctcgacaacgccatagttccctatccataacatctttcaatgttgtatggtgaaactgaggatgctttgctctcattttacagctcataccttctagaagaaggatggaattagcatcagttgctgtcgatgtgtagcaagttgatgtattgtttgtctagctcggttttttctcttgctgtattcgatgaaattgtcatactcaatgctaaaaaagttgatgtactggagaatttcatttctctcctttgtattctaatcttaatttttaaataaaatataaaagtcttaagaaaaaaaaacttgtgagcctcttaaaatagttggtcctttgaagaggtttggactgcatggctttactaaagagggaactggggagggaaagaaaatgaattctaagggatcagatcagtaatgttacgcttgatcctacaaagttctaagcccaattgaaaattgagcatattgtatagttttgttacagaaaggccaccacagaaaccctcttgaaactgcgtttcaatagggaagttaatctggtttctatcaaaatcccggaaaatccctagtgaaattgacattgagaatatctttaagaacagctcagcaccctttacactaattctaaagtcgcctctcactgtctcacataagggcacccacaatggttatctataagctctctacaagagatccatgtcagcatattttcctacttggaagagattaaatgaagagagagagcaaagctatctactaacatgaagatagtctatagagaaaaacgaggcaatggattagagagctatagatacccatgtagacataccattgaagtggtttactattaatctagtctattgttgaggtgtacatgttttatagatagcaccttactttactattgcgggtgctctaaatctaagctccctgaaccttcttccatggctccaaactgtgtggttgaagattgtagcatacttgaattaatgaagttaaaggttgtcgcattaatgaagtgtaagatgcctgtaacacccaacgaccatctgctttacattcgcaactccgatccagtggctggatgctgcgcaccaacaaagtcgctgcaatccctggacccatatgcttcatgtcaccatggggatgactagagcaagttctatagaaagggtagttatccaattttgtacatgtaacataagaggttatatgtacaatatatatatatatatatatatatatatatatatatatatatatatatatatatatatatatatatatatcacatctgcactatcttttgctgaaattaaagtcaacagtgagcttttctagtacttcctccgttttatattataaggcattctagcattgtgtgtatatatatatatgtgaatgaatctagacatatatataacctgaaacgaaggtagtattaacgtatagaagccatggagccatgctcgtgccctcatgggagatgcaagctttggtgaaagagaacgtgagaatggtgacagaccaggaggcgtggagaagcagaggtatatcaatgcaggacgtggagggggtagtgacattgtggataacaagtggcaacatataagcaagataaaatcttgtaccggaaaaaaaagagtaagttcactatagatctcttaatttattgctgagtctgaaattcatcgctcaacaaaaaatacaaggtataatccatccctcaactcacaatattgtgttaattttagtctctcgacatatagtggctggttttagctgacgtggcgtgtgagacccatgtgggccccattagtcaatggctaactcctctctctcctttccttgtctctctcttccccgtctctctagggcacgcgatgaagtcatggtggcgcgtagcctgcatcgcgcggtggttgacgggaaaggaatagcacggcggctggcggaggtggcagcggaggcagctagctaaggcgatgacagaggagatggtggcacgcggtgctagcctgcggaggaggcgacatacgcgatggcggaggagattgtagtgcacggtggctggtggagtcgtcctctccttgcgaccatgatcggtaaagtcgtccttgtccttgcggccggggagtcgtcctcgtcctcacgatggcttcttgaatgccctcgactaccactacatccattcccttttcctcaaccttgagagatcctcgggatgccgtcgtctccttgtttgggactccgtgcatcggccgccgtgcgccaccatctccttcatcatcacctccgccggccgccgcatgccacatggcaccatgtccttgccgcgtgccctagagagatgtggcagagagggagagcgataagagagagagaggagtgagccgttgactccattagccaaaatcggtcatcatactgctaaaggactaaaattaacacggtattgtgagttgaaggatgggctatacctggtatttcggttgatgacgaatgttaaactcgacaacaaattaagggatctaaagtaaacttatttcctaaaaaaaagggcttttacgtaaaaatcgagtggatgacaacacaaagtcatctatacaatactacgagtattgatgctcaaattgatgctgaatgagagatcataaagctacttgtatcagtacaaattacgagttacactcaatgattaggttcgttgagttgaaacctactcatagaagagtattaagtactaaacttcacggctaattattttctcataggcctggtatagttctaaaaaattttgcccaaaaacatcacaacgaatcttgaatctttagactatatatgaagcattaaatatagataagaaaactaattacacagtttatataaaatcgcgagatgaaacttttgagcctaattagtctataattagccacatatactaatgacagattaattagacttaataaattcgtctcgtggtttacagacgatttatgaatttagttttttcattcgtgttcaaaaaccccttccgatatccggtcaaacatctgatatgacattcaaaaaaatttctttttacgatctaaacacacccatagtaaaaatgattgtagcaatttcacctatccctacgcgcctgtaatcagtacaattacgggtgcgtttagtttacgtcaaaattagaagtttggttgaaattggaatgatgtgacggaaaagttgaaagtttgtgtgtgtaggaaagttttgatgtgatgaaaaagttggaagtttgaagaaaacatttagaactaactcggcgtacatgagtatcttcgagaaaaagtaaatgtttacaaaccggagagatataaatgagtataggagaggataaattgtggccgtcagatctagcaccaagtggagatactacacggagtactctgtctccctctcgtcttcctcctcctctccttccgccggggcgcaccacgcacgacggcataccccctccccctccgatctcccgccgaaacctcccccgcgcgtcgtggagcagaccagatcccgactgcgccgcggtttgcgctagccgcagcagctcacccgtagattccccccccccccccccccccgcgcgccggccgcggcgcttgttcgccttccggcgatgccgacgccgaacggtacacctcggtggcagcgctactccgccgttctcgccgcaaggtgcaccgcattctccaccccccgcgtgattgaattttagtagttcgttccagcgtatttggccccatgtcaggctttatataaaacttcaaatggttactttgggatgaactgtatttctctcggacttacgatgtcaaattgatatagttttgatacgttcaagatgaactgttgttgtgatttcctagtgtagatgttaactaacctaaattcacccaatcctgaaaatccaaacaaattgttttgcatctgattttgattcaagtgttataactgggatttccgacccctttggagacaaaaaagtgacttctgtcaattgtgatatataatggttagcttttctagaatgcgcgctcatgtccagtactccagtctgcatgtctgtttcatcatttatttcaaaaaaaacttggagaaacactataaagtacctgtaaacgatattagtatctttcgttgcactatagctacattacaaactccacagatcatagagggctgccctctgccatgatccaacattttgaaagcggaatagagactacattgctccaaaattctacatttacattctaaagtaaaattagatgtaactacaggactgcaactcgaaacatccctaggtggcatgttcttgattatcatgccaagtcgcctcatgcctgattagtgatcactattatcttaatctggtaccttctgaaaggtatactacatacctatctgcagttctttgcatcgttgctgatttcaagcatccttattcaaatttccataaaaaacagatgatcaccatctcgaattactgtaatatcatcaatttcagcaaattctggattgacaagttttgtaagacgataattgttaaacttctgacctgcagaatcaaaattattgaataagaacacttgcactagatccaagttgtattacctaatacagacagtccctcatacttgtacctatgattaattatagcctaatgggacagctactgcttgcttttttttaatgaaatgtcaaccaaatgtaaactacaaaaatgccaagggacagttcaatctataaaatgaactaataccgtgccaactattaacaaattttggtgctagttatctgaggggttaatgcaatctcatggcccattaacccatcaactgatcaactcaacactgaatgcataaatatactgtttggtagggttaggatctggtggtttggtatacctgctgggctttactttcttgattaaatggcgttgtattcaatttaaacatttcaggtgaaggtgttatccatgaagaaacatatttcttgaactataagtaaatgttggagaccttaacctccagtctattgctctaccaagcaaatagagtagcatactgatgtaaaacagttatcatctaagaaagttctggtgtagtggtaggatagaataatagaactctgtttgattgttgcatgggatgtaaattaaaagtactcttcctgtaacctatgagaatcttaagttttccaaaacatgctgcagctggaaggatttttctcacttctcaggggagttttacctcccttgcactgagaatatgaggtcccttctgcttacatacctgagaagccagttcatggaagaaactaagccctcctatacagggccctaatcgtcctccctcatgtatttaaatcaaagaatacttacaagctatggcgaaaagtttatcaagagatcctggtagatttataacttttgcaagcggtgcctccggtcttttgttcctctgtgaatacatatgtattgtcactcttttccattctaaagccatagaatgaccattattagcttttaattcattcttctcattgtcttgattcaatgcagaacatctgttgtactctccaaagtgttgatgcatcatctgtaaagatttttccatcacctcggtagagaacctgtgatcttggttcatcttctgccgaatacgaaagaattctaatcatcattctgcataaaaaggtatattataaaacaagacaccatgatgataccaagacatgaactaacctgggaaagattgttcagaataactcgtctgtcatcgctgttttccttgataatgttctttagcactgctgtgttcagccttaatagttgtgaaactttgattgtatggaaagcacatggctgggggatgctgcagataactcctatttctccaaatatttcaccattgcacagtacttcctggacctggattttgtaattatacatgtcaaattctgcattacccttttaaccattgttctttagaacatatgaacttttgttaagtcaccttttctgttccatcgatctctacccgctcttcctgccaaacaaaataacaacagttacactagtatccatagttgtatgaactgcaaagggtgcag

SEQ ID NO: 58606 - DNA, 851 bp, Oryza sativa
ttgagtaatattgtcatttcttttattccactttttgtctttttattgattgtattcatgctgcagcataaacttatctttatcttttagttacatgcccatgcatggttgtttgtcctgtcttgaagtgatgccaaattatggtagcatatgtatatacgtcatcttctgaattttttgccctggtattggggtacaccgacacgcacacacaaattcttcaaagtatatatgtatattattggtgaattatatgctatgaaattagctgctattagcagaaagaaattaatttatattcacacaaataaccaggattggtatttttaaattatttattattttattttattttgtacatgatcttggcgggtggcgaaacctaaaagatcagtaggtctgctctaatcaatggtacgtaaaaatcctactcggtactcgccatatgaataacttattcgtgttctacaaacaacttctcatgtctctagcatattcgttctagctgaaggcttatcgtctctttaggtagttccacccgaagggaacacttctctacggccacaggttattctgatgcctaagcaagatgcaggttaacaatgagaactaccaaagagttatcacctacagagtcccttacataagcactaagctaaacaaatagactgggatgtacaaaggaaattacttcatataaaacaaacaaagtttaccatttgtttacctatggttttccctttcaggaacccgcgagcttacaaatagagctgaagtattaccttcaagcccacacagaggtcgatctttttataactatattagttcaatctatgaccaaaattaagctg

SEQ ID NO: 58607 - DNA, 3128 bp, Oryza sativa
atatacgcacgaaacacttagcagacatgactattttagtcttagcatgtaatattatttgagttttaatataagattactttatttgagattagacttagtatataattattgactacggaagtggtgcgacaagtagcaattgactattgcagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtatttagacttagcacgtaagtttgtgtagggttctaatgtacgacatttacacttagcatacatgacttagattgttaaaacataaatgtctcgtggcttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagataggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagctggacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacagagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgctcgtcaagcctgagctgctgtagtccctacccacacaaatgtacaagttccatcagctgtacatggagatgagcgccttcagtagagagatgatcggagcgaggatcagggacac

SEQ ID NO: 58608 - DNA, 22267 bp, Oryza sativa
tcccccggtcgccgggccacgccgcaccggggccgtcggatccggtggcagccaatgcgttttttcttagtgtggggcccacccaccacggcccaagccctatgctaggctgtagtaggatctcgcgttacgcgcttttccgggttcatattctattccccccgccgcgtggccacatgccaatgttaactggttatcggctatttacactgttttctttttctttttttaaaaaattaactttatccggcttgattataagggtgtggagtattttatttaaattattatgtcccatggaattggctttaataaattagtaatgtggaatttttgtgttcgatcaagcgaattagtcgaaataccacaccccgtcatagatagatccggtaacccggaaaattgttgatacagagacatagtgatcaggcatgtaggagaaagaaagaaaactagtgtgaaatgattagtaggatgagctatacatgaatgaatgatgattagggtaatgggggagcatctcttgcacattcggtgctgttccctttcggccctattgatcatatggaataatggagctacatatacatatagatagatagatatagtcatgagtggattgtgtgggcacgtatattgccggcccgttgcttgatttctggtgcaccctacctcttcttttcatttcattcttgagtgtattacacttgactcaatcgaacagtggatccatctatattttgttctgtgtctagggtttcaaacctatcggaaaaatagtgcaaaactcagtgccggcaaaattccgcaatacaatgtcgaattctttcagaaattttggacttgcagatattggcaaaatttagcaaggaggatattctctatggagggtatgtaagtggttcgcgggagggaattttgttctgaaacttcgagctcgagctattttgtgtcataaatatccatcactttaagcttttttttaatattgtaggtatccacatatatacataaggtgccacaaaaccacatgaaaaactactaattaagccaaaaaaaggttattaacaattttaattaacaaagcctccctatgatctacaaacaagatatttcaaaatgacaatggaggctttgctgaaatttttaataaactccatacatgcgggttttctatgtggtttataacactctggatatgtggtttataacactctgcaatcgatgcaggctagttcacttacaaacaaatataagtggtgcaatgggagaaaaagttgttgttatacaataatatctagttacatatatgtgataccgtcatgactctagaaggcgcctcacgatgaaaaaatcgaaaagaataaaaccaacaatgcaactttagacatatactccctccgtactcgtaaaggaagtcatttaggcaatgtttaatcaaatattgggaatataaattatgaataactctcaagttattgagtttgaaaatgtaaaagttatatgaataggtttgtcttgaaaaatacttttataaaagtatacatatatcacttttcaataaatatttttatagaaacaagaagttaaaattgtgttttggagaccgtgtcgctgtccaaaacgacttcctttacgagctgtacggagggagtatatataacataaaataaaatttgttgtacacataactatcattacttaattcctttcaaaaactatcattacttaagccctctcaatataatcccccgggccttgatctcctcctcaacaagttgtttcactttattcccctttccctctctccccactcactatgtgcatcgcattactaaatgagatacttctgtttggatgatcccttttgatcttgttcttgcttcttttggttgggaaagggtccaacaaaaactagtgggagttgtttgtttcaaaacctccacacaaagcattgatgcactgtgttacatcctaattaaaaaaagtgtgtattcacacatatgttagttaattgatgggaaccaaatggtcccccttgctacgtttttggctagctagctaattaactcagaagatatcatggaagttgcattgggacaagttggagcaagatatatcttttcaaagtcttgtttacctgacacattctagaaagctaaagtgcatgggatgctttcagactatattatgaaactcaaaaaaagaaaaagaaaggaaaccactttgccctgggtcaattctcctgcatattgccattaaacaacagttacagctaccaaacttgctagttacggaagatacttaaaaaaaatgtaatactacaaaagttacaaattcacgaatttagcgtagctcagctgcttagatttcttgtgatgaaacctgctcgtctagataagagttcaagttctaaatttgacatgagtacgctcatgtctgtagctattaattgttttagtggcaggtgatcgacgtgcctgttgatagcgagatgactgcggtgactttgtcaatattaaaatatgttggttaagtttctcggaggtgctcatacaagtaggattatgtgtacgtatttatagagtgtgtgcatccatgtacgtacatgagcatacgttagcgtttgtatactaaaaagagaaaaggtcctaaatccaataaaatggactaattaattagaaaaataaaattcataataaaattctagtggtgcttgcaaacagtgtccttccactatgtattttttacagtatttaagcaagtaccatgaagtactatgttacttatatatttctagtattaattaatttgtgaatgcatgagagttttcttttaaggcagcaaatcaaacactagcaatttgcatagtatgtgtacatcatcgaggagcatatgttgatgatcaacaataacaaatcaagcattgcagttgtagcatccagggatgtcaaagcagtgttttccattcgctttccaagacaatatcgattggctttcttagctagttcgtatactcaacaataatcaatttccccattggggttttgaaatgaaacttcttcattcactatatatatgcttaaaaatatgtatacattgtctgaatctcatatcaagaacatatacatatataaaagcctaacaacagttaattaaggtctaattgatgaagctaattatggagaagcaagacaccctatatatatggagctaataaccaatacatttatatatgagccatatatataggccttgacctagtatatacatgtatctaatctaacctcttctcttaattctttatatgctgagaacttgagatgttcctgccgatgtcgacacatagtaatatgctccatgatcaaaacaattaatttgctatttttgcatctgggtgtgtatgatatctttcctattgtcagcatcaatacagtccaatctagccaataagctactagtattttattggtggtaaacttcacccttgatctgataaacttgttcaacaaacgcgctagaatcaagcttgattccctgtcacaatgctatcgtccatacatgcatgattggttgcatcaatgcagagcttttttttttttgtcaatagctttgctatagcatttgactattgcgagataccttctgttcctgcaacctcctgcagacacaacctaaaataacaagccagtgcttgtgctgatcatgtacactcgagtttgtaaactatatatgtgtttttcaactgcttctctttttctttatggaatattgttgttgcctgatcaatgttcaagcttagcagtgagatgcattaatatgtgcatgtactaccgtccatgtcggcccacagaaaattaattcctcggattctagatatggtctgctatgcatatgagattattctgataagggcaccgactagctgtgcacggtgctttgtgctgatgcagtgcaatgcaattagacatgttgtgtttgatgtactaaatactacatgcatcttggttcccaaataaattagtgcatattatagtaagttccaattcagttaatttgtatgctgtaacaagatcatgcatatgcatgatatgtgttgtagtgacctcctgctacatcacaagcatttgtatattataataaggatgttgtatcctctttgaaggccggctttgcatcaaagatcatgctccatgctttgggtgtttggctgttgatactgatcttcataggaggtccgagccgcttgatcattacctagtgataagattagaaccaatggcttatgatggatctcggtatttgtgccgtcacaaccttttgtttttttttctcttcacatggtttttttttcctcgatgaaccatacagttgtaaaatttttggacccgattttctccataatcaaggttagttctttacttcttaattaaaagtgagaactcgctgccatttttagaggtactagttatatataggcccacgtgttgtaacgatttctttatttagtttagtgggaggatttagactaagtgggatttttttttacaatggttggttttttgataaatcagtttaaatttttttgggcggtttttatgggtggaaagagatttaggtggatgtggaggactccctcttttaagtagtagagatatatatctttgaaaaaactagtgcatttgcccataggaacttatatagttttgtttgtaatctagttcaaattaaataaaagtatgaattacccctaaactattgtggttgtctgaatctcccctaacaattgcggatttgtggtcgtccgaattaccccttgaactcaaataccatatatcttacatcctcaactattcaaagtaaagaaatagcccttcctctctccatgagtattgtttcgagtggtttaggctttgagctgcacacgtggcagtccactgtggcaaaagcaggccttgctgccaccctcgctaggtatttgagagggaggaatttagggatttgaggggagagagaagcccacaatttgtcccatgtgtgtgcattgctgacatggcacttttgccatgctgaacaaccacgtgtatagctcaaagccaagtggacagcgaggtgcctgcaaagggaccaaagccatggagataaaggacactggagcgcatagccgataataagggcacggaatcccgagtgattgggatgtgccgtctccggctataggggagccccaaagaccgagaataaggtagggcagggacaccttgccgctgctcggaagaggatgagcagataggggagggaggagaagggtgtgcagaggcatgggggagtgacagtggagcttgatctaggtaagcgacccaacatccattgatgggaggagagaggggagaagataatgttgaatacacgtactagtcttaacgcagtatggatcatccaaaagtgactaaaattcatagtattttcaggtgactgaaaactctagatacaccattttagtgcaattcccacgaaattcctcaagtatcaattaaaagagagacccaagtttactaggggcctccatttcaaaagagacctaaggttatgaaagacaggcaaagacatatgaacagcactccacaccactatcacagtacgtcgattgatctcaacacacgggccgtgtgtgaacaaaggtgtactagattgtataggagtatatcgcaaatgagatatatgtagttgcagatatgcaaaacgtggtcccatgcaaccactcatgtccatatataatctgatcgattgatatggtgaccaaaaggacagacaatgcattatattcatcgtgtaaggagaactactgggatatcgatcaatatagtatcatctagcgaaggcatatatatgcagctggtgcgatggatcatatcacgcgcgcactgatcatatgatgatggggaaaatggcaacaactccatctgttcctgcacatgcacgcatggccattcccctctccctagcttttctctttaattcgatcactggttcacttatacgctcttaatttaatttgatagacgtacataggattattgattgctcatttaggacgcgaaacttttattgttttgaaacaaagattcagaaattagataaacggctaaatgatagagcatagctcaactggttagtttttttttcgtgaaatcaatccgccgggttcaagttctagagttaacacggatgctcgcatttatggtaatttattcttttagtggtagacaacatactcgttgacaacgagacgtccgtggtgacttcatcaatctcaagatatattggtccaatttttcaaaggtactcataggggtaggatgtgtatgtgttgttagctcccacgtttgtattatattttgaaaaagaatatatacacgttgcatggggtaaaagaaactagctaggaaaagctagctagattccgcgttacaaaggattcatggattaatgtttgcccatcaacttcggtgttgacagatatgatcccgcacaaataatatttttttaaaaaaactttctttatcatcgcttcttattattaagatacttttaaattaaatcaatttattaacttcataatatttaatttgttcgtcttacccttgaataattgatatgtaaactcaatttcagctatcgtccatcagcactttagaacacatctagttttgttagctccgtttcgtatgctaccgagtttatggcttgctctacgacctagacctacctgtcagccggttgccctcatatttttaaccatttgatcatcaaaaattgccaacttaaggtagaactatatagagtaaagtccatcaccggtctctaaacttgtaccgctgtgtcatcctggtccctaaactcgcaaatcgaccgttcatatccttaaacttgttcgactgtgtcattccgatccctaaacttatagatcactcgtttaggtcctccaacttgttcagttgtgccacctcagtccctaaatttggatttgaatatcatctgggtcaaataggacggtctaaagactttatatttaaaaataattcataactttttcatgtgaactctaatgaagataaactttataacaaacttgtagccctcaacgcgatctacaactttgtagttgaattttttttattttaagtcattttttgtcccaaaatgtaattttaaaattaaaatttcaaaatctataaacatgcaacaatattttgggaccctaaacagttttaattcaaaaacttttcaactacaaagttgtaggtcgcgtcgagagctacaattttgatataaagtttgtcttcattagagttcacatgaaaaagttatgaattattttttgatataaagtttttagactatcctgtttagggaccggggtgacacaactgaacaacttggaggacctaaacgagtgatctgcgagtttagggaccgggatgacacatcggtacaagtttagggaccggtgatggactttactcaactatatatgtatgcctattgagaaggcaaggtttaaattatggcttggagcattatatcctttctcccgagtatatcaatatgccatgaagaaaatttatataggtcctgtcccctaagggataatgaacctatgtcctactggttgtatttgtatatgaaagatatatgtgtacaagaatatggaaataattagacctagtcgagactaacttgtcgagaatctcaatgagatatttttttggggatctccttgtttgtgtagccccctcctagtcctaggttcaagactcagtgggataattttggtatcattgtgtgcctagctaagtccaagtagatcttcgtaatcttgcgatagttggatacatatttttttttatctatttcaagagagatatttctttatggagttgtttccatatatgaatttgtatactattatttcttcacctatgtatccatacgcgtgtgagttatctcatttagtataacgatagttacacaccaaatccaaccttttctctaccatcaaattgatgtccatcaagtgttgtgtgctactaaaatttaaattttaaaacttgattttgatgtttttccaacgtatatcttttttttaatattgacttttaagttgctaaaaacacatatataaaagttttacgcataagttattttttgatcactaataaattgttacgtcttataattggccataagcaactgatgagggcttggaagtcgtagtcgccagtaaacatatctatgtgatcaaacatatagtatatgcatatgcagtgaagcatgcatgtgaaaatgatctgaatgtagcgggcgatgcgtacacatacacgtgagatcgaagcgacatatatcacaccatgctcgtgcagttgcatcgatcgcgtaatgtactaatgtatggatcgtacaaaagttgtcgggcatatgcatatgcccatttagtttctctctgccgatatacgctccaatcactgatcagtgcacagtgcgtgaaacgtacgtacaccgatcgatcgacaaactcatgcctttaattatcatcttgtcgatcagtcatcgggaaaaactagagctgattttttttttaaaacacagggcagagcatagaccgcttataagcatgcgtacactcacctctctctatatatatacacatgtacacgttaccctataagtttatttgaaaagtgatacatatcatgagattcacaaagttacaacatacgtcttcgctatcaacaagcatgtcgtctattattgaaaaataataattagttataaatacgagcatatacatgctaaatcatgaacttgaacccagatgaacaaattccaccatcagaaattaagctacgctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagtatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctggcctcgggttcgacgagaccgagctccggctcggccttcccggcgccggcgagctggcagcgaggagctccggcaagaggggcttcgccgagaccatcgacctcaagctcaagctgcagccggcggcgcctgctgccgtctctggggaagagggtgctcaggaggacaaggaagatgccgacgcggcggcggcggccgccgacgagaagatgtcgatgaagaggtcggcgagccagagcagcgtggtcaccgcggagcccgatcccgacaagccgcgcgcgcccaagtacgcactcgacctctcctctcctcgttaattaatctccatttttgttgttattttcatgaacttgtgtggtcttaattcttgtataaagacagtttaatccttgaagagtttatgtttgctctttgtttcatcttcttgaaggatattaaatccacatagtagataggactgataaatggaaagctagcgagtagcgattcaaaagtatattggcaagtgttttcaagaagagccattagttagccctgaaggaatgaagtaaataaatttctgcagttttgggaaaagactgtaatttgatatctaagttttttttttgaagaacaaatttgacatccaagttaaaacgaaatgaagtcggagaatttttcaagtggcagctaggcaggagctagtttttggtctctgtagttttgggaacagagacattaggatcccaagttggatactctggcaatgatggatacaatattcagtcaaaaaaagatgatggatacaataaacgaacaagaacaagctttccagtatgtagcagtagagtactatccccgttctgaaatattactacatagaatagtatttgactcatccaaaacaatgaatctggatagaagtaatccagattcattgttgtgagatatatgacgatagatcaaatctcatcctaactactccctccgtctcagaatatagcaatttagaatggaatgagatccattttaggataatgtatccgaacatcccatcctaagttgctatatcctaagtaatatttagggaaggagtaagttcacgatagcttccgtgcgtacacagaggagcagcagtagaaaaatggccatctgatctgaaaccaacaagccattggaacttggaaagccgtttttctaaagaaaaaacatttttcatttatgtagtgcacagtaactggcagagacatggcagtttgcttgtcgcactaatttacacaaagcttgcaaattaaaataaagcattgtacaaaatggagaaaaggtgtcagcttttctttttctatattttttttacgaggcgtagctacagatgcttcgtttatcattgaaagaaaaattagtcgtaataacatcctctggtgtgaaaggatagacgagtgttcaaagacagggagcttcacatccctcaactagcggcaaaaatcctgaatgaaatccatatttggatggcatgtggtgcaaagaatcttgcaagaatagcaccataacatcctctgctataattttttcttcttttttttctgctacccctgtcctcctgctcttcttcttaaatataaaactagctcggctggctcagtttttttaaaaaaataaaaatagtcgtaataagcatagtacttcaatccagattagatagatctcaccattaaaaacctaactagttgagcgacgatgatgtcaacttttcattgattaattaattaatcagaatgcatatatgtcgatcagggcgcaggtggtggggtggccgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgttccagaacatgttcacctccttcaccatcggtatatatatatatacactagctatatatatatattcaactatatatgcatgatcacacgatataataagtttctctttgtcactgtaatagaactaataaaatcaacggtttctactaatgacattggccgttacataatcctgtcagtagaggactctatttcatatagagacgatcttaaccattgatttatgagttattctaccattatcaacagttgaggggtagtataaacaaaaatatgacctattagattattatagaaaagaatcaaagatgaacgatatatatatagactgattaaaatattaagagaaactattgcaaaacatctgttaaaattaatagggtggttgttgatcatgttcaggcaagtgtgggtcccatcagcagctgaaggagagcaataagctgagagatgacctggagtacgtgccgacgtacgaggacaaggacggcgactggatgctcgtcggcgacgtcccgtgggagtaagcctcgccgtcgcgataagcataatcccagttctaataattaatccccatcagctaagctagcagatcggatggatcgatcgagtaactgatcaacggatgaaataatactccctccgtttcaaaatatttgacaccgttaattttttagtacgtgtttaaccattcgtcttattcaaaaaatttaagtaattatttattcttttcatatcatttgatttattgttaaatatactttcaggtacacatatagttttacatattttatattttttttaaataagacgaatggtcaaatatgtgctaaaaagtcaacggtgtcaaatattttgaaacggagggagtaataataattctcttgatctttaatcctcatctcgtcgttaattgtttgttgcaaactgacatacgtgcaggatgttcgtcgagtcgtgcaaacgcctccgaatcatgaaagggtctgaagccattggccttggtcagtactattgtctcaacagaaattcagttcagagtttcagatcaaaatgtgttttacttttacatgcttcatactaatttggcactaactaaatagtatgtttgtttgattccagcaccaagggcagtggagaaatgcaagagctgaagctgatcaaggagaattaattagcgccgcatccagatttattaattttcacggatattatattatattatattatattatattatattatattgcatgcatgctttgctcctccctgtattatactagtatcaagtaattagtttactgtaattcagtgtcagttaagcctgtgtcatctcagtttttctaagggattttgatgtatttacatgtgggttagctccatcttgttatgctcatggagtatatatatacgtaacaacaatgtcatccttacgtcacccttttcctctctgttttttttttctgttccttttttttttttgcgggaaatgcggttggtgattacctgttcttctgcagggatcctgcagcttgtctaacactagtacagcagtgctcaattatcgtggccatccaacagattataattaattgcctagctgcattgtttaattaattatgtcgaggtgctaattaaaaaacctgtttctggattcaatgatgagaatgagaggcatccttttgtgatgtagtgtacacaagaaacattagtatcttcacaatgttttatatttcccagccagctaaagagaggaaacatgccatgtgcatagagatgggggatcttgtttttatatatcttccagtggtaaattgtgcatcataatataatatgatgttaagagtttggggtttttgttttccatctatctgtattacgtgctaaggtgttcaaatagtgaattgttctacaagcaagcaaataagaagggtgcaaggttggctaaaaaggaaaaaaaaatcaggttgttggaaagcagtgccattatttttttttataaactttaggctgctgcttcaatgctattgtatacttgtatgcgaatattgtatccaaaaaaggaggttgaatgagaaagctattttaaactattgcagaacttaagctatcttttgttgatcctatgtccccttgtaatgatgacacgtcccaaacaatccgggtgttttcaaatgctccagcagagcaagaaaagaatcaaagatttatttttttacaaagttgtatcaagttgttagttgcagcatgccaacaaaattagagatgagtacaggttatgctgatatcaggggttctaatcttctgtattttcttcctctcaaggagacatttcatatattaaaaatcttgtacaaacaggaatcaggaaacaatagctagtacggtcggtagtaccaaccgtctaaactggagtagcatgtgtattcacattcacactgaagatccatcaatgagattttctaccacttgatatctttcagacttgataacggagtaaaatactatccctagaatttcttccataccttaatagcagagtaaaattataccactagatttctttcagacttaatagtacagtacaacatttgtatcacagtaactgcctatactgagggcactcatgctaagctagcaaagcagtaaatgagttgaacattcctgagcataacatttcaaaggatacaggctctttattttcccgaatagaatagaatatatcgtcatggctacatattattgttttacaaagtctcaggccagggaaacacacatcataagcaatggaaacagttgcccaaagcaactttatacaacaagcgcatcatagatactataagttctggagacatcaccgaatgcacaacaacttaacaatctcccagcagtgtgctataaaaattaggatgtgtacaataacaatgctcaggtttctacatctggttacgttattatcaatcaagatgaacggtgcactggttccgccttaaatcgatcccctttttgtcctgcgatggctgagaaattcagaggtaagcccaatatgtaggtgtaatggtcaggagattatgcggatttagaggatgaggttacctcttgctgtgcgaactgcggaagttgaaccctttttgaaccatctgctagccgcttgcatggaagatgtggttcagctgcagcgaactcattcagaacctggcaaaaattttggcaatacattggaaaatgaaaggcaaggggcaatgcttttccagatcttttttttaaaaaataaaaagatggctcaattgacactattaaaaaacagcttctcagctttataaattatttgtccgtacaacaaattaagtgcctaaaccagaactaccagtctttgcaatcagaactgtaaaaggtcagttgcactggttgcccaacaaaatgtgaaatccaacagtttgcatatgaagtttctaggaacatgtttgttccacatgacatgatgtttaggaacaagtttattgcaaaagttatgccataaaaaagagggtaaagcaatttgatcaattgcgaatttgaagtcttctggccggtttgcacctcaaccagttaccagcaagctggtcaggtttactagctaatctggttcatcttttaatttaataagaggcaaagcatttcaaactgcaactagccaactggcgactgccaactaccttatgctctctcaaaattagtgctggtagcagtagcatacataggcgtcttttcagtttaccttctctgctagtcaccgctcaactctaaattcgtgaggagcaatggatagcaaagcaacaaagcaatgaaaacctaatgcaccagcagttaaggacaagatggatgaaccacacacatcaacttggatgtcagtagttcctaagatgatgacaattgacataaggtagacaaacaccatgaactgatcaagagccaaccctttagaagcaagaatacagacacagggagactgatgagtgtatagagtatataggtgttctattgctcgccaatggtctgagttatttggcctgaaccctgaagactcattgagttggagggccttagactaaggcactccagttcactatataatttttttaagggagggaagtctgctacagagatttttgtgagaagtgtcttatatataaaatctagttaagaaaatctcaagttacaacatcagtcacatgacgcaggggcatcaaccatcacaatgtacacacaccgcatccaattgtatggtttatatctaagttatgtattgcctatggtctggtataccttcagcctgctggtgcttactcctttgtagattccaattgaaacacttttcttcgttatgttgtctttcggtttatcagtttctggagggtaaaaatgagccaaaaaccaaaagcaaaattagatgtttttccaccatattggatacaagaaccttttttccaaataaaacaaactaaacttgaagttagcaaacttatgttcagttcaatttatcaggagtgtcttttagtttatcaatttctggagggtaaaaatgagccaaaaccaaaagcaaaattagaatgtctttccatcagattagatacgagaaccattttccaacttaatacaaactaaatttgaagttagaaagcttatggttagttcaatttatcaggaccaatctagttctgcagtctgcacaagggcacatgtctacagttattggtaagcaaaacacacatgtgaagtgtgttcttcagaaatatctagtcattctacaagaattccaattacttgttgtccattgtgaatgatttgatgcttgtcaccttatgagcctacttgaaagttgaaatacaagaaactcaaaacacagtaacaggaaaaatgcaggaattgagtgtcatgatcaatcaagtcctacggcagctgaaaaacaaaggaaaacttcaaaaggtgtttagatacaacaccagaaaattgtaggtttggaagagacagaaacagaagcatgagatatggaaatattcctccaaagcccatattgagtagtctaccatattaggagtttcaaaggaaatcatggagtccaatcctttgttccaaaggcctccataggacttttttttcttacagaaggattgtaattgtccaaaattccatatttatcctccattttaaacggggcctaaaaaatgcaataatccagcgacattgaattttacctagtgcacttgtaactgagtaattgtgaaagaaagttctatccaaaaggaaaattcacatgggcatgagaaagggtctcgtaaactttacctggtttctgattgctccaatcaacatatcatgacaaccagatgcatgcacattctttaattttggacactgaagaagcaaccgttctgcgcaaaatatttagatggttaataacgatggctactatcaacatactcaacaacatgaagaaaaggggaaaggacataagacctggatttagatttgtacaggagttgaggtttagatcattcagctctggacaatttagatatagagcctgccatatgtgaaattagtaaaccatatgaatgattatttcaataaatcaaagcctgcaaattccaaaacacttacatctattgctgagcagccccatagactgagcttcttcagattgccatgcttaatgataagcttttggttagtagactgttttttcgaggtgggcaattttggacaaaatctaatggcaccgttaatttcaccaaaataaggcccctgtttttcattctgcaaactagcacataaggtcattccacagtccattagctgaagaagtggtaattgtgctgttgcaaattggatcccacctatgaaaagacaagataagttttttttacgctggatcatgtaaacacatacaggtggacatctataatggagcacgaataataaaccatgagaaaaaatctgtcttacacgtcgtcacatttgggcaaagagcaaggagtagccttgataaagtatgaggaaatgccttgcagatcatcccgacaccattatcactgatactagatctggagtataatcaaaatagctaattacatcagttaattttgaaaaccattagaggggaaataaatcaatagctttatgatgacttcgtattttatttatttctaaggacataaagtagtgattacccgcttaaatcaagcaattccaagcttgcacaagatcgaacaatagatgcaacagctgcatctgttatttttgaccctagaatcaatgatagcatgcacaagcccctgtgacataataacaagattgagatcaaagggttgaaatgctacatagttagaaatttgtgatgataatcattgtattatagctcaaagatccagcaagattacattaaaagcatggtgtgctggaaagatacctgaggctagcaccctccagagcaaacacagcttcattggataactgagcagatgatatgtgcatgttttttaagttaggacaggtacgacccaggccatccatcaatgtgacaagatcagtacagtcgttactttgctgtgtgaagcacagcgagatttcgctcatgttaggacagtttatgacctacaaggcatttacactccaatgaattatagctgaaaaagaagctgttaaattgttaaagtattaaaacaaaatattaccgattttgaaagggaacaaagatctgacagccaaagaattgacaggcttgaggagtttagattaagaaaaccaaggttacagcaaccaccaattttgagaactgagagagaatgcttttccgaaacaaaccgacttagttcctccctgttgagaacagaaacagctttatttgaaacaggtcctggaagtgggaggctaatagtgttgcagttattttaaaactatgtaaaatcaataagtattgaacattcaagataccaataatggcaatatagcccaggagaaaaactggtttatgcaagcataacataacacgagaaaatgattagggacaacaaaaattatcagcaaaggaaagaaccaactagattgcatttttaatagtagaattgtaaagaagaacaaatcctggcttggcagaatccaatttgctaggaaccttgattttacatggcaatttttagatgggaagctagcacttgcaaacaaatacatgtcaatttgagctattcaaactatatccaagcaagcccactctatgtaatataatgaaatttaaagaaccaaaagacaaagtcaagatacataagtaaacaccacatcacgtatgcaacaactaataagtgataacgtttgaacgtacccagtcatcctgttgactgcgttgtcagacatgctgatctcaagagttcctaaacttgggcaggaaaaagcaagacaggccagtatagtggcatcaacatcactgcataaaacaataagatagttagatacctgtgataataagttataagtacaacatctttttcaaagcgcaataaacagaaaccgcaagaactgtgtatatgccctgtaataagcatagcatcttcttctcagtgtaaataacagaaacagcgtcaaagctatattgactaccacagtggccagatccaaaaaaaggtagttacttgtgctcattcacgtaaatctaagcgcacaagttaatttcactgttgataggcttgagcgaatctctatactgatggaaaaagaaaagatttttttattatttgaactttttaaatttttaatttaaaaaaaaaacctttcaaaacttatttccaagatctgaaccttttggccacactagccggactggcgtggcaaaacaatactaccatgccggtctggttggcgtgacaacgtatttagccatgccggtctagctggcgtggcagcgttatttggccacaccaccctggctggcgtggcaagataaaactatcgcgcctacagtgtgtggcgtgtcagtgttgttttgccacgctaggtgggctggtgtggccaaaagattcagattttggaaataagttttgaaagggtttatttttaaaatttaaaaagttcaaaaaagaaaaaaaaaagggatagtaagcacaaaaggtgtaagaccagttctacatttgttagtgtgcttgaaaacctttacgatgtgaatacttctaatttgtttaggacaaatattacagttacttaaatgataatagacttgttagttggtggtcactagccactttatattttataaaggaagggatctttaaaggttaacagatgaaaaagataagacaagtgaaacaaaaggcaactatgctacaatcccttcactgccagcttctctatcgcactggacctagaaagagtccaaactggaagcatagatccttgagaaatagagcagctatgagtgctgtccactacctctaatgttccaaaacagataatccctcactcgcaacagagacctttcaatgtattgtaccagcaggtcattgataatcatgtgttcaattgtccttttgctttaccaaccaaaatgctacctaatctgcgcccatccaattgaccatgcatacagaataacatgtcccacaactgtagaatcagtcaatataactaaaaattatgatgaaaataaagtttcattaacacggcaaagtggagccaagaaaaatgtaaagaaccccattttcacaactgaaaatagatgtatgttatttaacataaaataactgaactgcgtaggtactggcagaatgaactaatactgttttttaagtttttaaaaatagttggtgtaggccacaggctcaaataatatgaattatgatagaagagaacagtttctactgttcaaaattagcagattttattctagggctagttctatgtcagtccatcatcaacgataaacaacacattacatgtgcatttcctacaaattaatctagtcgatcacttgtgaaagttatacacgccacccttgcaactatatcaaaagattgtccaaaagagggagatatcagcacagacatgtcttaagcatgctccccattattttcaccttgctgcactgagaagtgagacactgacaagcatcgtgttgtgcaaactaaatctccaaacaccaagatctgatgaacccctcaacagaacacacgaggttttctcatccaaagctaaaaggccagaaatgacgagcattttcccaacagtttgacactagtaattccaataaaatagtttcatgtgccaacaccatttggtagatttaccacctcagcacatccgaccgcaagtccatgggattccggtgtcgtaagaatagaaatggcatttcagtgccatgccgactagcgataaatcttctagcagcagtgacagatcggccatcagttgtccttgggaaatctcacgttttcgacgagttagtgtgattgtgctatggagtttaaccaaaattcattggccctaagagtcaaataatttagaaggcattttacagtgccctgggcagccaccgatgagagatccggccatgaatccgagcagatcggcgtggaaatgagatcgtttttgaaccggattcgttgggggtttcacctttccattcgcagggagagccgcgagagcgcggggcaccgcgggagcagcgcgccgacgaggctgaccccagcggcgcggaggcgcagctcctccgccgcgcgccacactcgccccgcgcagtcgcgccagccgcggctgaccgcggcggcggccatgacccccctgggccccaggcggcgcagcacctccgccatgagctccctcggcacggccctcccgcccagctccaccgcctcctcctcctccttcaactcctcctcgccgccctgcccctccaccat

SEQ ID NO: 58609 - DNA, 6575 bp, Oryza sativa
tgccaaatcagctaattcactatataaaatatgacagtacagctactagggaaaaaaagagagagagaaatatactaccaattataaagaataaaggaaaacactttaatttggttgtccctgatagaaacaaattctaaccatctgttacttgtggaaacaaattctaaccattcattaagagaactaccatcaagaacaaaaacagcgatatgctattgattaaataataaaggatatcttcagtctaccgttgtgcatgcatgcaaagtaaaagcagatcagtacattggctgcacaacagctatgccttggcacctgctgccgttgagggccacagatgctggcagtagcagcagccacagcagcaacaagccaacaacagcaaaggcagccgagcagaccctatgcctctgtcaaggagttgtggaccgtatattcgataattgatcaatccaagaacaataatgcaaaatatataagtgcgtgcatggttcctcaacatctgatacgttaggtttgggatttaggacatcaatactcaagaataggaagctgatggaacaaaacttcgagtgacaagtatagacaaaatgtcaaatttaactcaatcagaacagcatatactagctgtgaaattgaaatcttgtggggaatcaagcataatagaaatcccgcttatttattaaactgccaatggctctgtaacatatatcgttaccaggcgagtacaggctttggagttgtgttgtggttcttatgtttcaagactacagctggcatgtagcagctatagaagaaatgcaggccaacaaggatatctacaagcaattgagttgtttcctgcattcaccatccaccaactaagaaaccatgctctgtccaaccattcgagttgattttgtattttaagttagatatttggatcaattgcaaataaggaacacatcaaacataaaaaatggagcaatggaaaggataattatgacgatagacaggatagttatgatatgcaagctttcatcctgaattgaatataaataataggattaaccagaaaatagtatcgcccacttagcaagaattcaaacttatgaaataggataagtgaaatttgaccaatggttgagcttcaaagctcacctcaccacaaagttcttcaaagaaattctttacatctaattgagtaacctgcagggaaaggtgaaagatgtcatatgtttgaattctatagcttccgaagcttgaaaaaatataaataaccagaggatgaaacgaaaacaagtcaaaactatagcacactatgaagtaaaaaggagacatgtaccttcttatctatgtttgtacaataaacagttcttatgaccatttccttctcatcctccgtctatgggccagacacaacacagtatgagtactaaggttatgtggagaagaggaataattctggcatcaaaaggtgaaacaacgcatacaatacaagaacttaccctaggaaggaactttggattcacaggcaatatagctgtctttgaaggtaagactctaacagggtagaaaccaagcattgtgccaccaaggttaagtgcagttcttgcgccctctttagaacaaataaaacttacatacatcaaaaaatagattcactatgggagaaggcacttcagtagaaggtgaaactatattaccttcatcagcaaactcaatgaatgcaaaccttagaactgagtgtggatcaccacagattctgcagtcaacgaccttcaggagagagagggtattagtatggttttggaaattttcattccataatttcagtaataaaaacaataaccccagaaattgcagtacttgatattgtacacaatataagcaaaaaaaaaaccgaataaccaaaatagtttcatttcctttcttaataacaagaaaaaaattactaatagaagagatgttgggtttttattctaacatacaaatgcactcaccctttgtcactcatgtacttacagtttagagcataaaaaaccatcatgaaaaatttcgaaagaagttctagatgtacttctcaaggtcctgtacatatgtataaaacttcaaatatattctatagtcagcagggaaaaaagaaaaagggccaatactaccacccatagcaaacttgtttttcaaaaatgtttcttttagtccattttaaatgtaaaaatctttcaagggaggtagactgcatcatcaaatcctttctctggaattatttattacgatttggaaccctaaccgaaagttgagtgcacgagcgcaacaaaagggtgagtgcacatgttacctttatttccatcaactcgacggtcattaagtacagacttgctaataagtggaacaatatgatcaactagtagaaattctctagttcaatgcgagcattggaatagtgaaaaatcttatttgcagtatttcatacataataccagtacaacttgatacttcaggttgaaggaacttacttgcccacagttagcaaatatatcagcaagtctctcctccgtcacctaacagatgctcagctcatcagacataacagctcctctagaatacgtatgcatgcttagaaaaatcctcaactactcacagtatggtcaatatcagaaacataaacagttcgccgaatgctgtcttccctgtctgcatgccttgctctctcgttcatcctcctccttccttgactgaggtatccattcctcctctgacaaaaaaaaaaacaaccattacatcctattctgatcttatattaattttctttttccatggacttgccaactccaaacttaattcttacaagcagctgatcatcatctgttaaatcctagtcagcaaaataaacaaagaaaccaagtgggagaataatagaaaccctgaaaggggagtctaatctcaaactttccccatatttggggaaaatagtctcaatctttgtcgtctaatatctgaaccactaagaaaagttatgctaaaaaataaaaagaattctcagcatgggttgcctcattacaagacgatttgagcgcggatcaaagaactagcagtttcaaagaaaaaatagcgtttggtaatttggattgtctacctactataaataaataaaaaaagcaggaattctcagcatggattaccttaatgcaagacgatttgatttgagagtggatcaaagaactattccatgtccatggcagttttgaagaaacattacggtactgtacaactattcgaaatgaaatataatagaattgtgcatagtgcattgactggttttgcagtgtcataaaaaaaattaatcatcaaaaataaaataggtaaacctttcacgaaagaataccaactaccgcaccacgaaccaccaaccgataatgcaatccaacacaaggggaaaaaagaatccaatctttacctaccaaactaatggaaagaaataatcaaataaacaaccaaatcccccacacaggcacaatcacaaccaaccaattcagtttctcaagaacagcagagtttttaactcagatttttttttcttttacccgacgctgctggtaggcgtcggcgccggattccttgccgcccccgttccagcctccgatcgagttgtagtcgaacaccggcgcgtccgccgacagcgccttcctggacggcgacgagaccgccgccgacgaggggacgaactccttggcagccgggttcagcttggacagcaggtccaccagcttctgcacgcccttctggtattccgcctccttcgccaccgccgccacggcagcggaatccgccggtggagccgcgcgcgatccccccgccaccgccgccatcccccagagccgggctcctcagaccagacggcacggccgaccaatcttggtcaaatcaaatcaatcgccgccttccctcgcgctgggctctacgcctctactcctacagaagcgaggccatccggtggctctggggcgggcggaggaggaggaggtggaggttgggggaggctaccgcgtggtggtgttgcgcgctcgagctctcgccaatggcgtcgattagtggcgagtgggttttgctttttacaaggttttggccatttttttttaattcatcgcaacagctgcgaattggaagaaatggtattttggaaaggaaaggacagtgaggaaggagagggtatagagtctgcgtggacgcggtctatgcaccggcaggtgtgaagcacgtgcgctactgtgcacgtatactgtaccagcatggtccatgtccatcggtccatagccatgaggccgtattaaatgatggagtaattagtgtggttgatttgatggattaaagcctaccaaaatttccatgtggaaaattaaactattttctatgcatttttttttgttttcaaggaggctaaggttgaatagtaaatacacattcatccctttgtagtacttttttttctaagcctatttagaaaaaaaaagtaaagagtaattagggagccacagagtagttatttttctaattccaaggtgttgatatcactacatgtcaaactatatcagccctttaaagcagcaaaggcaaaatgtgggaaaactgcaatagcaatatatttgtcgttttctaatggaagacattgtgaaacagattttcctaataagaaaagtatgtaaaggaattagtaatatgcctcgccaagaaaggaagtgtactaatatgcctcgcaaagaaaaaggatttactatctaattaagatattacttatatgtaaagtacacgattttggtttctacacaatagtggaatccctgtaaaaacgtaatgtagggcaatgctcaatactaattattttcttccatttcgaacactaaaataatactagtagtactatctcggtggaataagaactcagactctgactctgttttggaaggaaggtcgttcgcgttaaacaagatgaagcacgaagaaggctgaactccatatcaagagtattcatcaaatcgccaagattctccattaagtttgtccatgctaatccaggtgtacgttacaactaattgcattaatgctcgtaccttccgtagaccataatcataggttattatcccctagccattgattaaattgcggggtattactcatttagtttagctattattactctctctattttcaaaatataaggcgcaatcttcactaatataaaggccaagaaataattattatcaattgtttgtttggattacttcaataaaacaatccattgcatactccacccctcaagatcttggaggtgttagttaacttgagggtggagaaatccaatgggggttaatatccaatgaaattaaacatctctaattttaaaaaaaagggttaatttcactagatcaccctaaagatctctaatttaacaaaaataaaagaatgatggtgttagttaattacatgcatgcatgcatgtgcatgtttatattatgaaacgttgaaaaagtggttgcgcatcttattttgagttggagggagtatttggattagcaggaataacttactgcttatcataattatgtagatgtactttcaaaatgtgtttactccttagaatttgagtcatccatcatcttctccccactccaatgccgcacgaagcgtagccacctccttcctaaaaaaataaataaataaatagttagttaacggaaaaccggttagatctaatgttttatgctcaattcacactcttagcctatccttagtttgtatggacaggtgtagctcatcccacatcgtatgggcccattgcgatatacaaaaatattagctaaagactgtctgtagctttcatctcttttgagtttgtgttgtaggtaagatatccttttttatgtttctcataatcaatatcttttctagacattagctcattacagaaaaatttactcaagtttttcaaaaagaaatgatgcatactactttaagctcagttcgtttgtctatgttctcaacctctccctctcgatttccgtgcgcgcgcttttcaaactattattttggtacgttttttttaaaaaaaagtttctatacaaaagttgtttaaaaaaattatattgttccatttttgaaaaaaattagctaatacttaattaatcacgcgctaatggatcgctctgtcttctgcgctggaggcaaacgttccgaacctgctctctccaacagagcctaactacagtttagatatatgttaatggtactaaataccgatgtaaaaaaacaaccaaatatattttatggataaatattttatatctatgttattaacggtgtgcaagtcaagaaaatagaccatgatgaaaaaaaattgtatgtttgtacagtaatgtaatttattgtatatttgtatactatatgtgatactaccaggggaaaaagaagcgcctgctggaatcaacaccgtcgaaatcgatgggtttcttacgtatcatttcttggatggaatcggaccacttctcgggcatcatttcccttgacaatcgcttttgttattgatgggctaatca

SEQ ID NO: 58610 - DNA, 924 bp, Oryza sativa
gtatagattttttataatgtatggcaaagggtataaattttgtagaatgcatggcagagtataagattttggtacaattttggaggcaaatctaacaaaatagattttcataattggatcgaaatatttaaagtaaaaattattgtcaaagtttaaacatattgactgcacgtatttcaaaacagaactaaactgtgaccggaggcaacctagatcatctgggatgtaaatggacaaaacactttgtttttacgacttaattatgttgagatctccatccaagcatgttgtccccatgcttgacaatccaggtaaaaattcagaatttcatagaacaaaatttttgcataacccatgaaagcagcatgctatgctggctgctttccgaagtcggaattcaatcgaggtggaatgtgtacacgggcaaggggtaatcttcattttacacatgggttacaaatccataggaaaaaaggaggtccaactgagtgattgcaataatcatatagctagaggatggagagggatatttttttttttttggggcaatcgagtgaactgcgttgcaaacatgaatatacatctacagggcgttgcagcgacgaacagcagcactactaatgtcaatggaggatcacagattcacaggcaaaatttgaaggtcgaaatacccaaagctatctgtggttgaagccttaaaaaagtggattgaaaccacaagtttgagatgtgcaacagtatgcatgtccgcatgttatagctgcagaataagagggcaaattagcatcatagtgttaatgagatgagtagacaaactggtttaacattcaaggcttctctgttgttcttttttccaccccatgactgaaacccaacatatggaagtcgatactaattcaatttcaaacagcataccaagcaact

SEQ ID NO: 58611 - DNA, 2113 bp, Oryza sativa
ttaatttgaaaaacaagtccaatttactccctcgaactatttcacttaaccccctaaactatttttctgctcattttaacccctaaactgttagaaatgattcactttactggctaattacatttctcttctttgtttctctttatatgagtagtattttaagcttatattttgaagagccatagatgacaccattatcaaagttctaaaatagtttcaatattttttcatgactattttcttaaaattttaaacctatatgtttaaattagtctcaatgcttgcaacctatgtaaacagcgattaaaaatgccaataaattgttgagacttagttataatgcatatatcaatcccaccaaatttcattgcaaaatttgacctatatagagataaacaaaaaagataaatatcgtgagggagtaagacaacattttcaatagttcggtgagtaaaatgagccgagaaattgtttaggggattaagtgctccagcgaaaaagtttaggggggtaaaatagactttttcccttaatttcacatataaattctatattgtaacttaggaccatagcgtaaaaaccagatcggaccggcgatccaaccggaaaaaaagggaaccagtgttgcccatggtttggttctatgggaagaccggatatgcaattgacctactctgaagtctgaactgcctgaaatgcacggttttaccatgaatcgggattaaactgtcacctgttggaccaacagcacaagaaattttgggctgtacattccttattgggccaaatcaaggcccattaccatctcagatgtgctatttacacaaaaaaaacacaatagcgcacgcagacagggagttagaacaaaaacacgcatcactttattgactgacggttcagcacatgaaccggcagaccggccggtttcaccgccgtaccggtgaactgaaagctttgaccgggttgagctccggtccgagtttttgtactatgcttacgactcaaaataagttgatagtataaagatgtatggaggatttgccccatactttaagtacacttaagttgtagattctgatattgagaaacagttgccgcaatacttcaaattccacgatatcatcaacagagtaagtaggtgccagagggagaactttaaacattgcaaaaagtgcatatcagatgtggttgcatattgaatcgatagaaatttcatcgatgttcatgttccacaatgttttatactctgcagaaaatgatctgtctcgttgcatgctaattaccttctgtagaatgactatcctggttactatggatactgcctgtaactatagtatttcttaaggaaaataattaacactttatcattattgataaagttaatgaaatcaagagtaccttaagggacacccgccgagctaatactctcctcaaagcagataaaattccagcagtaagtgggaccaccatttctttcattccaataacttgtgttcccttctccagtgattcacttccaaagctatctatacaaagtgagggattttcaacatcatttacttgagttcataagaaatttggatggaagtcttaattgacaaaaaagatagaattttgcagcgtgttatttcagaatcagatctgcaaaataggatacatagtggtgaatgtgttcttgtagcccatccatttcctaagagatagtatgctaccagcatagcagcgagcccaccaatctacaaagccaggaaaaacagatgtgaaaaatcatctaatgaagaacttactggttgctgacttgctacttcattttttatatcagtataggagcaatgttttgagaaattcagaaaaaactcacagaaaaaattcaatagttgctacacatgatcatagacaagaattagtttatccagtaatataatcacacttgcacagatttctaacagttatctttcctgaaaagaaaccatgaagaatgtattcctctgaatattcacttcaagattcgtgcatgcatgcatgcagcctcatctgtgctttatgtcgatcagattacccatataaatgcactatacgttttcaaaaattgaagtgatatcttttaaccaca

SEQ ID NO: 58612 - DNA, 6355 bp, Oryza sativa
aggttgtagtttgtgggatcttgctggtggtaatggcagtcggcaactttgtcaacacgatggagactttgatgttaaaattgaggttcaaagcaaaaatgaaaagagcaaagagcaggcaggatctcagtcgccaacaccaaaattgacaaagtgacccataatggtgactccatgcttggaaacagcgaatgctgacacaccatctctcttgtaaatcccttaatccataaactgttttggctgcccatgattttgtgttttggtaattgtttcacattgaagttcatattctacggtcaatgcacgattaaaaacactgttaactttaccacagatgggaacgctaaatttatgtgatttgtatgtgctaacagcgcttgcctaaaattgcagagaacaataatgtattatgtcagtagtcagtagattccgtggctctaattgcagagagctagtaacatgctgaaaatgaacagtccacagctcagaccatatcaatgcttctgtggctctatttagtggcattagaatcgtgttcagagtcttgtccaaagtttgaatgtttcacaggtttttttatgtagtgccatcagaatttgtgttcctctatctttgtgtttgaagggttccatgcagaacacccagtgatatagagaaacatcaatagaaatcatttggtctgattggacatgagagttgtaactcatcagtatgatctgtgttcttacaacctctggttggtctttaatccatagaactaacatagaagaattggcagcttgtaaaccctttacctgttggttgaaaagtcaggagtgtgtgataaccattttgttccccattttttagacaatggaattttgttttggacatactgttgtacctattgggaatacattctgcatttatgagcttgcatattggcaatatcttccatgctgtggtccagcaagaaacctttgcaagtttgcagacctgccaatcatcagtgcttgagacaaagcaaaaggcaacggagctcgctactgtgtatcactctgattgcggtagcctctgttctagtacctcaaattctttcaactactgtgtctaatcatatgcaatccatccaatgacatgcaccatcatgattgaatcattgagcccatctcatctctgtatgattagtttttgtttgtcagttccacacctgaaacccaagatcatagcatccaaatgcacaagctgcactcttaatttagaaatcaatatttacattccagtatttcatcactctaatcaattgattccagttctttcctaagcagtgttcatcgtttcctacaattaattaattaccttgccaataataaaacacacagacacaaaaataactaagtaaatcatctacaaaataaaaataaactgcaatccgatatccatcatgtggaatcggaggcatcgtgcaggtcgtgatgagcaatggagatggacgtcgccgccttctccgcgatggccgcgcgcacctgcgccatcgtcggccggaggcccggctgcgccgccaggcactcgacggcgatcctcgccacgtcgccggcctccgccgcgtcgtagtcgtcgcccagccggcggtcggcgagcccgtccaccccctccgtcctgacacgcggcagcaaccgcgccgtgaggttgcccccgccggcgccgccatccgggccgggtatcccggcggccggcgagccggtgatggcctcgagcagaagcacgccgaagctgtagacgtcggacttcttggagacgatgccggtgcggaggaagaaggggtcgacgtagcccggcgagccgacggccgccctggtgggcgcgacggcggcggagaacccctcgcaggcggagcccaggtcgcagagccgcgcgcccaggccacggccgtcgaggagcacgttggacgccgacacgtcgccgtgcaccaccggaggcgcgccgtcgtggaggtgctcgagcgcgccggccacgtcgtggacgacgcgcatgcggtggcgccatggcagaggcggcgatgcgccgccgtggaggcggtcggcgagggtgccgccggagaggtactccaggaccagtgcacctccctcctctgcacgcagtaataaaatttcttttaattaattaatctctttaattaacaaaaaatctctctcttagtaacaaacgtataatattataaatcattttgacatacatataataccaaaatagttttattaaaataaaattaaatatattttgataacaagtttgttttatgttttgtatataaacttaaataagtttaacaaagaaaaatcaaaatgatttataatataaaacggaggggtagcaggttaattagatgaagtataaaatcatttgcaatttctttttcttttttggggggatttgcaatttcattcatctggggatcaaaattgaattagaattaggattaaaatgatatatacgatcgaaagcgatcgtgttgagttaagttttggacgacgaaatgggacgaaaataacacaggtcgttactcgttaacgtactagacataaataggcaacagtgaagtgacgtttgttcttaatcgatcggtaggtaggaggtaatctccatttcttcttcttattgttttccccccgtacgacgtacgcatgccattctctacacatgttttattcggtcgatttgaaatttaatttgtgaggtgaaatgtaacatcatactagtagtattcatattgaactaacttaataacaaatcttaagaggagaaagaaattaagcaaagtaaataaataagaaagtgaagaacatagcaagcagcaagctggagtagctagcatcagagttgcatgcagatgcagtgtaaagcaagtgaagaacagaaaaaagatgttcccttttaagacttttaaccacaccgagacgaggtaacgtaagcttagagtcaaagcttcaataatttgtgcaaggaaaaaaaacacacataattcaagcagttggagtagtaggagagaggagagtgacgtgtaccgtggtcgtcggagtaggcgaggagggagacgatgtgggggtggcggaggcggcggagcaggtcgagctcctgccggaacgcgcgcagccaccgctcgccgccgcaccaccggtgcaccttcaccgccacgggcggcgagacgacggcgaccctgcagctgcttgccaggtagaccgtgctggagccacctcgccccaccaccgccgcctcgtcgaagccgccggtgagcgcctccacctcccgccacgtcagcttccaaggctccccctcctccttcgtcgacgcaccaacttcgccgccggccgcaacaacggcagctcttgctgaggaggaggagaacacggcggcatcagctgtcgtgctcccgccccgccttctgcggcctcggcgtcgacgtcggcggcggcggcagcacggtggcggcgccggagcccggagaggcagtgacggaggaggaggaaggtgatggcggcggaggagaggaggaggaggcagaagaagaggacggcgagcgccatggccacgtccatggcgccgcgctaagcttagcttcttcagtttgggaaagaaatgcaaagcaaagcaagagcagagcagaaaatgggttcataataagtatgcatggccagattaatgtacaggtggcagtttagttttactacttaaccacagctttgatttgatttgatttgatttattaatccctaatcttgattccccctgtgggaatttaatattaagctagcccctcaattctggtcaacgaatgattatattaacaccatggtctcatctggtctctgtatatacatggttgctgttaaaaattgtttttaattcataatgtgaataattacactgtctcttttaatttatttatttattacagtaggagtagtaccttcccatacggtgaatatagagtcaacagcatcacatgaaaattaaagagagggatagtaggatgcattaaataattttgcagtacaacaacattttgaaaatctctgggtccttacgatgtacggatacagatatatgaaatttaaattttgggagtgagtaaagatatatacacgccgacacgtatgcacggcgtacgcgtatacgcagttggttggatcaaatccccacgagttagcgactactaatcaatttgggattaatttgccgatcgagaatgaacagtgcttccagttaatgttgttcctgtcagtaccagcagtttgtactcagtttgcgtggacggcgcattataatatataaacactcctccaaatactcagtgttgttaatttggacagcgcaagtaatctcgaatttaaattttgagttgtttttggagtattttagcgacgatcgatcagtttaacggactccacgaggacgacagcttacgaccaatgagttaatgagtggtgggttctcccatgccctgcagttaatctactgtgcaatacttgtgttaattacttcttcacctgcgactactgttcttctgccagccaacacagtgtcatgaatcattttgatttccatacacacgtgtaacatccataatttaaattttattttcataaagtacaacatactagtgtgttcatttcgtgaaagtgctaacaatcttatcttatactgatatggtttttcaagctagctagttaaacacgatttttttcagtgaaatttaaacacatgctccctctttccttttttttaactcctatgtgatacgtaagaaaacaaagggagtatcttgcacgcaagctagaggtgtactaggcatagaacgtgacaagagacagaaaacaaacaaatctaacgaactaccagataattacaattaattagtactcctaattaaacacaagagaatcacaaaccaacttattagcggcgtatagctagtgtagagtggtactgccttgattttaatttagccgtgtgagtgaggcaactgtgatatgcctagctagctaattaagcaggagtagtactaattactacatcctatcattgatgagctctatctatccagctcgaagtaactcatgtcgctcttcacctagtggtacgatctagctagctaagaaaacccaacgattgattaaggttgatctgttttagcttgtcgtaactaaagctggagccaatcatttaaggtttaatttgcatcatgtgtatactccatatatatattgttgggttagttatgcacttatgcaatgcaagcaaagaggttaggttggatttatctgtggatttgtcagcagctgtaggctggctgcttcagttttttctgtggattaaatctgtcccctgtgttcagaagctgcattatattgctgcatgcgtgtggacaagggaaaaacgcatcgcatgcttgatctttatggacttttggtgaagcgtcgctttcttggtttcatactgacaaagtcattcataagcaatacgagctaggctgcagacaaattgatgatccattttgctcacatgtacaactagccagctagctgattcaatggaccttctggtatctcaaactgcttacagatggggaaaaaaaggatagtagatttgttattatgctgcagggtgaatagactgaattctgaatataagtcactcatgtttggaacggagtaattaacgctaaatgtaattaattaagaaccagttgattgattcgttcctacttcctactactctcactgtcatagcagctgcactgtatctatccaaaaagatcaagatcaatatacacaccatcaggttcttgttctagttagtacatagctattacctcacatattcaaaaggggagaaaaagtcagtgcccaactaaaattctaggacccaagtaataatgccaacagaaagaattgcgattgtcatacttcatcatgcataaacaaaaagaaagacaagtccttgataaagcaaagagaaaacctaaccgaactaattaatcgattgaaatagtaggataagagaaaaaggagcttactcaaagacgacaataacctggcacaagttttctaccgcttaattactcgccttccctttcatgatattgtttgatttattgatgctaacatcacacaatcaaatttaagcgatattaataaggaaaaaaagggacggctaatttaaagtgacactcttccaaacctacctgctttagagcaatgcaaccaaataataaattgctatgaagaacctaatctagctcaaaatattggaagcacacaaaaccccccctaaagatcctgcatatccaaatccagcagattttgagtgcatt

SEQ ID NO: 58613 - DNA, 3689 bp, Oryza sativa
ccccaaccgggagtaaatatcttttcccgctatttcgaaattctttttaaacccggttagggttaagaaccgggactaaagattatagcactgcatatgattttcgcttacatatgtgtttataaaatagaagttaatgcattatacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgagagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctatttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgtgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccc

SEQ ID NO: 58614 - DNA, 1742 bp, Oryza sativa
aaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaataagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttc

SEQ ID NO: 58615 - DNA, 9570 bp, Oryza sativa
tcactgtaatggatgaacagtccagatagccgatatataatattttgacagtggtacatgctgtcatgcagaagtgctgacaaaattcagatccattttgaggtccactcccttcgtcccacaaaaaatcaacctagtactagatgtgacatatcctactattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtctttgtagcgtcccagcataagttcagttacttgtgtcattagattaagaggtaaacatatttaattgagaagaaaataatttgcactctttagaccagcctccacaaacgaacaggatccgccgcactctctagaccacggcactactcagcgttctttctcatttttaaagaccctgtcagcttcattcattttttttatgaagatatccttagcattattagagctttatccatgctgtgtggtacacagaaaatctctgaaaattatatggttctctactaaaacgaccatattctatctttggaatttcgatcgaatttaaggagccgagcacacgcgtgtaaatataaagcttttactagtatttttctgctttgagaagaagagcaatttagttgcacgtccaactcttcctgtaggcaggcataatgtagccgttgaaattaaatccctgacgaggatagttactgattaattattggtgacagcggtagttaactactcaaaccgtggtagtggagacagcagtgtactctatttaccagcaatttaacactatgtaatattgttcttcctttcattgagcagtttgaaacagatcatttgatcagattatttatactaaattatctacacgattatatacataaattaactattataataaataaacttaacaaatagcttaaatcaataaatctaagcaatcgatagaattttttatagaaaatatataattttaaagacttaaaacaaacaatcagcaataataatgttttattttgagatggtagatgacgacagaatcacgaaaaagacgtatcaatgaatttaagcaatcaatatttttttagaaaatatataatttgaaacaaataatgggggacaataatgttttatgttgagatagcaggtgatgacagaatcacgaaaaagagaggctaccgtggcttatctctgtgggccccattggtcagtaggatattagggagacatgggcccacgcgtcatcctcacgggagcttcttgtcttctctttacaagagaatagagaaagaagacgaccacgccaccaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggtgactgcatctcgttcttctcttctactcatctccctcttcctcttcctctccccgcgcttgcttccaattcgatctctctctctctctcactcacgcgtcgcctcgtacgggtttcggcggcttggaattgaaacctacgagctgctagtacgttagatcgtgattcgtttcgtgattatctcgcaaagcagaacgcttacgcgcttcacgccttcgcctggaggattgagatgtaaagtttgcacgcccgcgatctggtgctcgtcaaacactggatttgttgcgccatctccctggagatgtctccaatttacatgcttcctattggttttcaaagttaggaatccgaggcgtgtgcatcgagctggatgctggccatggccaacgattattattgttgttttttgtattgaaatctcgaggcagtttaggcaaactatagattccgtcagaaatctgtccccatcctttactgctccgtttagagatccttggaatattcgctctccctcatgcttgtgcaaatttgtaatgcatccactaggttgctcagtacgtggattgagaaacattgtccactgctccgtcgttgctaagccaaaaggtttaatctcaacctagagaattattacaacctatctagatttaatctgcactgtctcccatgcatttctttagcacgcacaagtgacaaaatttgacctgtttctaaattgatataagagtctccgtccgcatgtccaagtttatcgcactcctttttagattttctacttaccttttgtacctcttttctaatatatagttttcttctgtacttctgttgtgtcatctgtgagaattgtctcattctgccatttatctatataggttgaggaggaactggagcgtgccagggtaacaatctcagatagtgacgtggctgcatttctcccaagcaagcggaatggtatgctatgatttatctcaccccccatgcccgtctcggggaaatataactgttatttatggaattcacttctccttgaaatttagggaagttcctcaagacctttgttggccctgtaaatgtgcgggtggcgagaaaagaagataagctcagagtgaaggacgagtacaacaactacagggtagattttagatgcttcttcgataatttttttttagaaagcttatgcatttactttggatatgatttcttggaccaatttaataaagctatctgtactttttattacttttattttgatgacttaagcattctaaatttccaatgattactccaattggtgtattctttaaattttgatctgtgataagaatcactattgaagagaactactaccattttctacaaaaatctaagtaaatttcagattatcaaggtcaacgagtatggtgtgtattcaatctcagacagcatgctgataaaaccttgaacctgttttgtatgtcatatggtttaattagtaaatacgggaaacatgcaattctggactaatactctagaaatcatgttgaaaggttatgtaagtgttccttttcatgtcgaattcaagcagtcctttctaaattgaacatagtggcttaactggtagagtatacttggtataattttcgctactataaatttttatgtcatgcctgacagtattgatggtttcatttatttgcaggatagggctgcctatatgtttctattgttcccatccattctcctcctacttagatggtggatatgggatggatgccttccagccttggcagttcagatgtaccaggtatttagtgccgtgcagtgattgaccctgaatatattttctctatgtatgactttgctgtccagcagaaacgatctaaagtttatttgttccacttaacaggcttggctactattcctttacacaagttttgctctgcgggagaatgtgttgattgtaaatggaagtgatattcgtccttggtatgtgtctgaatttcattgcttacagaaactgtcaactgcagcactcaacaattttatggcaaatacccatttttaatgcacggacagacaaaagtgcttgatttttttactatatgcgacttataatttgttggtatgggaaagatcttatatcaaaacatcttttaatgatattcgtaaaacccatgtttcgtttgttcacttaatctagcaaaatcaattcctttcttagaatgcattatcatcttttcaggtggatataccaccactatttagcaatgctaatggctctcgttagccttacatgggagataaaaggacagcctgattgttccagcaagcaggtaaatgatcatttttcagagaaaactagcactcactttgtcatcaaaccttcaaatttttggaacgctgaactcagacactatggctttcttttcagaggggggtacaacttttcctgcggtgggcaatcatgcaaggaattgcaatgcatctacagaataggtaccagcgtcaaagattgcgcacccggatagctctaggaaaggtaaggttctgtggttcacgtcttgcttcaagacagtactcaacaacatattcttttagtgccaagtgaaggtgtacaacatgttccaataataagattcaaatgagtatcatcttcaaatgatatgtatacaatgcagatgcttatcaaaagcaatttaatgcactaatttgcttgatgtttgttgatatttgcatatcagctaagagttcggaatatcactgaaactaatttagagaagatgctctggtcttttaatcaaactaagtcttataggcaatggttgttcatacagctcaatagactgttgaaatgatgctgtatattgtatcatctatgtacctttctcaagttttatcggtgttgttatttattctgtttcatatttaattgcatgcaggctaaaagaatggatgttgttgctggagaaacagctggtgtggaagggcagctcttgctactttacccggtccttttcacattacaggtatgtgtaaatgtgtcttgtgagctgaaagcatggcagatccaagttgttagtaattgtagccccccacccagaatatgttgtctcacgttgttggttcttgatattttagtcacttgtttcttttccttgatgaagtttgcttccgatttctggatgttagcacaaagatgattaattaaccattatatatatcttccatattctgcactaatgcgcttaatcttggatgctatgtgttgtcaggttttcgaaggatatgttggagtattacttcttaagacggctttgcacgggcttgcatcggaatggcaggcaagaattatcaactatgtaatgtttgcagttgatagttaatcagatcttcatgagacttaggctgagtttgtttcttagagttcccaattccccttattttccgcgtgcacgctcttcaaactattaaactgtgtttttttacaaaaaaaattctataggaaagttgctttaaaaaacaaattaatccatttttcacgtttttttagctaatactccctccggttctatattaattgacgttttgaacaatgttgaggtcaaacttttataactttgaccatcaataactttaaaaatatttagtttaaagaaactagaacaatatatataaatttgtctttcaaagcactataataaaagtaaacatgcatttatttattgtatatattataatagaaaaactagcatggtggcccgcgcagattgcgcggctagcatcattatattttctatcatataatagcatatatgttttctcattatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacgtgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatactctacttctaatattccttatttttaatttcaaatttctattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttcccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacga

SEQ ID NO: 58616 - DNA, 24350 bp, Oryza sativa
ctgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccctggccgaaccggcaaaggggggcctgcgcggtctctcggtgaggagccccacgctccgtcatcaggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtctggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtaacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgatgacgagggtcatgtcctcgccgtcgagggcgcttcgcgggccacccgaaaggggaggcctgcaggaggcaaaaagaacgaggccggcgctcccaacagggagcacccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttagatcacatcgacctaccggtcaccttcggtggatccgccaacttccgcacggagcgggtgaacttcgatgtggcggacctcagtctgccctacaacgcggtcctggggaggcccgcgttggtgaagttcatggcggtggtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggtgtgcgaccttttgtgttttctagatgcatactctggttaccattagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattaaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacagttctcatttcacgcttccccaccctgtgccgacttggcccgggagagagcagggaggagaggctcccgagccgaacggtgacccaaggcccccgacgaccggagttggccctctgcccacttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttctaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgtcgcctcctggtgttaggtgactcccagctggtcgttaaccaagtctgtaaggagtaccggtgctctgacccgcagatggacgcctacgtgcgccaagtacggcgtatggagcaccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctgaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgtggcgctaccatcagcgccatgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaagtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgcctcgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactatcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtacgccaccagcgttgcttcccggatggtgacggcggcctcgcggtccgccagatccctctccacgacgtaggcgcgctcttccagcgccatggcgcgcgcctcaagggcctcttctcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctctgccagcaccttcttacgagtttcaagctccgagacgtgccggcggtgagccttatggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttctagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggcacctcgcttctcgctcccactatttcgccccctcgtttctcgcgcccacgcttccactaatcccattcgcccgcttgcggcgcatgaggtgggtatgcggttgtggcagtcgagatagatcatatcgtgcgcgcgttaattacgctcgccgaccgaagcgacgttaccatatcttcagacgaaacgaatcgccatgtccagatttgtgtgctactcaagtaatgtggcagtcttgaagagaccgctcattgttgacagccgagttaccattgccgatgtgcgtggtttgtgaccgttgagtttctgcccaattgtggagaccggtcccacctgtcaccaggtcttaggagtggcgtcatgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcaaacagccacgattccacgtcgcacctgctcccggcgaaagtggaggtagttgtgggccgtctcatcagaaggtgactcggacggcaactatacaaatctccgtccatttatgaaaagggggggggggggtaagtccccacaaaaaagagagaaatggtgcatgtggtatccccttaagatataaaaggaggaccttgcccacagagaggggggactggacttttccagattagaaacccagaacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatctccaaaactacttcgtgaataaattccaaatatcaaaaccaataatcacatataccaattgttcatcatagaataagaatcaaaacacacattgatcttacagctaagtccaagctatccttggcctccagtttctttaatggataacaatgtcatcttttggcatcgcatccttcacggaggcatcgtttttttgagtcttctctatgtggtgttgttgtagtaggctcgacgatgattggctggtttagtgcttgtgtgtgtatggttggcgtgtggttttgagatgtgcactctgatgcacatcctttctttgcactggtggagaaaccatctttggtcggtcgaccaaattccacaatagtcccgattgcaataaaaaccaagactaaagattatctttagtcccggttgaaaaggttagagctactttttgatctttagtcccggttggttgactaaagatcatttttagtgccggttcaaaaaaggataggtgatatcagacccctctaatatctttagtcccggttggtaacaccaaccgggaaaaaagatcggcatgcacggagagatcgaggcgtacgcgtgactcggatcgagataaatatctcctcctctcctcacactctatctattcttctcctctcctccgatccccttctcctcgccatcttacgcgccgaggatcctctccttctctcctctcccccactcatcctctcctcctcccctcccctcccctccggcgggtggcgacggaagcagcagcgagatgaaggccgaccggtggcggcccggcgtgaggtggcgggatgagaggctggccggcaccggccgggcgcggggcggtggaatggagtccggccggtggcggcgggatgggaggccggccgggcaaggggcagtaggatggaggccggcctcgcactcccctcccgggcccagatctgtggatgattttttcttttcttttttgatgatttgtggatgttgatttctgaatgttgatttgtgaatgtgtttgcgaatgtttatgtgaatggttttgtgaatgtatatgttgtgaatgaatctgtgtgaatgtatttgtgatgttgtgaatgaatatgtttactgtgaatgaatcgatatgaatgaaggaaaaaactgaaaaaaaaataaaagagaaagaaccgaaggaggaaaaaaagtctttagtcccggttggtaagatcaaccgggactaaagatgcctgcgtcagtcacgtggctcaaccatctttagtcccggttggtaacaccaactaggactaaagatagatttttagtcccagttatttcacccgggactaaagatgggtatttttagtcccgtattcgtagtcccggttgtataaccgagactatatgggggttcccaaccgggagtaaagcccctttctccaccagtgttgacatcggacttttgatgaaaaacttttttataaacattttatcttatatcttaacaacattcggattacctctctcagtcatcgtggaaaaaaaaactgtccaagaagagcaatgcatatacagacttacagtacgtgtatgtagctggctagcgagtgcatactagctagtgatatcatctcagcgtattctgtttctctgtcctatgatcgatggattaattagctcattatatattgtgcaaactgcaagtaataactggtgggaaaatgttgattcagctgcaagtcatgcaggtatataacacatggatgaattaattaatgaatattaatgtaacgctattatagttgctagatggatatatatcactgtactagatataaatacatggatagaacacgatggggcatgtactgctgcttgcgttcaatctagctagatagatctgtgtttgtttctttagtagtactatatattttctggcctgcgcagcctcgacgatatatcatgcatctatatatgcatgggtaattaatgcctctagaaattaatcaaagcacattgtcgtgcatataagtatatatatatatatcgcatgcattctgtgtgcgtgtagtacgtaagtatactgtagttggtaaccactgccttaattttgctagcttgtctcgacaatttaattaaatgcctgatgaccaatgcaggtcgatcagtcatctctatatatagagtattatatacatgcatgtacgcagcaagtacacctgatgatgcaaattgagccgaccaaatttgcatgcatgcatatatatacatgtatggacttgatgcataattgattcaatataagtattagctacgacaattagcaagtcagtttttatgcatatatatgagtatagttttctcgaacagctagcgtatagtgtgcaaataccatgtatgatgtatgtaatgtgtacaaatgcaccgtatgcagataaatgtgtacgtacacatttatatcaataatgtatatacgtgttgtatatgtatctggaaaaaaagagagggggaaatggatggaaaggaaaagaaaaggaaggagtggggggcagatggagaggacgacggcatgcacaagtgacaaaaattgctacagtgaggaggatcgatactattgtgggtggggcccagtgggcttgaaggtgagtttggcccaccccaggcccaccgacagccctgacccgttactgtcaatcccccacccgggcccactgtacgtcaccccatccctcctctgcactgcattgctagcctaattcactgttcattgtcattttgtttgctcattcctatacccccgatctcgatccattttcgatcgatgtcgatggtcatatacaaatttcgcctcgactccatttcaattattaataattactccatacgttttcaaaacaaaatggcgtagctagttcgtttcaaaacagtaattcgttcacatatgcctgtgccctcctatgtactatcacacaaaccatgcaagttaacttgcgttcaatacaatcatacgttgccccgccggcaacctggcctttttcctttggagctacgctgtcggatggattattagtttatcctaaagccgcattagtatagctatatattgaattgaagtctacccatgttgaccttgcttatttttcaattatcatttcatataacagagttaattatacaaaaaagtgttatatatggagataggttgatcctgtccttcgagactaatctacgcgacactatgggctatacagccgtctacgtataactgtatatggagcccgtctcaaattatcacactagtacattttagccatgtgatggtttcttaggcagtactcccatccccccgtctcgaaacatatattagtagaatgtgttctatttatctctattcagatttcgttcttatattataagatgatgaagggaatacgttgtttgctttaccatagtaacttgctttctgcactttcatggacgcgtctcgtgtccacatatagtttacctaatttaactttaagcgttatatttgtgaccatcaattttattattgcacttttgtaaaatatataccagcttagacaattaaaaattgatacatgatgcatacgtaacacacgtacacgacttaattataaaatggttttcactggtcttcggttgctgacggcgccgcaaattgccagctaacttaaacccatttttacctctaatgaataccgattttgtagtagtgatgtgtgtcaggatcgatacacatatatacatggatgaaagtagtagatatattaatatacccgtgatccgatatttcaggatcgatcgagcgaggaagggatcggaagaagctatggggaggaggacgctcacgcatggacctgctggaccgtccggagtccggacaataataaaatcaagtgtaggagtacatgctgctccaccccgaccattgtcctcctgcattggacagtagcaatacattgccacattgcactgctgtcccctcctcccctctatctctatgctcttgctagctgtcccagctacttctcccgttttaaaatatagatatatttaaagttttagccaactgatatggaaaaataaacactcgagataacaaagtagatgaaaagttaagagatgattgttatcgaatgtaataagaaattaaacgaagagagatttattattgtatgaatactaagaatgtttttattttaaaataggagtatgtcgcgtgcaataggcaatgttggctagctacctattgcagcttagggttactttgaatcgtacgaataggaaaaggaaggaatataaaaacacatgatttttaatagtaatgtaagtggaaaatataggaaaaacataggaatttgattggaccgcgggaaaaattgtaggaatcggatgagatagatagatcgactcaaaggaaagattctcaaaaggttgaaactattgctaaatttttttcaaaatctttatagtattgtccattccatataaaatttatataaaatttttctatatgattaaaattctctaaaatttttatgtgtttcctttaaatcaaagtacgccaaatgtctccaaacaaaaaccatagctggcccctacgcacgcatggacgcacgtacattggcagatttggatcactagctagctagtgtttttcttttctttttcgtttacactagttttgattaattccctgctacatactcgtatatgtacgccgttaattaattaattaattgccattcgtcccgacatgtacaggttaataaatccatttgcacagtattttatctactgttttttaaatcttcatcgcatagtgtatagtactagctactctacatgtgttcgaaaagtttcagtgcacacagtacctatcgaaattacgttactgtggtagttacgtcacctatcgaatatatgtacttcgtgccatttactacctctaccttcattttctaatatataattttgttaaccttttgacatatatttaacattttattttttttccacggacatgaacaaatatataagtattcattagtaaagtcgtatcaaaataagtaacaattacatatttttaataaggttaatgatcaaaaataccttaaaaatcaacatcatatttttttaataatgagaagaatttcgttagaaatgaaattacacctaacttctacatcgaccagagaaactcacaacctaggacaaaagaaaccaaagccaaacataaacatattatgttatcttataccggtagaatcctaagcatctagtaaaaaaacaacacctctaagaaggtcctaacatttgtgtgccattgccatcggaacaagacgatattttcatccaaagcccgagatgacaccttcaataaaaaaataacaaacaagcattgacattgaatatagataaactagataagagttttcatcccggagtcattgtcactactttgtgccaccgtctggatgaaatgagcatgatctacgatgtgcagccaatatggacaaagtgcaagcctcctctacccaccaccaccgagctaatggaagaagtcaagtcatcgtcaagccgaaatcttggaaaaaggaaaaactacggacgaatatatcacagtgtcttgcctgatatattatgagaatggaactcgttggctcaactagatgggagggtgccacaacgcacttcaaatctcccttgtttgatctcgcttggattgcaaaccatacctggtgtcgatctggcacgtcgtggtgttgggcagagaagaaaatcccatcacaactaccgccggcggttgcagtggcgaagacggtgcataggtccaatggtgtcgtagaagcagaagctcactgtcgaggccatccccgacacaccccatcgtcacaaccgcgtcgaagttgccccgtgcccatgcagccatggtagctagcccggcaacgacgagataccacccggacgccatggccccctggatggatggggtggcggcgctggtgaaggttgatgtttgtcgccctcaggtatcatgtggagcggattactagtttatttgtgatatagtataaaccgtataacaaagttttaaatggtgcaagatgttttaaagaaaaatgatgctgccccatgcgtccatcgaggttagttagtacaattaggcattctttaaaaaaagtacaattaggcgaatgatgtctgctattatgtgtgtacgctattactccctttgtccctaaatatttgacgccattgacttttttaaacatattagaccgttcgtcttattcaaaaaatttaagtaattattaattcttttcctatcatttgatttattgttaaatatacttttatatatacatatagttttacatatttcacaaaagtttttgaataagacgaatggtcaaacatatttaaaaaaagttaacggcgtgaaatatttagggacggagggagtattatatcagtgagcagcgaaggcatcatacaagacactgcttgagcgtttcatgtacacacaaaatgcattgttaattttatttgtctgtacgtactttgtttgtagctacaaagtatcttgcataatgttcggattaatgtggtctgaatttaattgtgaattttgaacaggggaaggaagtgccgtcccgtgtgttaaattactagatgaatccgaccacgaccatttcatagatttaatttgatttgagctatatagcactgctgcaacggtttgcacggatgtgtcccactgacgcaattaaacacacaccttgctgttagcagtagatcgattcgaccatgcatagctccaaaaccaattttgtgttgaataatataaggtcagatgaaattaatatagttagctggaaactgatcaatccaatatttcgtgtcatcccggccgtcggcggcgagtccgtgtgaaggccaccgccaccagctagcagcctctgctctgccgccgacgaccaccaacgttgtttatttcagtacgacggaattaaccaacattcatgcatgcatggtttatttaaaccgattttctggaggagattaccgcccggacgtccgatgtaactcaaaatatcgaactctacccactggtggagaaaccctttgtagtcccggttcgtaacccccctttagtcccggtttccaaaccgggagtaccaatccgggactaaagatcgctatctttagtcccggatgaaataaccgggagtaaagatcaatctttagtcccggttggtgttaccaaccgggactaaagatagagctgaccttttttttttttgcatgcccctgttgctgcatggtttatatatatatatatataccatgcatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatatgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatcaagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattccccttaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaaactctcatgatctccgcgtgcccttgttcttcgccagtacaccgtactgataggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatataaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctagcagtcgcaccagttccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatatatatatatatatatatatatacatgtatatatatatatacatgtatatatatatatatatacatgtatatatatatatacatgtgtatatatatatatatatatattgcattttacgttaacgttcgtcctcgttcgttcgctcgttcacgttccctagctcgttcacgttcgttcgatcgttctcgttctcgttcacgttgtcgtggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcagcggtggcattgcgcgcgcggcggcgaaggcggcggcggcgtggcgacggcggcggcggcgtggcgttggcatgcggcggcggcattgcgcggcgtcgaaggcggcggcgtcaaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggtt

SEQ ID NO: 58617 - DNA, 3229 bp, Oryza sativa
gtccccgtagtacttgttctcaatttttcttatgcatcagtggatgtgtttttttcagctgagtgcaatttggtgcgacagctgtatgtttttatttgtttaatgaaattgtaagatagcttgcacacatgcgcgtccatcttttttattacgaatatttatacttattctattgtaaacatgttttttttaaaaaaatttatttgggattaccattgtggcgtataacaatgtataacttgtaaactaaaattacttaaaaacaccgagttttgaatttataagaaaatatcgtgtcacgatgaagttgctacctatgaaactatataacatttgtacataagtgtgtttttgtaagtatcttacttttggaatttctaaattctactaagtaacatttttttcatactatatatgtctttgtgaattttacaatattttatttgaagatattatctattaaaaatatagataatatgaccgcatcatctaattaaatgaggtggatatgttgaagtattgatttaattatcaggatatagttttgcaataggaaactacagttgtcctatctcttagcgattgtcttcctgttggctatctcttaacgtggcttgtggctatggctctctatggctcgtgattgtatgccctcttcttctaggaagaagacgagagaaagaaggaagaagatggaaaataaaggatattgatggaaaacgtgaagacagtggcacggtccaattttgtaaaattttagtgatacgactattaatagacgaattttaatgtcatttatttgaataggcaaatttgtaaaggcatggatccaattaagctaattttgtttattatttgactggttgaggtgggaatttcttggtttcgctgtttcttcgtgattcttttccttcccaaaagttttctccttttttttctccatacgaaccttttttttttggtaaaatctaaatcaagaggcatcttgttttaatgctaacgagaggccctaacaatataccttcactatagtactagctagtccaacaagcaagtagaaaaaaatatattcctatcacatgtgcttcaaataaaattctcttaaaatacttatccgatctatgatccaattacaccgttgtgttcataaaagttaaagttttataacaagatctcacatgattatgttttaatgaaaaaaatataaattactcttataatataccttaattaattttaaatttcactaaactacttcttcgacatataaaagtaaattcaataaagcataaaagtaattacatatattatattatagaagtaacttaaaataataatttacatatattatagaagtaacttaaaaaaaagaaagtaactttgtgatgatattaaaagtaaatccgttatggagataaaaacatgagtttatctagcaattaaatttaattagcacaaattacggaattgaccaaaaatgataataaaataaacaatatattcacaacatcatgaatgtataagaagtaatttaatcaaatcgaaaagtaatttatatatatgataaaagtaacttatttatataataaaaatattttacaatatatatatatatatatatatttatttcttttatcaaaatatagtcatgtaagatcttgttgtacaaatttaattgcaacaaacacaatggtgtaatcggattatggatagataagtaatttaaaagaaaaatctataagaagaaaaaaaaggcatgtattattcggtttactagtaggcaaccagatctaaagatgagtctctggttaagacaatatagggtgcggtctctgtgtagttacatctttttattgtttgttttttttagaagatccatttttcctgctctaattttggtaattgcgcttgactttccttttaatgatcaagttgttaataacggcggcaataatcagggttgcatccatttgagccggtagagagccggctattctttttcttttaccatggaaaactggcacatctttttaggtgttagttttaaaaacctagtacacctttgtgaaatatgtctctaaattggtgccagttgagaagaagttcccatccggtatctatgggtactctgtagcagtgatgtcatgtttcccttatcaaatgctaatgttgttacatatattgacaattatttggttaaaactgccagtttgttacaaatttatagtaaggtatttcacaaaatttgttatgaaacaatagggtgaactcatccatataaaaggatggatcgcaaccgaaggcatccacgcctcttccctaggcgctccttggcaacggacgcgtctacagttgccacctcttccccctctataaattgtaccgcattgatcaataaaggaccgcattgatcaataaaggacatccactcattcgctctattgtggtcaattctctctctcgctcaatcaatcttacccactttcaacatgttatcagcacttagctctaagcgaagagaagaaatccgattgctttttatctcaagaaaaagcgaagaacagaagaaactaaggaagcgcataaggtatgtctaccttgatttcatcctcgatgccgttctcggcctccctcgccgagaccgcacccatcgccttcgccacctcctctgtcgattcgaggagtcgccaccatcgccatgccgggcaccattctagggttggtggccgccgccaccatcctcggcgcagcatttgccgtcgctgctacacctccgactccaccaccacaagcgcccgccatggcaccggcgccccgccgcgtccaggtccaggcaccatggatggattgcggtggtgacacccgccggcgagcagtgctccctcccactggagatggagtcgccaccggcaccgttcgtcgccgctccgccatcaccttcacctcgtcggagctgctcccccgatcccgcgccgccggggtttcggggattggaactctcaccacgcgcacggggtagccggccttctaccctccatcatagtctcgccaccatgctggtgaagccgccgcttgccacccagcctccccgctactttccgcccgcgccattcctcacgactccccgagttgcacgctctcaaatggagtggggagaacggcgtccgaacccgaccggactcttactccgatgaggagagggggctgtcggcggacgacgggggctgcg

SEQ ID NO: 58618 - DNA, 9375 bp, Oryza sativa
agggggtgggggcggggcccccggcggcgcagacgtggcccttcttggggaggccgcagcggccgcagttgtagctgccacgcgtcttggggcgcggcggaggcggcggcttgggcagcgacgccatgggcgcgccccccactggatttagggtttgctcgcgcggctgttgttgttggaggtgggggatggatggatggatgggtggggaggggaaatagttagcagctcgggaggagggcgggagattggggacggattggcgccatttttcgggtcgcgagtgacccaccgcccgccacgacgccacacgcgcctctacctctcgctctcgacagccagtcgcagtgaaaaataaaaggaaaatttaaaaaaaatggatgttaggttttctatggctttgggaacggggaattgcctttcatgtttaaatactttctttttttttcttcttttaccactggagtgcctggaggaaattcccatcactttcctatctttttatcgccctccttcagacaatcgcttttacactcctcgacttaccctgactcatttttcccatgtgctcttatcaaactgttaaatgatatgttttttataaaaatgttttaaaaaacatattaattcattttttaaatacaatattaacagatagttaatattcaaataatcatatgctaatggatcatttcattctacatatcttttcgatcttctcttttctctcctcccaaacacaactatcaagataaaacttgaattttacatttagttttaagttaattttgagtttttttttcatcgtagtttatttctagcattttcttttaaattattaagaatgtatataaatttttatttaaaatttattttttggttggtgataaataataataataagcaaaaacgatgattgtgtaaatttcttctttagtgaacttttaacttcctagttcctactagaaaatgttgttcgtttccaaaaatttaaaattgttgtgtgattaaaaaaatgatgttaggacactcccaattcatcgagtctatagatataattatctatttatttcaccacgcatatatagtttccacattagtgtctttggacgagaaattaaacaactattttccactcacaaacaagtataggaggatcagctatatcattttagtcaatgtgtccatctgtgtgtactatcaacttcgaataaatagttatttaggtagtcgtcccttgacaacattctaagttgatgtgatcggatcagtgaaaaagctgcattccattaagtagaacaggcacatgcatccaatctatccatggatcatcaaggcgggttgtctatcgagggggattgctccccaagtgtatcgtcatcatcgacatttcctcattatgtttactcaccctcccacaactacctatttgtgtaatagaaagcttcaccaaggtaggagatgagtagtgggatgtcatctagtagagattggggtggaagtacgggagattagggtagggatttagcaaggagatagactagcggtgcgcaaaatcgttgagggagagaaagtgtggacaggagaatggagttttcacaggaataggcaagcgaggaagaacattagcaattcccacgcgagggaggcaccacttcgagcacacgacgaaggcgcgagatacgagcgcgatgaataatggcgggaatggggcgacgtgcagggatgagagatcgagatgggtgttgagaaaggaagtagacaatacccagccaagtaagggatctagactctaccttgggagctataaggatggaggaaactacaggcggtcaaatgttgagttgaccatcggtgaaacatcgagttatacatgataaaaaatcagctattgaacatttagaattttaatgaaatatggtgaaaacacacattaaacatgtcgccatcacgtatgaaacattgagtttcaattgcaacatatgtttttctttcagcagaatataatcatgtgttatcttgttataaatattagataagtagtttaggagaaaaataattttgaagatctatacaagcatggagtagaaacagaataagtagtatgctagattgctaggagagagaataggggcatgggcgcccaatactttaccgaccattggtgaaacattaagttattaagttatacatggcaaaaaaaataaactattgaaatatatttttatgaaaaacaatgaaaacacacattaaaatatgccacaaaaccgtgtatgtaaaagtgcacctaggcccccattggggttttggacgattgatgacaaaatcgtaagggaactaagtgtgcataaagtgtattgaacatgtgttatttccaaaatgaaaagaaaagaaattgcaatggtaacccttacaaaagataaggaaacgacactgtatagaatttgacatttttgtttacaatgcatgcatgggtgatgcttggagctgccgaggtgccgtctgtccatggagcatgaaccatcataattttatcatgttccttttttttcagagtctaggcatgccgcgctatcaagaggggtgtgtgcaatgcgagacaatgatcaaaagtgttcaaaaatacattcttaattgttgtgttgaaaatgtcaaagtcccacacccttgaatccttgttttgggctttaactggtaacctggagtacccgaggccccgagcattaccatgagtttcctggtaggcttttcgtgtgcctagagctcctatttcgaaggccccgaccttgacttggggccatctttcttgtagtacgtccacaagactctgggagttatctcggagccacccataagccacttcgctgcccggagcctcgatcccggggacctcgggctagtctgagccacactcagcttgtagtcccggagaatctaggtggatatcccaaagactccagacaacctcctcaggtgtctagaggttgttttccaggatctccgagatccacttcacggccacagcagcaacacttggaggctccgaggctcaagcctaaatacttcgagatcgggctgtcagcctctcaacggctagtggttggttggtgggggtaattatacccccccggcaaaccaccaccctctccccctctagctccccgtttgtgttctctctctcttggtgctctccccctctccatctctcttagctttgaggcacatctttgtgggattttggtggcctgagtgcttgtgagctagagttcacccttgagcacttgagatcggccttgggccttgcacgtgcttgttactcttggagccttgggccttgggcctggcccgagccaatcgccggtttcctggtcaccgggaggcgccttccagcaagggtcgccatcgtggagtccgcagtcgctaaaggcggggagtcaccggacgctttcggtgtggagtcaccggtcgccggcagcagggatgcgcccggcgccgataggggatggcatgacgcccgggcgccccttctgtccgctgagtaggtctgggccgccggtaccgtaccgcgagcctccattgtcctacgaaccatcggtgctgtcccattgcaaacggaaggccggactcttcatatcgtggaagagctacctggggaggagattctatggttgctgtcctaagagggtaagttaacactaacccttgctgtaaattttagctattgatcagcaatctccttgttatctattgaataattgctattgatcagcaatctccttgttatctattgaataattgctattgatcagcaatttccttgttatctattgaataattgctattgatcagcaatcttagtaaattttagccaaagaaaaggagataaatctatttttggtaggcttgtaagatagatgagagctattattcaaatatgtgtggtaacttctcagtgatataacaattcaacttcaagtattttagctatcgattcttgtcaatttttgttgttcttttttttctaatatgttcatattttgtttgcatatagaatgagacaaggtgcgatttctttcggtggtacgaaccgcaatttgatgaacaaggtggatttcttggtgactgagcttgaagaaaaaaaaagattaaggaagaaggtattcaaatccgtttgggtgagctgataaatgacctcaattttaaatgaaggatgttcagccttagagatgtggagatgttgttgccaatctctgctattcgaaaatgcttttgcaccgctgctagttatcattcttcactatcttagtttcagtcccagttagtttctgcagtcccagtttgtgtttgaactatatcgttggttagtctctatgtgttaaaactccatctgtaataactcttgtgtcaaccttatcatggtcacgccatgttgttggcttcagtgctatccaatgccggcttcttacatgatgttactgatgttttgcactcaaatgcgatgtttcaataactgccgctaggattaaattgaagttgtatgaaaattggcatttcgtgcctaaatggaaaacatggcagtaaatgggaccaaagatactagaagcggaggatgcaagaatggatgtttgatgctaaaatggaaattgagctgatgtctctgccactaaaaaagaaagtaccaaaatagaagattaccaaaactggagcttgtgacggtgaaatggagcatatggctctctaatggagcagatcagggaaatggagcaacatcagggaaatggagcatgtcatggtgaaatggagcacctcagggaaatgcagcaatagcagtgaaatgcagcacatcagtgaaatgcatgtcacatgctccatttgcctcacttgctccatttcagcagcatatgctccatttgcctgacgtgctcatcaggcgtgaaggggttgcttggggcgtgacttgttccacaccggaccacctccttctggccacaacggttggcaaggctaaagagctgggccacgatcagagccatcttctccagcatgcgcttgttgcaaacgcctgacctaaatgcgtgtatgacaacatggtgggcgatgtgcgggatggtgttgcagacctggctgaatcgttggagaaatggcacaaggtctcatccatgccctagcggagggcgttcaagtccacttccattccgggaagaggaaacgttccctgaaagttcgccatgaattggtggcgaagatcctcccaggagtagattgagctctcgaggaggttcatcatctgggaactcccctgggccttgagagcgatggggaagtagttcgccatcaccttctcatcgctgtcggctgcctggatggcggtgataatatctggaggtactccgtcaggtcgacggggccatcatacttctcaagcaggttgggctgaaacttggccggccattgaaccagctggaggctcggagaaagggttaggcagcccgagccacacactgcttcagtggaagggagcattggggttgcccgacggccttcctctagatggtcggggaatgcttctcccgttggctaatggagggagagcgctgatagtcaaaaaggcgcagctacccccacgtgggtggcacgctgcataggcaccctcacgctccccatgttatcgacgagatgtgtagaagacgtgcgcatactaacattaatgtgggggagtggttggagcaactccctcgccttgtcagctttccctcgatgtggctacgttcctcaaagggaaacaacttacatcggagatggttgggcttcgcctccggatccatcgcgctcgcaatgggcacactcgggccccctctcgaggcatgaagagtgcttgggccgctgcccgagtcccaaagacgattgggcttcgcctttggattcatcacgcttagggcaccctacgtactcggggcagcatcgggcacccaagccgttcccattgctagatatatattgttcatcgaatttggacgagcttctcgaaattatcaaagatgaaagagttcatgatgtcacaacttacaagggaggcccttgattgcttgtacttgtctcagtatcttgaagatgtagatcttatacgtcgtgatgtgtaccacagcgccctgatgacccgaggggaaaggaacccggttcccatttctttgacactatgtgacatgtggatagttagatggctaaataattactcacttaactcacattagtgatccatacgtgtattttgaaagtagagtgatctatatgacacatctaaacaagttggatgagcctgcatgtattttactctacaatatttattgcaaaatatataaaacattgtttaaatacggaggtatatcattcgtaagaaaggaatatcataaaccgaaggaagtagaagttaggagaaaaacattaccattgagaatcattgctcagtcactccaatatgcaccagtgatcaactcacatcaaaatattaagcaatccaaaatttcttttagttttttttctgcacatttatatcaacctttgtattattctgtcccaagcacaatgaactatgtgtaatttgggagacctgcacaaacataccatgaagagatggcagactttatcaatattcatgatagcagcaccacatttaaaagcaagaagaagctcaatggcactgaacattactatcgacaaagagtaataattggtaaaggcaacttacagaatagattgatatttcaatatagctagaatggtgaacaatcatagtgaggcttcatgtttgaaggtagacacaagatcaaggtgggtaactgggcataagtcaaacaccaagtcaccaacatttatcacccgcttttcattgatcaaaccattgcaatatttttgttttgtgcaagaaagaggaaagggcttcggcgtaggtgtatgagaaatcttcgacaattccaagttgggcgccaccagcgaggatgacaggcgatggagcggagtgagaatgcacgtagtggtgacaacgataggaggatgtgaccttcagagagagagagagagagaagatacatgcaacgatgttattagaggagcgaggaggcatcatcgctcagaggatggcatggcggctgggttagcgtagatgattttgcagtggcgggactcggcgcatcagctcgtggggtcagtgagttcactgaatgatccataggctcaatccgttatggatgtatgaagccattagttagaagaacccgacaactgcggaatgaatggggggggaattgtctatgcgtttcactggaaacatgtaagaaagaatgaaactcctccttttttatatcagtatctatactagtactacaaaagacaataatgatcagcccatgtacactaacttttgcttgttttacaaattagtgtatgatattatgcagtagaatgtctgttggaataaagtgaataacatatatttaaataaacatgtgcattttacccatagcaaaatatgggaattttgctaatagatatgaatgtacataatacgtaagtacatcaaattcgaagtactcctagatgtagtatatcggtcctaaaataactttatatttaatcatagtaacacaaattaagattttttttaaaaaaagctaaagtgttcttcatcaatgaaaaaaataggatcggtgggtggataagtaagagatattaaagagataaaactaatctatttacatatcaaagtaggtaaagagtaagaaatgaatatttgggacaaatcgtgtatatatgcttaaaaagtaaagttaatttagaacaccgaaaatagtacattcaatccaagtcgaacaaacaaacatatgatctggagaactctcttgagccctgtcaactttcccctccccttgctacagtagatcttccgttctccgcccctcccccaaaatacctgcatttcatcgaccgttggtgagggttggaggaggagtctagccacctcccatattagtatagtgtagctaggttgtagtatttcgtcaggttcttactatgcttttgggtatgtcccgtgtgatttctttttggcgaaggacccgggatgccgaagtggatggtggaggtgatggtttccagaggtggagctgtgagatgcgaaggtctgttaatgaattgagggatggagacatcttcttgtgctcgtgttagctacaggcgccatgtgaacgcggcgttggccttggagctttgggcggcattgctccgtgcggctgcggcgttgtccatgaagcttcgggcggcagtgctctgtgtagcagaggtggcctgagagctctgtgtagcggcgttgttctatgtggctgatggctatggagctctaggcggcagtgctttgtgcggcgcggcccacagcttccatggcttcgctgttgcctccgactgctacttttcggtaacggtgaagatcttccatggtgtctcctttctccaatctgagtatctcttcttcattggcagcttgctcctctcaatttgtcgcgtcctacttcagtttctgctggatttgagctcacagtgcttttacaaatcttcagcaatcctcagccttctgcaaagagaagttctattgcacccatctgattattcctgtgatgttggctacctgttctttggaatcttacttccttttgtttcaaaatagtagtatccatgcatagttcgagttgagcaaattatgctcctcagatctaatggaaaactccgtggaactaatttgttgagtccggtgacacctacatcaagatctacggctcagcaactaacctccaattggtgccatttccgtggtgacggccgtaggagctttccggtccgtcaagcggtgagcattccgtggtgacagccataagagctttctggttcgtcaagcggtgagcatgtaaatggaggcccaagaaactcaatcgatatgatactctactgctgtttagtctcttctggaagtttgctttcttagattggttagtctctaccctactaggatgtatcccgtaaactctatcttgggtaataaagttgtttaagttattaaaaaaaagagaacaaacgtacaaatcggttggttcacaccggcagagacacacacccatcaatcctcgcccgcatcttttggttgagctgtagaagaaacaccagagcagagcataccagtattgcacgtacaaaaccggccgggccggctgggtgggtcggagtggacacgtcggcgacggaaccggttccccctggggtcactgacatgtggtcccatcacactcatcatcggtcggggtcgtggacgcgggggggggggggggggtg

SEQ ID NO: 58619 - DNA, 3475 bp, Oryza sativa
taaatgcagcttagatatgcatacaaaaaaaaattgggaagcactctgagaagtataattaagctcagagcgatacaaaatatttatgcatatgtactattgaactaagttctataatggaagtgctcagaaataaggtgatagaaaggcaacaggatagtgcctactgcctagcacctggcaacaggcagcctaccaggttccatttgattggaaacattagagcagattactctatggttactgcaaatagtatcaagattaaaggaaccaaatactgcttaaagggaaactaggtgctaggcagggttgatacctagaaaataggcacccatggtttagaacagcatttgagcatctaagtgtaaccgtctccacaagcaaaaaaaaaaaaaaacatacaaacccattccctcagttgttcaatcataaatccatgacacatgcataaagggttagatggagtgaatattttccaggataccaatcaaactaatgctgttaaatttctagttgatcaggcacccttgccttacagcatggtttgcattaattgtatgtagagggggtttgcaccagacaccattgctctcccgacatccgtacaccacacaacacaacgaacaccaattaggcctttaatatttcatggtgtttaaagaaacaaaatacagtgtacttacacaagtggtcctaagcactaagtcctttactccacagcacgaagtacaatgccagaattcctccattgataactgtcggaacaacctgaaataaaacatgcaacctaaatgataaaacaaaaacaagaatctatagtggtagataacataatctcaataaaataaaaaatgtataaatcaacctgtgtgttgggcagaggccggcctttccaaggcttctgcaaagccaggaagatgactgaagcaggtacaaggcaactgaagatgaagccgaccattgaatccccactactagacaggtagttatacagggagtacacagaccaaattctagcaaagtttcccaaaatatgaataacttgcaacggtgttgacctgcccaatagaaaacattatagtttggttaacaaaaacgtgctattatactgaatgatatcacatatcttaagggtgctaagccaaatgaacatctgatatgagaaaaataattagggaaattgggtgttttcagatctgaaatgggtagaaaaaacaattgaattgagaagctagcaatcttgaaatatttgaccactctcattcatcaatgaaatttgaggaatttcatcatatgtcaatcacacacaattggcccaatttcaatatataacatcaggtaactcattatgtaccctttataccatttccattataaaacagttttgtgtgcttcattgaacaaggtaaaatgacacaactcagctacctcaaaactgacatttatctcaatggcatgtgttttcttatgaaactaaaattgaatgcagcaaaagtgccttcattcttttaatggcctccaaaaattatttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaggaagcggttagatgaaaagctcacctcgccgtgggcaccgagcgggaggtggaggcaccgccgccgccttccggtgcggcagaggcggagggcctcggcgacatcatcttcgaaggccccgcctcgccgctgccccctggtccgactccccggatcagctagctgctggcccctggtccgactcgccggatcagaccacggcgccgacgcccgacgcgtggagcggcggtaattaagccttcccgctgtgatgctgctcgactgcgcgaggcggcggcggcggcggcggcgggcggaggggcggcgctgggcttctccgatctggatcgatttttcttttcttttcttccccgctgttttgaagctcacgaaaaggaggcgatgcagaagactaggggggtgtttagatggggctaaaattttcttagtccatgtcacatcgaatgtttggacgctaatttaaagtattaaacatagactaatataaaacctaattttataaatgagagctaatccgcgagacgatttttttaagcctaattaattcataattatcaaaagtttactgtagcatcacattgtcaaaattatggcgtaattagactcaaaagattcgtctcgcaaattagtccaatgttatgaaatgggttttgtaattagtgtatgtttaatactctaaattagtgtccaaacatccgatgtgacagggacttggaataagtccctggaaaccaaacagcccctagaagaagaagaagaagagggtagctaccccacgggattccgttgcaaaacggcagtcacgggataaaattaatacagatcccttttccgaccaagccttgtctcctgcacacgattcccccaaccagaagtcgtgcgccgctccgagctccttcccccgatgagaacccggctcggtatcg

SEQ ID NO: 58620 - DNA, 19239 bp, Oryza sativa
  unsure (1)..(19239): unsure at all n locations
gccaccaccgtctccgagtgcctccacacctgtcagttcctcctcctcctccctcctaccttcctcccaccacgccgtccgtgttgaattcaattcaattgagctaggatccggtttctcccacgtccccgattcggcgccgtacgtggggatttcgccgtcgccgtggctcccgcgcgttgacgtgtcgcggccggccggggatttcgccttcatgggaggatatgccctcatgtcatgcctctgtgccttgctaggcgtgacccgatttccaacgtttcccgtgtgctagctacctgctccacttttctagtaacaccgtaacacgcactccaggaggggaatgccgtgttgtttcacgtaaatcattcacccgtctcatggatcgctgatagctctgccatttttcctttttttgattgagatagttaagcagctcagattcactaactgtcttactgaaagctcgggtgctccagcatggtaatctaccaagactgggatgagctcactattcatcttcgggagacaaggctggcctaaatatgctacttttatgtggccccaagcaaatgctagcgtctgtttaagattcgggagaatgctgcatgcatttccgggttgtcgatttggaaacattttgctcaagtaattaatgttaggctgtccattgtataaagcagagtgaaatgctacagtagcaacttaacaaccaacgtcattcaccaacgacacaagtagatcctgggttgaatgttgttagtaactagtagtaattcaaaatccagttgtgctgctacttgcattctttatgagataatttcggctctcaaatttatactttatcctcctaatctacatatgacatgccccaatatctttggtaaccgatagtatattttcagttggagttgaattcaggcagatgttacatatccgctattacgctattgccaacttattcgttccacttttaatcaattggaacagtgctgctagtgcacatctggtcagcatagaattcgccttttgatattttcagagttcatttggaagaactttcattgtttggcctctttttgggataactgtagttttattagtggttcttcggtcttatgtgctaccttttctatggattcttgaccctatcactaatttcacagttaagtttacaacacaatagtacaagtagtgagaaaaccagttatgcgtcttgacttaatttgataaaaaaaaggtaaaaaaacacaatatttgattgctcatagattccacagctctaattttttcaccctgatgcagtttgcagaaagtgtatatatgagaagttgaatgatgaggaggtagaatcctgcccagtatgtaaaattgatcttggctgcactccagttgaaaagcttaggtatgcttatcatcatgtatatgcactcaaattttattgagattgcttgtccctgtagcttgtaaggtcaaaataactgtgtatttgcacttcaattttgactgtactgttaaatttcctgcatcttctatttattactcctatatgatatgactaccaagtggggcatagtatgaatagagcatgtcaacttggtactttgattgagatttccttaataaacaaaacactaggaagtaatacagtgggaaaaaagtagaaatgttacatcctgaatgccttggtgactgtttgtttaactccaagtagctccccactatttgagtaaaatatgtacctcagggtttaaacagtatcacctgggatattatggaatcttagacactttttagttaagctctacgtaatacagtaagcaatcatacaggactattttgtacagtgttgattctgttgacttcagtttcatgctttttgttctgcagaatgtaatctggaacagatattctgcctcttgtaaattcatatgctctaaagaagaattttgttttcctgctcttatttctgtagttccttgttgagtgtactgatcccaaaggtttgctctcattttactgtatgggtactttgtagcctgtgaagccattggtacttgtttgatgatttatattgcatcctgtgaaattgcattattaaagtatttatcattgaaaatgcatctgatttattttttgcatatgtcctttagttggaaaataaatttgacgtacttctattcatgtgattctgcactggtgtttgtggcctacacctacttatactcatttctttatgttccaacttcagggctgatcacaatctacaagatgtaaggtcaaaaatatttccattcaaaagaaagaagattagtgctgacgaagtagcagctcctgttttacttcccagtaaaaggaaagagagatctatctcttctctggtagttgatacgcctacagtaacaccgacaggcttgacagggcgacggacaagagcagttaccaggaaagctgctgccttgcgtggccttggtcctggtattgatgatcctgtgaaaaaggaaattgataatggtgaaaagcatgctcagaattcaagcttgcccactaatttgggcaaagtgccacaaacaagaagacaggtaaacagaccacaccttatggggtacccatctctcatgcactttaatgaaagttacattggacttggctgtgaaatagtgatactaattactaagttttcaaactacaatagctagaagaatgcacatgccagcaaaaattgatcctgttgtatgcagatgtcatcaaacgcagaggcatcgaaccattcctccaataaagataccgaaggtgatcgcaaggacctggccgataagactgatgagctctggagacctttaaattgtttggtagaagctgcaaacaggacaaagtcctcccgatcaagttcacagagtccatttgttaagagagagcaacttagtgactctcctgggagcacatctgttaacaaaacaaagtctagggaatatatgcagaaatccaaaatagaggatgataagaaagatgtacctttgctaaaaaggaaaaaccaaaggactggacggaggagagaacttcatgcccaatctgatagtaagcctgaagctgcagctacacaaaacgaaaagaaattcagttctatatggttttcacttgttgcatcatttgaacagtaagaattggcgattcatcgtaatataactttggtttaatatttagggaaaaaaagaattgctgccatgaacttttatctgatcctgttccttttttttcctgattattttcagggaaggagacccacctttaccacagataccttcccattatttgcgaataaagtgagctcccatctttcccagcgtttccttaaggtttatgaaaattatagtttaatctgtacatggccttcatatagatcttgtttggatttatcacactggactgtcagtagatatgttatgataacaacaccaatatccaagaaagaaaatgcattagggaggaacaaaagaaagagatacttacatgatttgtaatgactaggtgcaagctgataatataaaagaaaattctttgcatacttgagctgattggagatagaagtcacttggttagtttcagtgtaaattattgtgaatgaggactttgatcttccactgatacttgaccctgattcaagaggcagcagagccgaggtctgacatttggcaacatgtgtgtttccagcttctgcacttctctgctagtctgttagctacaatcttggtgttgataaactgtttctttaactacaaatatcgtgctaaaattcgagtctaattaatttttagttggaaaatatattttgctcgcaaacttctgctaggtgctagacagtgtggctgcattcaagagttggaagatatgctggtctatagtagtgttgtatgatgcagattcagttgtataacatctaggtcattatattattttgcgacttgatattagctggcagatctgattatggctattccacactgtgttttacaatagagatggaaacatacctgcctcgtcaatccagaagtacctcatgcagaagcttggccttcctaacgaggcagaggtaagagctatatctgcctcgcatttttttttagattactatcatgtgtgactggtattgaagtagatcttttggacactcttgtgctcatctggacacggcaggctgcagatttgcttcatttctgctctagtttctgttatgggcctcttttcgcaatttgagctacaaattatgcttatcagaatccatgtcatgttgatgatgggtcaatttaattcataagaccataacttccagtttgctgtgtatttgtttttccaaaactgtcattttcctattttctttaatcgtccccagactgtatatcattttttagataatggaaacttttattgaactcagtcaattacatcaaggtgatacaattatcttgagaacacttccggcctctgcataactaagatgcacacagctaaacatacaaaaccacactcaaaaggaaaaaagaatgacatggagtattgaggaccatcaatccaaagactaaattgccacccatgaacaactccttggccatttcctccaaaagcataagagccaccaatcctaagactagatcgccatccatatccttgggtaaaaaactccttgaccaccttctccaaatgtagacatgccgcaaccaccattcccacgaaccatatccagactgcatatcatgatactaattgttactccctccgtttcatactgtaagactttctaacattgcccatattcatataaatgttaatgaatctagatatatatgtctagattcattaacatttatatgaatatgggcaatgctagaaagtcttatattgggaaacggagaaagtactatatattttcctctccccatagtagaatacctcggagcatttttaacttcctgaaaagattcacacctataaacatcgctgtacttgtcgcaacattttctttatcatggaacttgttttacttagtagtgaagatccactgtaaggtcatctgaaaatatcgacttgtctggatttacaggtcgaaataaattgctgcgggcagccagtgaaccctacacaacccctgtgcaatttagtagaggtgtggttgagggggcgatcaacacagacaacacagaccatgataggctcccctgccaaggagtttgtaatggtgctaacttatgggcggccaaaggccatcacgccatgaatggcaccacaaacacaaggctcaagccatttttcgcctagaggcgggtcccgtttcctgccattttattgggcccatggaagaagaggtgatccgagataaacctccttgatacatacatagcctcacaagtcacaatgcggttggctcacttggcagccagcccttggcgtcacattcatatgcattcattgatgttattcgattccattaagattgtctttttcttcattatttatattatacaaaaaggtgtgtaaagattagcagaaaaaaggctgttgtgaattatctgtatacctgtagtcattattgctgtttaggttggttataaagagtctatatgtatgagatgactagataaagtggatgtggatcgcaaaatttgtcttccagccgtttcatggactgctgtaacagttactagatcgttattctttttggagagcccagctttcattcaaagcataagagtacgttacagagcagagaaagagaagaaagacagataaaagtaaaaaggggcaaaaacctggggattccagcttaacatgaacagagcactatagctgctggcacagctcaaaaacaagccaggaaacacaccaaagacacttaagtattactcaattcatcagatacttaagcctgctatctttcggatactggcaagcagtaagtcccttgaagcgtccagagtactcttcttcgttggcgctagttttctccactgtaaatgtaaagaaacaaccttgtaaggtaaatgagaagcatcatcgatcattttgttgttgaaaacccagtcattttgcaaaagccaatggcccaagagccagcagcaaacaatgaaagggaagtaatgtttgaatcacaactttgcattttcagtttatccatcaactccccccttgatctaggaatgccactccatccaaaagcatctctaacgcagcaccacatgattttggatattgcacagttaaacatcagatggtctacatcttccacttcacacaatttgcaattagggctggcattccatttcatcttctccacacaatttgcaattaaacccttcgcataaccctccctaaccaatcacaccgcacctcaggtttcgcccccattcctcaacaggcagcgggcagccccctcttgtacctagataaacccggaagaagcatagactgtcgcagggcccatccatactccatcacgcccactcttgctcggatacgttagctaggtcaagccacactacagatccagccgttgccatgttggcttgtggtaagtacgggtaattcttccaggatttcccaagaacttccccttaattgtcatgggtgcgactagcaaaaccaagcacccataacccaccatttaagcatattttagttcaattattaccatggtggtaatccatcattaaattaaggactaataatttatgtgaaacccataatgtgctaattgatctaagcatggctaagcatcatctaaaccaatcatctaatcatttcatatcccagctatcaaagatataggttaaaaatggctgagtacaataggtatccatcccacataacatataaaataatacaattttaagaagaaagcgggaatttataaaataggtacaatatgatcaatatgtatgtatgacttgccttgctcctgagctggagagacatatgcaaccacttcgaaatacatgggagcttcggaactgccaaattctacacgacaaacaaagcacaagcaatacatgctataagtctactgaaataggaaaataaaccatttttaatggattctagatatttttatgaatttattgagacttaaatggattaaatcgaagctcagatgaattagatataaattttagaatattcattgtgtatttactataaaccagaaaatccttattccattattacgtgttgacgcctgtgggcggacaaaacaaggggatacgacaacagcaagcgggcctcatgggtcagcggctcattgagccgacctaccgtggtccagggccatgcgggcggtctactgctggtccacgataccggcggcctgggtcggtcacgaaactgactgagtgacgcaactcggcacggccgagccaggaaaacacgggaaacacgatgtgcgacaagcgaccggcaaacgacatggcaggaaatggccagggcgacatgacgctagggcggcgggcagttggcggcaacacggcacgagccgacacggcggcaacaacggcacgtggccagtaggtggtggcagacgcaggcaagcgccggcaacgcgcgacaggcgcggcggcgggtaggcaacggctggtgcgacaaggcgggcgctcggcggcggcatgcggcagcggctggcgcccgacagtggctagggcagcgcagcgcggcacggcaaggtgtgggtcacattgattcagcttgccacgtgagctaaagccgagcgtttaagtccgtttttgtaaattgaggtaccgattatatatttgactttttagttaagggacgaatttcatactcagcaaaaaaaaaaaattgagggaactagaatgaacttattccgggtgctgctgttccctgggtgctgctgttccctgacggcggagggtgtccgaccagcccaactgtgttccacgtgactgtcctcggccttgttgggtcgaaactgtgcgattcaagactccaagacccatcatggcagatatcctaaggtttctttaggggaaaaagttcacttgaggtccctcatcttgtcgtcgagtttcaaaatcgtcactgaatcggaataccagatataatgtatccctaatcttacaaagccggatcgtattgggtcccaaggcagtattaagagcggttttgaatgatgtggcgttgacatgacgcttaattttttttaaacaataatcatatggggatccacgtgtcagtgaaacaatatattcttccttcctctctcttaccatcacgtgttcgaaggttgtaaagcgaggtcgcgaggcggcgagggagctgggacttgggccgtgctttctcgagccggcccaaggcacgatggctcagtacgaaggaaagcacggcccagcacgatacggctatgggccgtgcctgggccgtaagttgaggcacgttgggcggcacggcacagcacggccattgggtcatgcttgggccagcccagcacgaaaaaggcccgaaggctggcccgagctctagcctagccgaacgcacgaggagtcgtaagtcgccacgaggagatcaggaggcaggatgatgcaaccacaaacaaagctgttgccggctacgagcgcgtacgcttggccacggagagtttgggtcacatgacgacgccattgccggctacgagcgggtcgcggagagtttgggtcacacgacgacgccattgccggctacgagcgcgtacgcttggccacggacgaagccgtgcttcgtcggcccctcgcgacctcgccgcctaaccgtcggcttggatggtgagagatgaacaagctaggaagattatatctttttcactgacatactggtcccacgtcggtttttattcgttatttttctttgccatgtcagcgccacatcattcaaaaccgttattaatacttctttgggacctaatataaccctgttttgtaatattagggatgtgttatatttcggtttaggaatgattttaaaactcgtcgacaagatgagggatttgaagtgaacttttttcgttccttagggcgtttttatccaccaatctctccgtctcgtcccacaccttcgtctcagccgcggcttgaggtgcgtacatgcgatttcctttgctctattccttgcccccgatttggattcgaatttgaagatttgtcgactcaagttcctgttgtttgggatgtatcgattgttattttatatcggatcttgagatttgtcgatttaaatcgtaagtagtaggattacggtggattgattcatattttgcaatggattcatagtatcatgatttgtcttttcgatttgtaatagtagtagtagtattggggatggattgattattattttgccatggattattcgtatcctggaattagtcgatttaaatcttagggcatgtttaaatcccctagtaaaatttttcaccctgtcacatcgaatatttagacaaatgtatggagtattaaatataagcgaaaaaataattatgtagattgcgtgtaaattacgagacgaatcttttaaacctaattactctatgatctgacaatgtggtgttacattaaacatgttgctaataacggattaattaggtttaataaattcgtctagcagtttacaggaggaatctgtaatttgttttattattagtctacgtttaatacttcaaatgtttatccgtatatccgatgtgaaacgccaaaacttttcatccctagaagtaaacacagccttagtaggaatttgtcgatttgagtcctagtaggaatgatcgatttaagtcctagtaggaatttatcgattgtgatgggtggtgaactgattcatattttgcgatggattcatcggatcttgggctttgttcatcaaagcgcttgaggtaggatttgggatggattgattaagttggagtaggatttgttcagcgtggtagtgagttcatcagatcttatgacttgtcgatttaaggttgattaggatggattgattctgatttaactcgagttcgaattgcagaaggaatacgtcaagtaggcgatttggacgcagtaagtacgtccatgctttatctcatcttggacgactggatcttccgcaagattgatttgtcgtctaaccaacctgatgggcggcaggtacctggaggcatcgcgagggaagccgcctcctccctgccaccccccttcttccgctggaatgcacaacgtgggatgcccctgcacttcgtcgccatcggctccaagatcttggccatgcctcccatggaagaaaaaagggatactgatcacctcgacgttggcggcgcctgcttcgacgtccgcaccgggtgcgtcgtcttcgtccctcggcacggcggcgatcagcacggcgacccagtatacttccagatcggcagtaggctcttcacgctagggtgctcccgcttccagctccttgacctactgccgctggcgctggatggcgaccctagaagtacaaggcggcagcaatggtcatggcgcgatctcccgatgccgcccttcctccactccatgcgtgctctctctcacgtgcttctccctcaagaagaccagaccatcctcgtcggcgttgggttcctctccccaagttcttcctccacctacagctttcgcattgcggaggacgggagctcagcctggaaatgccttggtaactgggggctgcctttccatggccgcggttactttgaccctaagctgaatgccatgatcgggctctcgatggatggacgcatctgctccggccaattggtgtctgatcactgcccggacgtgaagtattgcagggagaatctgttcagccgagacgcgcgtaggcgccaccctcgtctacatgggacagagaagcagattttgcctggttgagtctgttgctgtcaactacttatgtcaggagggggttttcagcttcaagcttgagggtccgttttttcgctacatgtttcggctgacgacttttcgtctgaagtttgatgatgatgatggacacctaaccactggtcgcagccgacgggtgcgatactattatgcccctgcaaatgatgttagttattttgcctgtcggtttcccgtagctttctacatatgaacgttttgtggtcggtgtaaacccgagattgattaaaatcgggcgatcgggggaggtgggaaaaatcggtcgctccctcttcccgcatgcgcgcgctcccctctcctcatctggacccacccacttatccctccccttgttccacaaaaatgtttcaccaagtgtacttataatggaatttggtttattttttgttccactggaaaatgtttcacctagtatactcacaatgtttcactatgtatagatctaatgttgcagtgaacgaaacattccattgcaacaaaaaaacccacatattttggaaaccccctattaagagaatttggtttattttttgttccaccgaaaaatgtttcacctagtgtactcacaatgtttcactatgtatagatctaatgttgcagtaaactgaaacattctttcactatttgttgaaacattgtttttatataaggtaaaacaacacccaatttaaacaagtgaaacattttcgatctacttagtgaaataattccgatatacctggtggaacatcgtgcaacatttaaaaataattcaataataagctttttttcgtcggaatatatccatgtgtggtcttgttttgaagatttaattgcaacgaatttaatggtgcaatcggatcatgatttggataagtagtttagaagaaaaatcagtttagtagttttgcatgtaaatcggacgcgatttttcttgaaatcgtcgggcgcccgagccgtaggcagccgtgtaaacctgcagttggaccatgtatccgtgtttggtgtaaaccagtagttttatctgtggtttgttgtgggtggatgactgttacattttctggtgattgttcctactatttctaaggcctggtttagttctccaaatttttttcctaaaaacattacatcaaatctttggacacatgtattaaatatagataaaaacaaaaactaattgcctagttagggggaaatggcgagacgaatcttttgagcctaattagtccatgattagccatagctataagtgctacagtaacccacatgtgctaatgatggattaattaggctcaaatatccgatgtgacatctaaaaattttcttttctgtaactaaacaagcctaaaaaatgtttggttgtacctattgtactaattaatgttctgaaccagtatctaggtagatcgcatatgaattgtaccaatgtattgacttttttgaaacgctttcacaatattgaaacttaattgttttttttaacattaatcacaatattgaaacttaatggttcttttacattaatcttagagctttttgaaggtatgcgtaagctactgctacttctaaatttgtgttgaaattcagatataggatgaggactccgactttgcttgaattatgagcgataagctggtagggtttgaattcttgcggtttttttacctgcctcaggctagccaacttattgtgtttgaagctcgttaaatcccaattttttggggtaactttcttcatatacaggatgaggacacatatccttctttgaaggttcaatcccaatatttttgggttgagtgattgaactttctccagactagttaggtgcccgtgctttgctacggggtaaaatatgtatccgcttaaagttatactaagtaaaataatgtcaaataatcattaaatgtaaatttattataataaaaccttaatatagcccccacattcaaagagaccactcaatctccacacgcttaacctagaaaattcaggtttctctgccattgcaaaatggcaagtgcgttcttaccccccttctttatgttttaattatgattttacacctttttatggtttatgtttttacccttgttttttttcaaatgcaccttcactctacccctattatgttaagataacttaacggtgtcaattcagccataaaaggacaattatacccttgggcattttcctaactttttgtataatttgcatgcatttcaaatgtgactaaacactgacaaaatttgacaacattttaacacaaattgtacggttgcaaaacttcactacaaagattcatcacaaattccaaccaaatagcaaatactgtgagatggcaaaaaagaaaaagaagatcaaacggcaacgacatcgctcgtctttgtggacgagccgcccgcagtgtgtcgttgttgccggcttgcggcgccaagctgctcgctgctcgccaccattgaggggaacggccgtccctgctgcgggtaaccgagacaccctgccctttcccttttcgcatcgtcagattcgctgcctgcccatgcgctgcgtcggagctaccgcggcctccccatagcatctgctatggccttcccacacgctggtcccggatgtgacgtaataggaattactatacaagcaccatcaccgatttttgttgagttgtgatctaaattttttttagaattacacagtacaacacagacacttacaacgcacgcgcactcacccatataaacacatgcacgcaaaccctacccctatgagcatcttcgaagactgggccagtaaattctgaaaagattgacgaagtcaccacaggtgcctcgctgtcgacgggtacgtcgcctaccactgaaatttgtgatccaaatttatttacatttaataaaggccagcttttgccggagtgaagcggatgcccaggggtgcggggacggagcccccgcggtacggatcgtcatcccttttagggttccaccatatatatacacctcttgtaagccgctgtacggtgttgtaatctcaccccgatatattgaagatattttacatgtgtagattggagataattatacggatgaaacacatcagatgatggtcaacgacgtaaatgactagaacaaacaacatatcaaaatagggaaaagataaagtactctcaaaacatacatgtatactctgaaaacatagcaatccacatgacatactacctccattttttaaatgtataacactgttgatattttaatcaacacttgactattcatcttattcaattttctttttgtaaatataaaaatatttaaatcatacttaaagaacatttaatgataaaccaagtcacattaaaataagggtatgtttagttctcaaacaaaatttttcacactgttacatcgaatgtttggacacctgaatagagtattaaatgtagaaaaaaaaccaattgcataattcgccaggaaattgcgagaccaatcttttaagcctgattatgacatgatttgacaatgtggtgctacagcaaacatttgctaatgacggattaattagacataataaattcgtctagcaggttcctgggggaatatgtaatttgttttattattagactacgtttaatacctcaaatgtgtgtccgtatatccgatgtgacatgcaagggtaatttttttccaactaaacaagcctaaaataataataatatatttttttaatatgacgaatggtcaaacgtataaaaaaagtaaacagcggcatatatcggaaatgctcttcgccggtcgcccggcttggggggagccggattggggcgcttccccccgcgccccctccccccacgtgcctacttgggcccaaccatttctgctccccttttttctagaaaagatgtttcacctagtgtatttacaatgtttcactatttataaatctaatattgcagtgaattaaaatactcttttgcaacaaaaaaaaacccacatattttggaaactctctattagggaattggtttattttttgttccacccaaaatgtttcacctagtgtactcacaatgtttcactatgtatagatttaatgttgcactgaacgaaacattctattgcaacaaaaaaaacccacatatcttggaaacccctattaagggaatttggtttagtttttgttccaccgaaaaatgcttcacatagtgtactcataatgtttcactatgtatagatctaatgttgcagtgaactgaaatattctttcgctatttgctgaaacattgtttttatataaggtgaaacaacacccgatttaaacgagtgaaccatttttgatatacttagtgaaacaattccgatatatctggtggaacatcgtgcaacatttaaaaataattcaataataagctaaaaaattttttcgtcggaatatattcatgtgtggtcttgttttgaagatttaattacaacgaatttaatggtgcaatcggatcatgatttggataagtaatttaagagataaaaccgtttaaagtaattttgcacgtaaatcggacgctgacgtcagcgcccgattttacccctcccgatcgggcgctcgaccgggagtcatccccgacatatatacataaaaaaatagagggagaactaattaaaaatagtgaaagtaaaagaataggatccgacacgggtttttgagttgctacatgtgcatactccccagctcagtaaggccattcacagtgcgtcaccaagttttggtgtttcttacatgccacgtagaccaagaactgtattagccacacatctcacagtgcaaactccacaaggccacatacatgtactagcttgtagtgggtcccaccactactacttttacagtttcaccttttactttcccctctctctcccccaactctttctttccccaccacagagccgggcggagacaggtcgccggaacttgggcggagcggcggctcaagcgcaggtcacaaagggggtcaggtggcgtcggctcgtcggggcgcggcggcggcggcgccgtggccttccacggcggggcgggggcggggcgggccggccgggcggcggatcgagggatcgacctcgaacggcggcggtatgtcggcggcggacgcccgacttggagcacgggacagcgaccaagcggactgagnccggggcgggttttcccccagcctccacgcctccgccttcctcctctggcccgagcggcgacggcgttgggcggctgcgtcggttggcgccctccttcgcgaatccatctccatccccgccgacggacggtgcggcgggagcttggcggcgcgcctacgggggacgatgcggcgggagctctggcggcacgacccaagcggcgccggcgccgggggctccacctctcctctcctcgccgggccgcgctgggcggcggacggcggggtgtcacgagcggcatcggcaccggctacgggtcgacgatgaggtcctccatgcggctggctgcggatcgacgacgagctcctccgtgcggccggccgcttctcttctcctccattgccgtcccctctcttctcctctgccggccagatccggctcggcggctaatccgtcctcgtcttcctcgcgctctccactcccttggccggcgcgccgaagagatcggcggcgtggagcgtgactcggcgacacggcgaggtcggcggcacgggagggggaaatggccggagctcgggagacaaggcaagcgggcctcttctcacaacctgatctgcacccaatcgccgccgccgctctcggttctcctttgctgccgccgccgctctccgttctcacggcgaagccaggcctcccgcacggcaccgcgacctcgtttcccacgccaccagtctcgattgcgccgaagaacgggtgaccaactttggtcacccgcgcttgagttttgtgggcccatgctgtaacgtggcggtgaatctgggctactcgccaacgtggaagctcaggccgaatgccagctcgttgcactgtaaatggcctaagagttccccgtaagtgccttcagtttggcacggatccgacacgggtttatgccatcaacaaacattatatatattgttggagtttttttgtttaggtgggtatgaacttgtaacaaatttttgtgttactaattaactgatcatgaaagcttttaaacataatcgtattgattaacaacaaccgtatcccacatgccaatgccatattgatcgaaaatatgatcatacaagttttgtttttattatttattttctcatgaaaatttgtatatataattggattggttagtaaccaaattatcacttttcgtaccatgcatccttgcatctgcgcattgcttaacatggatggcatatacgtgaagaaaaaaaaatcaaccaataacatataaagaaacttgtgaactctgagtgacatataaggaattttctaaaaataaaaacaagttctgcacttcgtatgcgaatgtagtttcttgaaccaacgtcttaatgtacaagtgcagagcatatggcctacaataatatacagaaatctaaaaatctgaactatatatggcctacaatgtacacaatggatgcaaacaaatgattgtgatgcccatctgatactcaaatggcaataaaaaatattgaggatttagttccattaaaaaagaaagagagaaaaactgagcaaatttcatagtagccgccgtacattaccacccaaaaagcagcactatctcaaatttctacagtccccagactaccccaaggtttgctgtccatggaggcgaaaattacaggattcatatcatgcacacggggaatggtttacataatgcaaatattattttgacaatccataccacggtttacatccagaatgccacggggtacttaagcattgcctcagtaacttgtagaggcatgctgtagtaccaaacccggcggctgttaccagttgtcagggctccattcctatcatactgcagcgaaaaggtcgtcaatcgcagaaagcacttcggatctagctgatcctcctcacccacctcatcagcagaatcctcgtcattcgcctcattagaatcatcaaaatcgatctcattcacctcatcaacagaagaaacctcattcgtctcatcggaatcagtcaactgatcagctactatatcatcttcgatgtggatactctccaggaggcagaagttgctttcaccaccacccatgtagacaagagtggcaccaatgtgcctctcagctgggaccatgctgaagagcttctccttgctgatcttcagggctggggggcggctagcaacagtgtcgtcggtagacaccacatcacaagagcagatgtggccaacggtgttgaggtcacctgaaagcccaacccaggcatccagccttgggtcgaagtagccgcgtccagtgaagggtagctgccattggccatgtcgcctccacatcatcggctctgccgttctgaagctgaaggtggcagggacgacgacgccaggtgactgctcaacgctgctgacgaagatggtttgtttgtcagggtgcacagcgtaggaggtgacaaggtcacactgaaaggctggcttggggagattgaggcacgagaagttcttcttccagttggcatcatcatcagcatcatcatcatcatatgtcggtggtggcatgtagagcatgtcaaaggaggcgctaccgagagtaaacaacctgtattcatcaatgggaatgtagatgatggggtcgagcagcacatcctgcagcattggccaagagccgacaacgaaggcccgcgcatgaacgtcaacgatgttcacaataagtctcttcttcttctttttcccgtgagcaggaggaggagtagccagaatcttgtggtcgaaagcacccacgatggacttaggctcgccgcgccgtgcctcgaagcggagcaaggcggatggcagggtgtgcctgccggtgaagacatgatcatctcctcctcgcgcgacgtcggcgggtatcagcggcggattgatgtcttcgtgcgagagcttcatcttgcggatgctacaaccctgcgaccagtcatccaggacgagataaaggtgccgtggcttttcattggaccgccgttttgacatacttgtttccttttgttcgtcatccccttggcaatccaacgcttgcaccagtcaatccaccttaatcatagtggcttttcacattttggtccttttgaaaaacttatttcgcaaatagacccctgaaaaaacttatcccagaaatggtcctttttggggcgcc

SEQ ID NO: 58621 - DNA, 7844 bp, Oryza sativa
ccacccattttacccctttattttagtttttaattttattttagcagcaatttcatattagtccctgtgttttatttaatttagtacaagcagttcatcagttgtacaaattacaatgtaagaccactggtgttatatgttacttaacataggtgtttattcaaataccctgcttcactaaatttcatgttgtcttaattaaatgccttttgcatattattttgagacatgctctacttcctcgcttcattaatttacaaaattctttaaattttgtactttaatttagcaaattctcttaattatgtacaacatgattaatggaggatttaatgcatgttccactacacattttgactcggaaattaatcacatgtagctggagtcctatattttggtcatcgtgaccataacctaggtagcaagtatgttgcccatcattaagtgttctacattttgagatgattacccggtggagtcctacaaattggccacactggtcataacctaggcagcgagtatctcgcctatcacacagaggtctacatctcacgatgattacccacatgtggtattttccgagaatatgttttgaaaaatgagattatttgaaatttggataaacacaaggtagtggagtcctaaacattggctgcggtatattcaccagaatatatttgcctagagatcatgttttaggcagcaagtataacttgcccactattaagagatctactccactgtttaattacttggagattatccacattgtgccacctaatttcgaattctaactcaaattatcaggtctataacctacatcttttcgaaacattacaaaatatgaagtcttacatttcgcattgagattacaacctcaatgtcatgtttttattaatttacctctgtaaataaataatgttaatcatgattatagggacatgacaactatagagttcgacgaactcgccctcgatgggagtaactacccaatttgggcttccgatatcaaaataaatttttgttctcgtgggatttcaaatacaatttaggaacccaatgattgggatccactagttgagaacagaaagctatatattgccattttccttctaaggctctacatctataaagatctcaaacatgagtacatgttggagacgagccctctcaacctatagaaagctctaaaagagcgttatgatcagcaaaaggaactcatttggcctgaggctaattatgagtggattcatttacgcctacaggattttgcgaaaaagagccaacggaagcagagaagatagagaaaactctatcaactatgtttccaaaggacaggatactgaaccaatagtatcgcactaaaaggattcaagagaaattcctcgaataaccctaagaatctaactggacaacgcaaacgcaacaacaggcgcaaatccaatggtcgacagaaaggaaaagggaaaggtcaggcaccacaacctcgtggcaaatagcaacaggcattacaacaagtgtggatctgactatcatgtcactaaagattgccgcatcccaaaaacatcttgttctcatgtatcagaaatccctaaaggagaaaaataaatcttctaaagaactaagatttgaagctcactttaatcttacaaaagaaagacctgagattgaaagttctcaccaggttgaagctcacttcaatcttacaaaagaaaaacctgagattgaaagttctcaccaggctcctattgaaccagagaacaacctcgctcttctcctagaggataccgcggcactttctgcaatggatgacatgctcatcgagtactgctcaacggacccagttggagatttactatgatcgcagtgcaccccacttagagataaagctgctttaatctcagtgtgtttgagacattatattgatatcctatagtttgtcaaaacaatattggttgtaataagtagataagtacaaactcccttatattataaggttgtaagacttgctagtcattagagtatgtacttataacatttgtaaacatcatactatgtatttgatgttttaattattgtatgtatgtatatattgtggataaagaattcttcactaagcaattcttctttcactatagatgtctaaggatatgactccgattggagatgaattatgtcttgtggacagtggtaccacaaactctatacttagggagatcaaatactttcaagctctcaaaaagagagaaggcaaagttttgactatcgctgggcgcgatactgtgatatttggctcaggacgagcaactattacactcccaatggatacacaaattacaatcgaggatgctttattgtatcctgattcaacccataccctactaagttatagagatatccgtcaaattgggtttcacattgaaacccatatgcataatcgagaagaatttcttctcttaaccaaacaaaagggatatggcaaacgcatttgcgagaaaattccatctctcacattgggattgtactatacatacattaagcccattgcacatgttgtgtacaaagtgattttttaaaatgttgatgcattccacacttggcatgatcgacttgagcacccggtatcgggatggtgagaaaaattattgacaattctattggtcatcatttgatcactgacaaatttcccaaatactctgatttcgtatgcacagcatgtgctactgggaaactgattttgagaccatcttatctcaaaattagagccgaaccacttaaattccttgaacgcattcaaggagatatctgtggccctatggtgccaagatctagaccgttcaggtactttatggttttgattgacgcatctactagatggtctcatgtgtgtcttctatcgacacgaaaccatgcctttgccaaactaatgtctcaaattataaggctgaagggaaattatcctgaacataggattcaatcaatccgtatagacaacgctgccgaatttacatctcatgctttcgatgattattgtatggcattgggaattcaggttcaacactctgttccatatgtccacacacaaaatggtttggctgaatcattgatctaaagaattaagcttattgcccgaccattattgataaactgcaaattaccttcgttgtgttgtggtcatgtagttctgcacactgctgaccttgtccaactacgaccaactgcattgaggaaactgcatatcgtgaaacttccccaatgcagttagtacgtggaaatcctccaagtatttcccatttgtgtaagttcggttgtattgtatacatactgatctcaccaccacatcgtaccgctatgggcccacacaggaaagtggggatctatgtgggatttaaatctccgtcgatcataaagtatttaaaacccttaataggtgatctatttactgcccggttcgctgactctatctttgatgaggaaaatttcccggcattagcgggagacttcaagtaccagaaagaatgacaggaaattgattgggatgcccagggtattccagcctcacacccacgcactactgaaactgaacttcaagtttaggaaattatacatttgcaaagcctgacaaataccttgccaaaggccatttcctattaataaaggtgtacttaaatctttcattcctgctcagaatgcgctagaaagagtggaggtaccaaataaaaccactcaacttccactcactaaaaagagaggaagaagtttggccactcagcgagatacagttgctagcaagaaaagaaagacaataaagcaaaccaaccttaagttggtacacaccaaattgatactatgtatcaagcagatcgtgataatctgcaacctagcccagttgtgcataatgctgagactaggaattcagaagaccatagacacattgttttgggaaatcacaatgagtctataagggttgatgaaattgccatcaactactcggaaactggagaatcttttgatagaagagctacaattgttgacattaatttttctgaataaattgctgattgcctgcaagttgatccagaacctaggtctataaaagagtgccaaaagcgctctgactggaacaaatggaaggacgcaactgacgcagaattagcctcgctttacaaaagagatgtattctcggctgtaatgcctactcctcgtggtatctttcctgtgggatacaaatgggttttcgtctggaaacggaatgaaaacaatgaggtggtgagatataaagcaaggcttgtagcacaaagttttacgcaaaaacatggcgttgatttcaactaaacttactctccagttatgggtggtataactttccgatatttaatatcattgatagtacaaaatcgtctatttatgcagttgatggacgtagtgacagcatacctttatggatcacttgattctaatatttacatgaaggttcctgacggaatcgacatgccgaatcagaaggtaaatcgtaacatgtattgtgttaagttgcagaagtcactttgtggcttaaaacaatcgggcaggatgtggtacaaccgattaagtaaattcctttcactaaagagatacactaaaaatgatgattgcccatgtgtccttatcaaaaagtcccccacaggattttgtattatctcggtatatgtcgatgatcttaacatcattggcaatacacaagatattaatgaagcacgtcatcatttaaagacggaatttgagatgaagaatttgggtcaaaccaaattttgcttaggtatacaacttgagcatttaccttctggaatccttgtgcaccaaagtgcatatacctagaaaattttggagaaattcaatatatggacaagtcatatctttccaaaacccttatggtggttcgatctctagacgtggagaaagtcccatttagaccaaaggaagatggtgaggatgtgcttggacctgattttccatatcttagtgctattggcgcacttatgtatcttgcaaatagtacgaggccaaatattgctttctcggtaaatctattagcaagatatatcgctgctcctaccaaacgccattcgactagagttaagaatgtctttcgatatcttaatagcacaagagatcttagacttttctttaaaaagaaccaagattcgaccttaattgggtatactgatgctggctatctatctgatccctacaatgccaaatcacaaacaggattcgtacttttacaaggtggaactgctatttcatggaagtcttctaaacagacactggtagccacttccacaaatcattttgaaataattgcattatatgaggcatcacgtgaatgtttatggcttcacagaatgattaaccacatattaacatcttgtggtattggttcattagaatcacctaccattatctatgaagataatgccgcttgtgttgtttagatggaaactggttatattaagagcaacatcactaagaatattgctcctaaattattttatcctcatgagcttcagcaacatggagagataaacatcttgcaaactaagtcatgtgataatctcgctgatttattcataaaatctctgccatactccatattttttaaatgtgtcgaaggaattggtatgagatgacttaaaaatttgcaggattgagggggagtaactctctctgggaaataacctattttcgtcatattatactatttttcctttgtatgagttttaccctttatattttctcatccaaagtttttaacgaggtaatatcaacataagttatatgtcttatcattttgcttttccccactagggtttttactaaatgataactatagacattatactaattttggaccatactatgagctttactcataaagtctaaaaatagttaactatatatcacggttcttctccttattttcccaatgggtttttgaggagtttacctgatgtatctaatacaataaattataattatttctaagattatgtttacaaatattctggaacaatgaaagagcaatgatcaaagctggattcgatcaagggagagtattatgaaacaatagggtgatctcatccatataaaaggattgatcgcaaccgaaggcaaccacgcctcttccctacggaattgctactaggcgattgctcgctcagggcgatcagatccgatccccctccccctcctccacgtgggttccttttttggcaccgcattactttcctattttagtaaatttatgcacctaaagtttgtacacctcaagtttacacatctaaagtttatacacttaaagtttagagacccaaagtttataagtcaaaagtttatacatcagattcaaatttgaatttgaattcaaatatattttatatataatatttctgtacatctaaagtttatagacctaaagtttataattcaaaagtttatatacccgattcaaatttgaatttaaattatatccgattcaaatttgaacttgaattcaaatattttttatatatagtatttctttacatctaaagtttatacacctaaagtttatagacccaaagtttatgagtcaaaagtttacatacccgattcaaatttgaatttgaattcaaatattagtttatagacccaaagtttataagtcaaaagtttacatacccatttcaaatttgaatttaaattcaaatatttttatatatagtattttctatacataaatttttccaactttatttttttattttttttaaatttatggtgtagtaggaagagaagaaggggaggaggaagggaaagagtagagtatagggggacggagagcgatcacccgcccattagcacccccctcttccctaggcactccttagcacccatttcctatctataaattgtaccgcattgatcaataaaggacatccgctcattcgctctattgcgttcaattctctctctcgctcaatctctctcgctcaatcaatcttatatactttcaacgaaattgacacgatagcaaaccattttatttttattagaaagctacaaatatttcccactatatatgtgcgtatgacttgcattgtgggccccaacttgcaaaagcatgagttttgcatttgtgtatgacatattgacctataaacttataaaacaaattaagttgtcgctttatgataaaagcaaatatatgattcaaaataagtatggaatatagctagaatgaaattcaaaacagcaaatataaattgcacacgtaccttggtcttgtagaacggctgcgtgcaatgcattttgtctatttgggccagagtacgaaagattcccgtctgtcatttgatgcaataactttgcaatgtcgacctgttgatgcaagacagctaggtacaacggtgaagtacctgttgcatccataaggaagccggccaattctgaataatatttaagaaggttggtgattatatccttatttccaatgcagacggcatcatgaaaggccgtctccttacggcagttttcctttctcaggagttcctccagtctcgcgctgctaggggagttgtccttagtttcaaccagatcaattagatgatcaaccattttggaatggccagcccggacagcgcagtgcagaggtgtgtcaccgttgttgttctgcactaacatgagatgttgggacctgctgtagatgacgcctgcactcctcaagtagcccgggccatcaccgcaggtggccacaacatggagtgcagtgttcccttcagtggtgaccccgtccagatccatgcccgactctgcatctgcaccag

SEQ ID NO: 58622 - DNA, 5525 bp, Oryza sativa
catatgattggatcctaaaatctttgtagtcgaaaaaccacaacactcccctttttgcaaaccaacccttaactcatttaaacaactagaggaactagatagagaattacttgtatgcacgcggtcctctcgacaatacattttatcatgaaaatgaggtatagtcaaattcgaacaaatatatactcgatgcacattatattctcctttactatcataattaccaataatatgaaaaatcacatcagaagggcatggcaattcaactctatcaaataatttcttctctaagcagttgagtggacaaagatcatcaaattgaatataaccccaagtatttaaagaagattgcaatttaggctcttcattctcgctagcaatgtgaataacatgtttaaactcaacacatagtggctctactatagaactaacatgttcattcactagttgttgcatggatataagtgaagcatcgcacaactcttctttatcacaagaaacatcaagcaaattgttttgtgacaaaggtatttcaacaatcggttccactatgggttgctctaacgtagcataagttgtggacatagttggcacatcataaatatgcataccttgagtagctgtagcaccattatcattactttttttctcatcttcagaaattataggtgcttggtcaattgaacattcttcccgcatgcatgtagctatagatagatctttttcctctccatctttcttctcttcctccttactaacttggttgttctcagatgcctacaaaatattagtatccaaaacaataggcacaacattacgttcattttgtaacaactcagacttagttgaaggcatcacaatattagtattattcctggtatctctgaaaatctcatcgattctattcttcgtcctttcaatactatctttgaaaatttctttgattccattcttcatcctttcaagattatcttcgaaaatttcagaaaaactcattggttccaatttcatttttcaaccgttatgtctaaatgtgtatgtattagcaacaaaattatgcaaaccattattatcatatacccatggttgaccaaacaacaaagaatatgcttgcatagggacaagatcaaaactggcagtatcatggtaattttcaatcgaaaagtttattctcacaattctatttaccttgaacttaccacaagagttgaaccatttgatgtaatatggatgatgatgcggttgtgtaggcaactcaagtttctcaaccaaatctgaactcaccaagttattgcaactctcattatcgattatagtacgatatgctctatccttaaccacaaactttgtttcaaataattcgtgatactgccattgctccgctttttccatttgagaacttagcactcgttgcaccaaagtactgtcatcacgtgcaccttgttggtatcgctgattttgagcgccactcatatctgtcattgccaacacaaaaacaacaacaaataatgaaggttatccctaataatctgctacgcggtgtagtggtgcccctcaacaactcagccaaatggagcaccttaccaagctcttacaagtgtcttaccagcaatgctaaggacggtacaaccggtggctggttcgtgacaccttaaaggacgtgatgtggcaattgcaaggatcaaagcggtgctgaccagaagtatatatgtgtagcttgggaggcacaatatatagtagcaaaggaatgcaattgtgctaatcagaaaatgcaaagttgaataatagttcaaagtactagtcaatgtgctggcctagcctagactcaactctagctcaagcaaccacccgaccacactaaggactagatacgaatcaatgcacaactctgcactctgaaaacatactcaaaagatgaatgatttttttctttcttggtgcggcttttttttaagcacatttctgccttttttttacttttttttaggtgcggcttttttcttttttttctttgcacctttctgtcttttctttatttctttattcttttttttttacttttttttcaacaaaaactgaccactgaccttgaacagggactcaaatgtaaatatgaatatatagggactcaaacgcaaagtgcaaaactaaaattggatcatctcaaaaatggattgctcatatcatgtaggttccatttttatacaaatatctcaaatccgctacttaacaattctataaaggaaaatacggatagtcacagatagatctgatctgatccggagtctctccttagacgcacagagtactcccctcacgcgcgcgcacaatgcaacataggagctctagaaatcgagtaactcccaaaccgttggataaaaatttctccaaaatacaaaaacggaaacccgacgacgagatgattcaatttttcaaggtcccggcaacaactgacgagatgaaaaactggacccaaaactgacgtacaactcacacacttgagtgatgtaccctagacctaagtgatgaacagatgcaatactcaaaactaaaaattaaatctaaaactaaaccagcactcgacacgacgatgcaacctagaattcaacaaagtaaaatctaatagaacaatgcaacggctcaaattgtctaggtaaagaataaatatttttgtgtggcaattttctggttatgggaagataaattacctaacgggcaaccacgctctgataccaactgatgagggatattaggtcccgatcttccgataggtattgataaacaacgatttgggcggagtcgcgacacaactcgatccggcttctgaacaaacacgctactgagccccgcaatcgcagcaccacgtctcctctggttatcaatcgtgccgaaacccggttgacctcgccgagaaggctaatccctgcatgcgaatcgaagaacacaagcaagaacaagatagattgcaaccaaattgcatatgaatgattaagcactcgaatttggggttccacaaaccgatctagcagcgaaactgttcttgacagaataatctaagcaaaacccaactctaaacgatgacggctactgaattaatatgattagggacgtcctagggtttccctagggcgcacacccccttgggctaagcccacgatacaattaaaaggcccaaaacccgagtcagattcggactggatgagatacgtggcttgttttgcagattcccggcagctcggtaggaattttgatgtgggaccaaaaccatctgaaggtagactccataagctttccaacaagtactcatgggtcccgaaattccttctagatcagcggctaggtccatttgaagttgatgctatcaggaggcccgaattcgaatccaaaatatgtagaactttatctcttgtcttctatggaccaaaagtgacgtggtgaggtagaagtagacttggagaggtcttggtttggtccctaatcaacttcttcaatcatccatttattagttacgctcggtctcttttctttcgcccaagcaactacctctgcaaatgaaaacacacgaaactcattgtgtagcaacgtttgttcaaatatataacaagtaaatcttatgtagaacatatgcacctttatttgattaatacataaggtagtcatggttatatccgagctagttatgtccttatcaagtgggttgtgactatagtggatttagagcacaaccctcctccattgagcccctcttcactcaggttcctaagatctcatcgtaatgtatcggatgaagactatgagctgattgagttgctgcacaacaacaatattcccactcgcaggatcatgtctgttttgtctgacctgtatggaaacattcgcaacataccgttcacgaagaaagatgttagtaacataaggacatcaatgaggaaccggactacatgcaatggtgacatggctgaaaccatcaagtacttccaagaattgcaagcagaagacccgatgtttttctatagcatggatgtcacgaccggaaataacccaacgggcgttccttacgtgcgtgcattattccttgtcccaggaggcaaggtacaccaagagttgatacagttcagagttcaacaagcggaagcgtaaatagttaatttattacatgggcggcgaaggcccagcacacacaaagacaaacgggaaacagctgaagactagggcgacgaccacaggcgcttgacggcaggcacgagctagacaccaaagccttcatcttctagggactcctcttctgggtttgggaaaaattgagcaagactgagtacacccaccgtactcacaaaacacacccacaagtgcagaataaatgcagggaagtacaagggggttataatataaagggttagggtttgcagaaaatagcattaaaagacacttagttgcttgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatctttgtcgcgtcccaaaacgactctaaaatacatcctcgaaattatgcaaagaataagtaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaatccctaaaagtcttcttttccccccttcctctcttgggccggctcggcccaactctccctccctctctctctcctctccccgcggcccatcggctccctccccgcgcgcgcgccgctgacaggcgggcccgcccgccaccctcgctgacgggtggggcccacctgtcatccccttcctcccgccgctcccgccgctcgcccgtgccctagcgccgccgccgccgcgaatctcgccgcctcccgccgtccccgcgcgcaataaagaggggggaaatattccccacgattccctctctctttccccccgtttttccctctctctctccctcggattcgtccggattcactcccgcaaacctcgccggcgccatcaatggcggccggatcctccgcgccggtttccatctcctccggccgccttccctcactcccaaccctatttaagccacccccgtgctctcctccaccgtttacgccactcgccgcctctcctccccgtcggattcgtgcccgcgccgtcttcctctctctccgccgtcg

SEQ ID NO: 58623 - DNA, 1393 bp, Oryza sativa
taggtggagtcctgcttataccccagttgagcgcctgtgaagatggagccgtaggccgctagtccgctgctgtttattttttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaaattatttgcgaaagttcctttttctccttcccctaatgctatttgcaaaaggtttactccgttcttccttcttcggattttcaactagtactagatggtcaggtcagtgaagaagaagacatcgtcagttgtttgccgaagctccggaagactgcaggatccgctagcgaaatggaggaagtagtgaagccagctgtgtaggagtgaagatcttgggaacccatcgcagaacctaagccgccctctagggtagagttgttagtcgtgtgtttcattgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacttcaagctcccgagtgaatgaagcaccagacaccagttgtgtgacactagtccaacacctggttaaccagaaccgattgcttatagagatactacagcagcaccagacgccaattctgaacttgagtcaaatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaagacgtcagagaagaaataccttccgaggtgcaacacagttgacagagcatcttttagctaatggaggtagagtgtctggtagtgaagattcagatcaagtctcctccgatgatgaagatgagaagtctccccaaggttttaaccagtgatgagctactgtac

SEQ ID NO: 58624 - DNA, 941 bp, Oryza sativa
caccgccccccctcacccgcctccattcctgtttctctgtatgaagttgcaacggtgttatttttattttattttttcggatgttttttcacactcaggatcacgatacaaccaaccaaaaaaaaaataaactcgaactaccacttagctaagtctgaaaatagctagcataccacttagttgcaccttcactaaaattagaccataactcctttagtaaaaccctttgatcagcatgttaaacataatgcactctaccactatatgaaattacttaatctaattcaaaatataaccacatgaaatgacatatataagttaaacagtacagagagatgcaatttttttatttttattttatttttttaatatttttttcacacttaggagaacataggaaccaaccgtataaaacataaactcaaacggacaaaatatgtgacttgtagaattttccaaaactctaccgaaacggataaaatatgtcatctattaaaataggcgtaactttctcatacggactcggaatcaggcaaataatatatgcacggacatttacagaaaaagttacatccgagttcagcaatattaaaacctccaaattccgcttgcaagattgtgtttttgaggagagaagtttttcggtatagctttagaaaattccacatgccacatatttcgtccgtttgagtttattttttatatggttgattcctgtgagttcctaagtgtgaaaaaatatcaaaaaaataaaataaaattaaaaaattgcacatctctctcctctgcactagttcggagagaggagaggagaggaaaaattctataggtcacatattaggtccatttgagttcaatttttctatggctggctcttgtgtatccctaagtgtgaaaaaaatagcaaacaaataaaacaaaaataaaaaatttcggggtgg

SEQ ID NO: 58625 - DNA, 3116 bp, Oryza sativa
tcctccgctccggtcgtcgtttccgccgtcctcgtcgacccggggtgagccgtggaccgctcctttcgcttcccccttccctcttctctctcgggcgccgctccgccgcgctgttggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtagaccgagaggctgacgcgtgggccccactcccgtggacccggtccgcgcgccctctctctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattaccttgttcaccctagattaaacaaaacctcaactagtggacattctacttaagacaccactagtttaattttaggtagatgcttcgcaatttaattaggtaacattaggtggtttttcaactatagactttgggaattattcatatcacctggacactttggaatggtttggttattgtggaattggcttcacaccgccccctctattcaaaatccccaaaaaatggttttaggctgggcgcggggtgcatggttttgatggtagcacctcggccatataaggaccggtcttcgggcctctgttgcaaagcactaccgtacttccacatgtctaatgggtaaggcttagtttgtggctcaggctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagttctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtagaatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgataaataatcttgtatagttctagaaccgtgtttacaaaatagccctgagcaactaaatatctttaaatgctatttactgcaaccctaaccctttatattataattcccttgtactcccttgcatttattttgcatttgtgggtgtgtcttgttgagtacggtggttgtactcagtcttgctcaatttttcccaagcccagaagaggagctccttgaagatgaaggcttcggtgtctagctcgtgcctgccgtcaagtgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaatcttcctcacgtgtaaccacgtgtcgcataccaccacggtatatggacggaagacgtgacatagtttccaacccatcctagccatagacaagagtaccgacccaaccccacctacggccggaacctccgggacaggtaggcaggactgaggccctagcagcaggacaccggccctgtgccatgacatctcgactactgggccgcagcttgtgtagccttcatttgtcctagagatgtccatcgacccctgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccctagtgtccaggtgataagagtattcccaaggtctagagttgtaaaaccacctaatgttgcctaattaaccagcgaagcatctaccatgcgtagagtgtccactagttggggttttgtttaatctagggtgaacaaggtaataataacaataacaataataataaggtcataacaaaggtaaataggcatggctaaataaaacagtgataacgcgggaatttaaataaagcggtaatgcaataatttaaatcaaaataattttataaactgggattcaatatgttcaaggatgatatgacttgccttgctcgctttcccaaacgtcggcttcaacctccgcgaagagcggatcttccgaagctgcagcgtctacacgaccaacggaaaagaaaaaggcttttactctaataaact

SEQ ID NO: 58626 - DNA, 8136 bp, Oryza sativa
gcagccttttcagccttcatattgtccaaaaccctcttataatctcttgggaataccttgacaaattttggaagaagagtatcaaaattagagagtatatctctagcaacaacactcccagtgttaagtcgatgttgttctatcatcattttcaatgtggtaatgtcttcctcttcctccacatgatagagatcaactaactcatggttacagcggacgctgaatttcccatcaatatcataaacataagcaatgcctccactcatcccagcagcaaagtttcttcctgttttaccaaggataaccacagtaccccctgtcatgtactcacacccatgatcaccaattccttcaaccacagcttgagcacctgaattgcgcacgcaaaacctttctgcagccattccattgaaatatgcctctcctatagtagcaccatatagagccacattaccaattacaatattgtcttctggaataaatgtactatctcttggtgggtagacaacaatttttccgccagacaatcctttgccaacataatcattgctgtctccttcaagctcaagggtgattccaggacagagaaaagcgccaagactttgaccagcacttccagtgagcttcacatgaatcgtacctgcaggtaatcccttcatgtgataacgctttgtgacttcatgactaagcatagtgcctactgctcggttagtattctggattggagtctcaatgaaaacacgaacttccttctcaagtgcagcttttgataaagctatgagtttgttatctaatgccatgtcaagaccatgatcttgcttttcaacacagtactgagcagccccagggcgaatctctgcagctggtttcaaaatcaatgagagatcaatgttctcaagtttctcgttgctcttcactacttctggatcaacctcaagcatgtcagagcgcccaaccatttcagtaatggtacggaagccaagctgagacatgatttctcttagctcctcagcaagcatgaagaagaagttgataacatgctctggttctccagcaaacttttctcgtagcactggatcttgagtagctataccaacagggcaagtgttggtatgacatttccgcatcatgatgcaaccaagtgtgatcaacggagcagtactgaaaccaaattcttctgcgccaagtaagcaagcaacagctacatctttgccagtttttaactgcccgtcagtttgcagaatagctcggccacgaagcccatttgccactagagtttgatgtgtctcagccaatccaagttcccatggaaggccagcatttttaatacctgtccacctagaagctcccgtccctccatcatggccagatataaggacatggtctgcatgtccttttacaacaccactagcaacaactcctacaccagcctcagaaactagcttgacgcttatgcgagctctaggatttgaattctgaagagtacaagcaacaagaatgtcaccatatatcaggaagcaacatttgcaaattgcatgcatgtgttcaagttcaattgtaaaatgttgcatggcaaatgagcgatcatgagttggtatgatatctcagaaataaatctagtactaacaactatacaaaaataacaacaaatcgcttggtttcaagaaatagcaatgcagtatcacattaagttaccttaaggtcgtggataagttgtgcaagatcctcaatagaatatatgtcatggtgaggaggtgggctaatcagtcctacaccagcagtagagtgtcttgtaaccgcaatgtcaccaataaccttgtggcctggaagctcaccaccttcaccaggcttagcaccctacatacataaagaagttataacaaaaggtaaatttctgcaacatggtaggtgctttcaatagactgctgcaatcattttaatgattttgtagtgcacaatgttgacaagtacctgagccatttttatctgcagttcatcagcgttagtcagataatagcttgaaactccaaatcttccactggcaacttgcttgattgcacttctttttggattcattgaaccattagcaagtggttccatacgagaaggctgttcccctccctcaccttcacagatgtattagagttagtgcataatggtttagaggttatggattctactcaaaatagcaaaagggtaaaaggagatattttagacctgggaataaaagtaatattaagttctagaaatatgttaaacaagaaagaaacagttaaataaaataaaacacaaaaaataaagtctcaaatagtgcaatatgcttcttgcaggaaagaattttctgtatagcaaggaaaaaactcaatcccactaaaaatagtgatattttgtcttcagaaggcactctccacaccaacagaagattttttaaaaaaaatagcaaggtaccgtataagtttctttgagtgaaatgcagtaaatacctttttgtttgatagaatcaaaataagttcatttgtaagtacaagtatgtctaaaatagtggctcagaacagaaggcttgttttgaaaggtaattccataaagtgttcttactgcagattgtgcaaatggtagcaacaaagggacaaatgctacatagtatttcagtgtacctgtattagatttccctccaagtttgttcatggccatagcaagggcagtatgtgcttccaaagaaatggatccataactcattgcaccagtaacaaagcgtttaacgatctcacttgcaggttcaacctcgtccacagaaatcatgtcagcagtgtctttaaatttaagcataccacgcaggttgcaggttttgttgagctcctgaatacgcctagaatattctttgtatgctgcccggctgtttactctagcagcttcttgtagttttgccattgcaaggggatcattgaggtggacttcaccatttttcctccagtggtagtcccctggattgggaagggcctttgcatctgcacttcctggtggaggtgctcttgatggaaatgccaactcatgaagacgtagagcatctcgtgcaagcatttcaaaagtggcgccttcaattcggctaggtgtaccatcaaaacacttacggatgacttcagaggaaaggccaagagcttcaaaaatctgtgcacctttgtaagatgcaagggtggaaattcccatctttgcaagaactttcatcattccatagttagaagcatagaaatatttcttgacaagttcttcctttgagtagggtttcccatcaccattaggaggaatcttcccatcattctgcaagcaccaaattgcttcgatagccaaataagggcatacagcatcagcaccaaacccaacaagggtgcagaagtggtgcacttcacgaggttcagcagactccaccaacaaacctacgcgcgtcctctcaagattggccacaagatgctgatgtaccgcgccaactgctaagagcgaactgacagcaacacggtctgaggaaaatcctgcatcaagaatttaaacaaaacagtaagtttcatgcgagaaaggtcaaatgttgaagaatgtcgtagacacggaaatgcataaggtaaacgaatgttataactttgttgataataacagcgctacacctacttaattgataatattcgacctattatattccaaaattatatgcttggagctacatttaaataaaaataaatttgttgaatgcgtttgactaccgcaggaatgattacaaaattatgagtaatgagtaatgaaacatcagtagtatatattgaatatttcactgacctctatctgagagaactaaaacagtgtagcccttctttatagctccccgagcttctgtgcaaattctgtccaaagtttcttccaagcccttccttccagacttctttggataagttatgtcgagcaccttgcttcgccaaccacggtagttcatcttcttaatagcctccatttcatcaatcgacaccaaaggaccctcaagtgcaaggcggttgcattgcttttcagttgtttccaacaagtcaccttctggcccaatcatacactccatagatgtaacaattttctccctaattgggtcgattggcgggtttgtaacttgtgcaaacatctgtttgaagtactcaaaagtcaacttctctctgtttgacatgactgccaagggtgtgtcatttcccatggatccaagagcttcaactccatctttagccatcgggagaagcagcatttcaagggcttcaactgtgtatctgcagtaaaaataaatttgataaataaaccaaaaaggaactcaaaacagcaaagatagtcaacaaagtcgaaaccttgcttacccaaaggcttttagtggagtcacaatcccattgacgcctgcatgttcctttttctcattcttttgctacaccaaagtgtaaaaaaaaagataagtaattatagtgtaaccaaattctcataaataccagctaaaattgtagccagtgaaaaaataaaataaaatgttaaaacactgtaacagacttactgtgagtgaaccagaaattccaggagcaactctctcagtttctggcacagattctacaatgtctttgaggtatattttttgtctcttgagccactccccatatgggtgagctttcgagtactgtgccttcaatgcttcatcatccactacagtatggttctcaaaatcaaccaacagcatcattccagggtttagtctaccctttctcaatacatctttggaaggaacatcaacaacaccaacttcacttcccatgactacacgtccactgtgtgtcacataaaatcgaccaggcctcaacccattgcgatccagggtggctccaaggtaacggccatcagtaactgcagatgaaagcaaagtaaccacaaatagtacatgggaaatgtgtgatcaggaaggaaaaggtcttccgtatcttcttacaagatattagagcaggtccatcccaaggctccataagggcagacaagaactcatagagagctttcttctcaggttccatgttcacatcgttctgccatgcctcaggtatcatcatcatcacagcttctggcaggcttcttccaccacggataagaagttcaagaacaccatcgaaagcacctagaattgaaatgattctatctaattaacaaatctctaaaaataaggaaaatcccattttctaagtgtacttgatgtttcactgcatgaaacaattagctcttacctgaatcagacgaggtagcatccacaattggtagaatttttgaaaactgatcctttgttaggccaagcttctcacactctaagagaccttctcgtgctttcatcctgccatgcatgcaaaagcagttataaaaccaagaatcataaacaaaaatggcatagccatgtggagatgattacatacaacctagaaatggacattgtatggagcattccaaaaaaaaaaagcaagattaccaattcttgttccctttgagggtattgatctctccattatgacctaatacacgcatcggctgtgcacggtcccagctggggaaggtgttcgtggagaaccttgagtgaacctgtttggatgcatgaaacttagtaactgtattatactcaactcttgtaattttacaatgttgaacaaaacttctaaatgaaacaccaacacactgaaaaaactgaagcatcagttgcatagaatttcatgcaaaacagttggaagccctaagctacctcaaaccaaacacaatttcttcccaccacctaattggaggtcacatccagaagagtcggcatagcagtcggccatagcagaactgcagctggactctgcaacatggttatcgggtatcaactaataaagatttctaatacttcacttaaaggcatcaagaaccaggactgaaatatcatatgaatagagcagtgatggtaagacaattcaaagtttgatgcctgcacaggagtcttgatcttacaactgccttgctattattggttcccatccgccgactatggtcatgactttttttgtataagaggatcaaggtattgtatttaccagagccatataacttgtgaagttttcatgacctagatctgcatagtagtaccccttaagttggcatggcttaagctggcccttgtagacaatagtcctggaaatcacaagaaagcaaacattgaattactcacatgaatagaacacaattagaaagttattacactacaggatccttaagagagagctcattgttttttctttctttagtcccatttgaaatagaaaatatttgctgatgatccccccccccaaaaaaaaaaaagaaatgtgaacttgattgggatttgggtatcatcatcgctttcatccttcaacgtaatcaaacacaggaaacatgaaatttggaaaatatttgctgatgatctcttccaaaaaatgaaatgtgtacttgattgggatttgggaatcatcatcctttccatccttcaactcaatcaaacatagagaacttgaaatatggaagaagagagaaaagaggaagaagtaccttgaggagagagaacacatgtagaagtccctctttcctccacgacggagattcagagctgcacggatagatagaatcgagagcctcctcaggatatacaactgtaataattcattacaaatgagttaaatacacagtctactacatacgcattcataaattcaaaatgtaaactcgtggaatgacctgctgctcaaaatcagcctccgaacttgaacttttggtgaggaaaacctgctcaataactggctcagtctggagcgcagattcacctaagtctgagttgtcagtgggaacccggcgccacccaagtattacatgtcccagcgattccgctacctggataaatgaaagtaacagaaaacattagtgtaaatatcacggccatgaattgaaaaaacaaaagaaatgaaaacaactaaccttctgaaactcagctttgctccgctcacggcgcttctcatcgattggcaggaagaccataccgacagcatactcgcctggctgcggtagctcaaacccagcatcctttgtcacctgcaggagtacaaacggtaacagctaagatgaattaactgttaaaacgagctgcctttgccttaaaattttattgagtttctagctcgcctctctgaaaaagttatgcggtagagccacaaggatgccggcaccatcgccagtgttcttctcacagccgcaggcaccacggtgcgccattctctcaagcatctcgagggcgtcattgacctgcagagaagtgaaatcagatcgatatcgcaaaggtgatgttcagaagagagaacctgcagagctaccacctaccgtcgcgcgcttgtaatcgcccgacagctcggcgacgaaaccaacgccgcacgagtcgcgctcgcgcgaggggtcgtacagcccaatgctgctctcggggagcgtcgaaagtggcctgaccggctcggcgtcgcgcgcggcggcgcggggcggccgtgcggcgacgcgctcctcggtgagctggcatccgccgaccaaaccgccctcgatggacacgccgccctgtaccagcctagccgcgcggtaaggcgccgccacggaggagtggctgcgccgagccctgcggccagcgcccgtgggcgccgcgtcggtgcggagcttgtaggccatcccttgcgccgccgacatggctgcacctcacgactctccctctgctacctgtcacgcggcatcaaacgacgagcattagaccgtacttctaccaccaggaagaagaaaacgaacaaaatcccatcacaaaaatacagagcagggaagagaaaaaaaaagtagacaaacgaacagaaaatcctcaaagcaatctccctttcccacatgtcaccaccaaaagcaacgggagggaactcgtgtcatgctgcgatggaacacagcacagcacttgcaatttgcaaaacgagaaaaatacacgcacacagggcaaacggcgacacacgcgggggatgaacagatctaccaacccccacacggcgacgcagattccatccgcccccacacgac

SEQ ID NO: 58627 - DNA, 710 bp, Oryza sativa
ccccgcggctggaagtagcagccgccaaccaccgacggcgggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagtagagctcaggcggcgaaggcaagaggaacaatggcgaaaggaaggaagcaaatccttttctcgatgcttttatacccttgccatcgctgggcctggctcctcgtttctcgcgcccactacctcgtccctcgtatctcgccatctcgctccctcgtttcccgtgcccccgcttccactaatcccattcgcccgcttacggcgcatgagggctgcaggaat

SEQ ID NO: 58628 - DNA, 8288 bp, Oryza sativa
ccaccaccaaccacaacgcacaacccaaccaaacaaagccaaaccgaaccccaaaagccgagcaacttgttttttttttcttttttggaaaaccgtctcccgatcctgtcaagttgggaggacgacgatgaggaagggtgcgtgcggccgagcgggtacctctcgctcttgtagcccggaggtgagaccgacgccgacgccgcgtcccgatcctccccacaccttcgcctcgcggctctcgtccccgagcgcggtttgtgcttcccccttctctcccgcacgcacggcggccttctctaccggcgacgcggcggacggcgtggttggcgaatgaatggatcggttttggggacgaaacggggcgccgcctctctcgcgggtctcttcccgtttcctcctccgagttgagcggcgactagggcactcggcgcctctgcatttatagacaggggaggggggggcaggccaacccatcctctctcctctttcgtcgctcgcgtcgcgtccccacacccgcactatattttagccaccgttttttctcctccgaattcgcctctttttttttccctttgttttcttaacattcgttggttgtaggttgtgacggtatctgcatctctacgggagtattttcgtacgggtccccgacaagatcagaatttggggtccaaagcttaagcccattgtgctgtgctagctggagtacgattgtaagtacaatggaatgaaagaaacacaagattgacgacaaccctactgtaccatggatcagttattacttcaaacattttcttttgttgtctactggagtaataaattggataggagtacttcaaacatttttttgtttggttatatatgcacgtatgactagcaaaagaaaagagaacgtctacatgagaatggtatatcgtaattagttttgtggttcattttactcatggtatattcttactgcatatacactagtagtacaaagaaaaaattaaggagattatcttttacaagcaaggacctacgcgcaatacaacaatggcacggggaccccgacgaaagaatctttttgatcccgaattaaaaacaggaaagcagttgcaattttgcaatcttccgtttccgctgtttttgcaatctctgcccccgcgggccgcggcccccgctactgtccaccgagagaaagagagtgaaaaaaaaaaaacaccgcgagcacgggaccaccgccaggtcagccgcgaccgcgacctgtggtggtggccatggtgggcccaccccgctccgaggagcaaacgacagccgcccgtggcgcgtggggcccaggacgacgcccgatccgacggccagggttcggccggcgcgccgccgccgcgccgacgccgacgcggggagccacagccgattcggagataaccacgccgcgccgttagcttttttaactcgatctccttatctggtactcctacgtaattaaattaaatcaaattaaatctctaatgcgggatttggtttgtaacaaaattccaaaaatcgcgatggattttttgtgtttggcgagtcctacgtgtcgctatcacgtcgggcggccgcggcggaggcggagagagaggcgcgaggcggcgagcgggtgggggcgtgacagtgtgcagaaggcggacgggcccaggcgcagcgagggtagggccccgcgtgccagtctgccagacggcgaggcggtgaggtgctttctggggaaagcttcttctgcacgtgttcgtcgcccacgccaacgagggacggattcgatagatcctggattaaaatgctacacgcacaggtttaacttttaacggtagagaaggaatactattatcggtaaggattactcttatttctttttacattcttatccttgcaatacccttctttacctatatcaaaatttcatatattagaggactactccctccatctacttttgatagtcatatttccaaatctgaaaattttatttttgatagacatatttcaatccaacaacttatcatcttaatgactttcttggatttaatgcatgactcttcattcttctacacatgattggctacatgggcattgagaaatataaatattaatgaatcgcttgtttacgaggaatgactagtagcatatttaaatagatgataagtagaattacttatcattggcctgtgtgccaagatgaaatatgattatcaaaagtagatggagggagtagtacattagtattactttagtacaactgttacagtatgtgcagcaacttatattttgtaataaagggaatattaattagttgttttgtttctatactaatgtgttactgatattataataatcattttattttgagataaagaaactatatcagtatatcaatctttaattaacatgttttatataaaagacacgaacattagaaaaggacctaatatcaaataactagaaggtgtggggcttcgaacctaagtcatttagcacaccaccttgtgaagctagctggaagacccctgggtgtttctcattaacatgttttattatagtttgttattatcggtccatgttttatttaccgaggacatttttagttattttatatgaacaatatttatagctagtattgtcatgagaattatacacaccccaccacctaagttagaggtatttattgaactcaaactattaaacttgcccagccatcgtactccttctgtcccataaaaagttaaattctaaggatgaatctagacatatacaatatccatattcatcctaaagatttgttttctatgggagagggagtgtatatgataataaaactactactcgtagtcaatatgaccatgctatgtcatgcgatcagaaacattatgttatagctagcatgctcatatccacttctaaaatggtgaaagtcaaatgatagttttccaccatcagcgtttgatggatcaagagaagttatagtatattcaaggtaaactagtgaatatggatgtgaagaccatataaataagttactagtgctagtaatatatttaacatcactggcctcgtcgccatggccaaaagaaatctgagaaaccaatcgttgaagtgttgcgcactgcatacctcatcaattaagattagaatcttgtccaccatccctattttagtggattacttctcgttcaaaattagcttatcctgacaagctgtaaaccaagattagcaccgctaaaagtaaaagatccaagtggaaagctgtcccaagttaaaaggacaacatattaatgcaagtgtggaaattggtgcatatatattctattgcaaaatactcctagtactccctccatatccctaatcatcttcattttttcgagccatcgaaaccagtactccctccatctacttttaatagtcatattttatctcggcacacagaccaaggataagtaattttacttatcatctatttaaacatgctactagtcattccttgtaaacaagcgatttattaatatttacatttctcaatgctcatatagtcaatcatgtgtagaagaatggagagtcatgcattaaattcgagaaagtcattaagatgataggttgttgaattgaaatatgcctatcaaaaataaaattttcagatttggaaatatgactatcaaaagtagacggagggagtactacttagtgttattcttcttttttttctgtattaataaaaaataaaagtagctttgtacaagataggactataggagtgtcttgcttaatttgccttttgctagtactcctatttttttaggactgtaggagtagttcccttgtctgtattttcatagaagtttaattttcgatgaatctgcttgaactgttgaacatgaatcccgttgctaacatccaaggtttccttgggagatgtatcacatggtcgtcgtatattagttgcatgactctttagagcaggtataatagtactgactcagccggcgatagtaatcaccacatcagcattatcatacgttgaggagggaaaaagcatgagagagagagaagcgagcgcttctccaagcaccagacgatagcacgataaattaggcaagataaaatattttattcgctttgtgggtctatagttcagttacttgatcttatgtgcatatgcatactgtgtggtttcaagtactaatttagtttcatgctgaagcaggacgggctacagagatggagtttagttttgatcacctgtacatgcaacaattaaacctattcttgtatccgtaaagaccatctagaaccaatcttttatataaacaatctacaatattaactttagatgacctagacatatactaccgccgactactactttcactattagccttgctcttatcagaccgtccaaaactttacactactgtatctgattggctcttgagctgtgacttgggggcgttggcaaggggaacatggcatggcatggacctcctgggcccacaaatagctgggtcccacgtagtaacgcggcagcttgctgcattgccacggatttgcacttccctgcagtcctccaccaccatggggcccatgccgacgcgacgcatgagcattttgggaaaaaagggcacatagttgaccacggaagcgatgcgcacagtggcaccgggagatgcgctcacacgtgacgccctcctgccttgtctgatccccttttcccttcttcctctcggtttcttcacgaggctctgtccatctgcctacaagcccaggcgccacgtccagatgcaaatatactcatgtcgtattaatcatttatttcttttacccaaactgaactacagttctaaccatcccttatttaattgaaatacatataggacctgttctgctatgtttagcagctgcgcagttgcagctagctaaaaaaaatactctagatgttggctgcaacacagtaaaaatgagtgcagtcgaatctatatagactatttgccctctctactaatttatgttttatgtgctaaaaatatactaaaagagtaaatgatttcaacgctatctaaaactaaccagagtagattggactgatgaaaaaatgaattcgaaagatggagtagggttggagccattccgcaactctccttgagacttcgctagttagattcaagtgtttgagttattggtggaaaatatttttcgttttactttgtgaagctctcgtcgaaattttcataggagtacgttttctcggggaactccaaacaaacggggctgaacacttgttcgacagatccaatgagcagtttgtagatttatttgtagggaggtgtcattactgattgagcattcccatgcttatcaagcaattctctaattcctcgggtatttccaaagtttgccgattttcaaggcgagtgctcagcctaggcttcacatggcatcgtggggcatcccgcatcccattagccaaatggagcggccatcaaactattttaactccacggtcggagtaacacatgttgcgtggcacgcttggtgaatactacgtccatctcgtatctaccacacgggttagaaaaatgtattgtaccggctcatgtctaacaagttaaaataagtaactctactcattctttttcaagtaaaattatgtgtaaaaagctctaacattggtcgctaattttagtaatacacttttatattttttttaactatcgtggtaaagaaaaaattacgaatacataaaacataataatacttccttacacacccacaattatttatatttttaaaatagagagagtatatgacatggagtaaattttgaagttatgactggttttatataaggcaaattttgctataggacactcaaaatttgtttattttgatggtagagatcgtaaaaatatgctagagatcgtaaaaatatgcgacggctgaaagatactctagaaaattggtaatttgctgaaggacacttctagctcaatcggagagacaaattcttcaaaaagacgggaatgacatttgggtctaaagctttttgagcccagactatagtgaaaatgaaacatgatgtatgctaatgatgtacttgaggctataacaaatttagagttgcataatttctaaattgttttactctaacaccatgctttaagcatgtggtcagaggggcattatcgtcttttttaagaatttatctctccaatagagtcgaaagtgtcctctatcaaattaccacctttttaaatgttttttagccgtgacacatttttcaatgtttgtcggcaaattacataaattttactcactccatctacttttgatagtcatatttcatcttgacacacagaccaagaataagtgattctacttattctccatttaaatatgctactagttattctacgtaaacaagcgatttattaatatttacatttctcgatgcccatgtagccaatctagtatagaagaatagagagtcacgcattaaatccaagattgttggattgaaatatgcctatcaaaaataaatttttcagatttagaaatatgactgaagaatagagagtcacacattaaatccaaaaaaaccattaagatgataatttgttggattaaaatatgcctatcaaaaataaatttttcagatttagaaatattactatcaaaagtaatcaaaagtaaatagtaaatagagggagtatgtgtcatgtaacaaaacttaacgtatactccacccactgtagtagtgggggacaaccgggaattcttgatggacccaccacagcacgtccaatcgcctccctccacatgcacctggggggaccaatcattgcgccctacaagttggtgagaaaaaaagaaatgcgaaaaagaaagcaaacacgcagcgtggggcccaggtgcttactcctacccctccctacgtgcttatataagcacacgtgtttatcagtatatatgccccccgctttatctatcctagtggaatcttatttcccgcgattacttatatatgcacaggaaaagagagaaattgatgcaggaaggaaggaaatacaggtttttgtttcattcatttgctgctgcatctgcctgcacggttgttcgttgcggagatggccgtgataaagattcttcaaacacctgtcactcccaccgcccgtgacgtgcaccgctgcacgtggtctgcagttgttgctctagacccacttggcaattttgctggggacaccccggaatggggtcaagtgaggactggccgagagaacatggagtcgtcttatccttctgtacatttttatatgcaagttattttagatcctcttgatttgaaaatgccgtaattaggcaaagtcatttacttttttttaaaattacatggtacaacacagacactcacaacgcacgcacactcatccctataaacacacgcacgcaaaaaccctacccctataagcatcttcgaagactgggacaataaatcctggagattgacgaagtcaccacagcatcttgctgtcgatgggtacgttgcctaccactaaaagcacaataccgataaattctaaaaaattcgctacttcttcttcttacttaatggtataattaaattatttatatttaaaatcagagaagatattgacatcttctacgtcttgccgcgaggccatgtatagctgccatgtctgtttaaaagctcaatattttataccactagtctttgtgttttttaaacgtgtgttagaagcacaatataaaaaaactaaaaagtttcataatcttatatggagtactatatgagtaaataaggtagtttgtgggtatttgggctatttgagaaaatgggataccgcatcatatatagctgatgcttgccaccaaattagactagctagtacaaatgtttgacaaaaggtaggtttgatttcagcattgcaaccacttggggctaccttggcggcctcaatcatatgttaggtggtcgacaactaacgcgccatgtatggtcgatcagttcgttggttctttgagaaaacattgaagaagttcaattgtggggtcaagaggtatcccacctaccgcgaagagggaaacatcaaaccattcgttgctactacctctagcccccccacaaaaaaggacaaaataagtagagataaattatttggcacgatatctttgtgaagtccaaagtttcattggatacataaaaactgaacggcatttaaataatggatgcgagtacaggctgcgcttcatgcaagtatgca

SEQ ID NO: 58629 - DNA, 3120 bp, Oryza sativa
ggtatttcagtcaactgcgatagtgggggaggtaattcatacttttttctttctaaaaaaagaaagaaaaagggtagcactgcgctattactggttttgttacatgttctgatgtcatagttgttaaaaaaaagaaaagaaaagaaaagaaaatacatttcaaatcgattatgaactattactatacgttttatcttcagtgattggaggtaattatacgagattgaaaatatacgattttcttaatttagctgggaaagtctaatttgttgctagtgttgctatgagaaagaaagttcaaaagaacccatccaaacaaaagatcctatccacatttaaaattttatgaactagagtgcatcggcaagcaattttttttcggaggcaatcctgattatttgacaaagtaaataaacgatatactatgttctggtattataataaaaaaaatcctttgcaaatacatgcgccattttctagcaggcacgctccagccaaacatgaactttggtcggtaccatatatgcttcacaaatatcaactatacacgcatacaaaatgacaatgtcatgtacaattaaatcgacataattgtctcttaacatctcatctcaagataacatatttatttaggtcgtcacacaacttacaccatacacatgctaaattataagacaatctcctaagagcaggtacaatagcagactataatccagctataaacatattttaaagagataaaagagaagagagaagagcagcgggctatagatatatagccagttatagcacgaactccaagacgtaatacgtgtataacacgtaggagcagttattaaaagtataggaagcaactattgtatgaattggctattacattggttatagatgatttggagctagtagttggctatactattaaacttactctaaattacatgctttcataattctccatccagcacggtgtatatataaaagatgcacacatgccttgaatatacaaatcatcataaggtttcgggaatgtactacccagattttgaactttcgagctattaaaatgataatgataggcaagtcctgtttccctattttggttcagaaaaataacttctttataaggatggaatcccaaaattgaaagatatccgtggcatcctccttcatttggatttgcagtgtcaagaatgtcatcgttgtcggagtcccactcaaatttatttactcgtactaccacatctttcttgatatcttagtgatttttgtaccagacactctcatattattcatagtgatatttcctaacgatgtgtttcttctaagcttcataatagttgtccatgtcattttgactgggatatccaaagtagttgtggtagtgcaaagtccacggaccatcattttgtatacagctttcctgacaccttagaaggaaactaagatcattgtcatgcttcagttcccatgtcatctgaccatataactcattgaggaaccaaacccgtagtcggtgctcaatatcgattaatgcatagtgcacacccctcattgatcttccgacaaaatggtttatatattgacatactttagtattcatcggtaactcaagtacttggtgcttgttattcgacaaggatattctgcattagaaaaaaaacaatatatgggtcataaataaaaccattgaaaaaaatataaagaaagaagagaaaacaatataagcacgataaaagtatgatgaacttgtacatcataataaaatctccctggcaatgtacataaagtgtcccatgccaatagactgcattatgatgatcatatggaaaagccaatgccatatcagtaactgtgcaggcagccgcaccgtctcgtacaaacaatcgctctccccattgcctagtccttgatgagaacacttgcaacacacatagtaacacacatagtgatggtggccgttgcaagctcttaagcataggatctagcacacgaaatcctatactcggaactcgtgggattttgaagatctcatagtgtgttgatatggtagggtcgaacacaagatagctgtcaaaccggtagaagtccttcatctagacgggctgaggtggggctggaggagaaggcgtccactgccgggtagcagggttagccacgccagactctagcagaaggagtctgttgcagtgatcctcgactaggttgtcgtcgggcgtgtagtcggtgaacaagccagagatggcgaggtgtgtggagctgggacgggataggaaaacaccgaatgctgcatctcatggaagttgatgtagatgccggcgagcgagagagggaggaggtcggctcgcagcaggcggcgggtatcgatgatggcgcgccatgccttgcagacgcagcgggacgcggcgagccatcgcggggcgaggcggccgaggacgtccgcgagcacgtcgtccggtaggagctgcgtcacgtcgtggtgcatagctcctccatcgaatctctctctgttcaattaattcgttgctcgataggtttttgggtgcgtgtacgcgtacctcctacttgtgggcggtctgttaatctatggacgagagtaaagcgcgattccgcgtttgttttccactccgagtaaagcgcgcgctgggcgctggagtgagagttttgcctgatacatacggagtcgatcgagggattcttatcggttggacttgggcgcaaatccgttctgctcccagacttgggcacaagaccactgcaatactaacacccagcatgaagaagccaacaaaagattggacggctgctgcatgcatgcatgcgcgccgtcgataccaatggagccatgagcaggcggcctgctgtgctgccaccgcgacaggttcgatgttggcgacctcaattccgatcgcaggagcaagaagggattactgatcgaatgtctggctggatgcatttctagttttttttttgggaggattactgatggtatagttgttaagaacaaaaagacgaaaaactcgtcccactcccaccacccgggtacccgccctctatgcgccacaccgctggcactactaaaaaaccgtttttgcaaacgggcagaatgcattttcgcatgcg

SEQ ID NO: 58630 - DNA, 1079 bp, Oryza sativa
tttttccatacggaccacttaaggggccgcatgcaaaaatgaccatcgatttttgcagacgccactagttgtggtccgtttgtaaaaatcaagaggtctcgtatagaaaaatcactttttttaagtagtgtgggccgtcgtacggcacgcccggagcatcatgcacctgtcttaccgggtaacgatcgagctgttttctttcttctgtcgttgttgaaagattttttttttgaaacaatgtcgtcgttattttcttagatttggaatatatgactcttaccctttcttttcgtatgcagatgccatccgctgctcaggagcagggttcactttatcggtttgtgcttttatatcggggtcaccgaaattccgaaattttagaaatttcggaaatttcggtccgaaattttgagcaaaatttagttgaatttgaacaaatattacccaaatttatgaaaaaactgaaaaattgaaaaattacagccgaaataatatcgtatcggaggggactgaaatagagatggcaacggggaattcaccgtcggggtcacatccacgtccccgtccccacagtgttaaaatttcaccgtccccgtccccgcgaatcaccacagggctacatttcacccacccccgtcaccacgcggtgaattaatccccgtggttaccccgtagagagaatcagagaagggacggcggacggcgaatggctggaggcggctggcggagagaccacgactggaggtggcgggcggcgcgacgaggctggaggcgatggcggcgggccgcgcaacgagggctggaggcggccggtgtcgcgacgaggactggatgaggcggtgtgctcggcgggacatcgcgcccgcgaggggacgcggcggcgcgttcttctggagcggcagcgacggctgtgtgggcggcgtggagttttggaggggagagggagatggttgactagggttggaatatatatacatgtggttattgggcttcaatttgttgcgccaaaacgactataaagtctaaaacaggtcctagctgctgtgaaatcgggtcaccgcggtggacggggacgggga

SEQ ID NO: 58631 - DNA, 3121 bp, Oryza sativa
atggggggaaagggggagggaatcacggggaataattccccccactttattgcgcgcggggacggcgggaggcggcgggattcgcggcggcggcggcgctagggcgcgggcgaggcggcgggagcggcgggatgaaggggatgacgggtgggccccacccgtcagcgagggtggcggacgggcccgcccgtcagcggcgcgcgcgcggggagaggccggatgggccgcggggagaggagagggaaggggaaggagatgggccgagccggcccaagagggagagggagggaaaggggactttttagagtttttcttttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcaccatttagaggatatattttagggtcgttttgggacgtgacaatggagttgcagttctgatggttcagttggtagcttattttgggtggatggagcctccaaagaagcctacaaaaaatttggtgattgtatcgtcttcgacacaacatactgcaccaataggtataaccttccttttgctccaatcattggtgtaagcaaccatggccaaactgtgttgtttgggtgtgtattcttaaaagatgaaaaagttcagacttttgaatgggtgttcgaaaccttcttgagagtaatggatggaaaagtgccacaatgcatcatgactgatcaggacaaagcaatggagactgcaattgcaaaaatactaccaaataccgttcataggcgctgtatgtggcacttgcacaggaatgctagctcaaaccttggtgtgctattgaaccagaaagaggggtttgaatttgatttgaagtcatgtattgagacctcgttgaatgaacaagaatttgatgaaagttgggatgctatgatcaatagatatgagttgcaggggaacaaatacatgcagcacctatatgagaacaggaagaagtgggccacatgttttttcatggattgcttcttccccttcatgtgcagctctcaaagaagtgagagcatgaacaatttgttcaaagattttgttcacccggtggattcaatcagaaacttcatcgtccagtatgagaaacttgcccaatcttgtctcgacagggatgaccaacagcgctacctcactgtccaaacagaccccgatatgtggtccggctacccaatggaagaacaagctgcaaagttctatacgcgtgcaatgttcagcaaatttcagcataggttgtacttgagtacaacttatcaaacaattgctggcccggaacctggatcatattttgtgcagctgattttaaaggatgacagtaaaaaattcttagttcattatgacctcactgaaagcttcagttgcgcctgcaacaaaattcagagggacaagatgttgtgtgggcatgctttgaaagtgatgtgaatgtgtatgtgctaccaaaaaagtacctttgtgatcgatggacgctcagagggtctcaacatgcttcaaatgctcttgtgcaagccaacatcgatgaggcatcaagcaagaaaatgaagtatgtccggctctgcaagaaatcagcctccgttgcagctgaagcctgcaaaacaaaagagggatatgagcttgcagtcaagacaattaatggattggcagaaaaactagtagtgattaacacaacaaaaaactccctctgtgagcagcactgcagtgttggatggtacccctgtagcagcaacactgaaagatcctaagaagaaggttccgaggggcaggcccaaaaactcaactaggttaaaatcttctgtgtttgatgataccagtggtgggtcaacaagccgtaaaaaaaggaagaaatcaacaagcaaccaaacctgctgatatgaggtgaaaagatggtctcttattttttttcccactcttttgtttcagctcagcgttatgaggaggaaattcattgatgagtcattccttttgcaggggtgaagaagaaaaagatagcactaagggatgtgggagagaaaagatagcaacatttcattttttttacatttgctgaatgagacttcttcatgtaataattcctcttttttggctgattggtgaaccatgttgcttgaaactgaattgaaaagcttccgaacaattgtgatgtatggtcagaaaaatgttaaaatgtggttgcacttgctgagaaaaaatgtaactgatacctgaattttatctgatacatgtactgtgagctggtccatgaatgaggtggtttgaattttatctaatacttgtactgtgagctggtcgatgaatgatgcatgtaccgtgtgctatcagacctgccaggtaccaggcctgggaccaggtctggtacctagtaccaggagtacatacttggtacctggtacctggggttactgctaggtaccaggcctggtacctgggttgctgctaggcaccagacactggtaccagtatttgtgagggctgataccccctatactgggtgataccatgcctggtgcctaggtttagacctgataccttggttttatgctaggtactaggtctgatacctagtagggactgccaggtaccaggcctggtacctgggtttagacctgatacctggtacctggggttactgccaggtaccaggcctggtacttgggttgctactaggcaccagacactggtaccaatatttgtgagggctgataccccctatactgggaggtaccatgtctggtgcctaggtttagacctgatacctgggttttatgctaggtaccaagtctgatacctagtagggactgctaggtaccaggcctggtacatgggtttagacctgatacctaggaccaggtctgatacctagtaccaggtactctaggtaccatacttggtacctggtacctggggttactgccaggtaccatgcctggtacctgcgttgctgcaaggcaccagacactggtaccaatatttgtgagg

SEQ ID NO: 58632 - DNA, 31161 bp, Oryza sativa
tttcgggcgagatgtgagcatttcggtgggggcgaaatttcgaaccgaaatttcaaaccctgtttgtgcttcacgttctttacaatcaagttaataatattgtaataagtaacagctaaagtagaggatgggattttcattgcattatcaaaaaaatgtatatatatattcgacgaatatttccaccggtttcacctcacaacataagctatagctatctatcttcatcagcagcagaggcagaggtgagctgagcacaacacatctccccttgagtagttgagtactgcacttgagtgatataaagcttagctagtatactgactgcactaagcttaaacctcactcgactactaccacaaaagtgaaatattcttggctagtctagtctactcgagaacgccaccatcaccatggcgatgtcgccgcacgaccagcacgagcacgagccggaccacgcccaccgctcgccgtccaacggcacggcagcgaccagcaccatcgccaccaacagatggggtccctactccggcgccggcgacttcgccagcaacatggccgtcatcctcgccgccctgctcgccgcgctcgccctcgccctcgcgctcaacgccgccgtcaggtacctgctccgccgccaccgccgggccaggcaacaaccagccgccgccgccgccgccgccgaggacccggagaagccgcctgtgcaggaggccgacccgccgccgccgcccccggctctggtgtactccgcggcgggcaccaagctggccggcgccgcggagtgcgccatctgcctcgccgagttcgtcgacggggacaccgtgcgcgtcatgccggtgtgcggccacggcttccacgcgcgctgcatcgagcgatggctcgccggaggccggcgctcgtcgtgcccgacctgccgcgcgccggccgcgacgccgcccggcgccaccgctaccgagcccgcggcggtggcgccttgatgcatgcatgcggccaactgatttggcccttgttcttggcaagctctcctctctcgctctctctctctctctctctctctctctctttcttcgcttctttctttcttgcttgctttcatgtgtaaatattcgtcaagatcgagatgatggatttgatccaactggatggatcatttggtgtctctctctgttttgtttggctgttcaaggagatgtatgaactgagagttttagattaggctgaaaaagtgaaaatgattcattactctcctgttcgattatcacaacatctgttcagttattggcttcttttttcccatgtgaactagtgttggtgccaagaaattcctctggaatctgggctcagatttgcacagataaaggtttatcagacagggcctttcaatgtagaggctgcaaatttgcttccaactccgggaatttgcacaacctgcagatttgtttacaggggagtggtgaaacatcttcattttttatatggagactggagagacatcctagcttgttttgtgaagggaaagaaaaacacaaacagttaggtgatcattcaatctcgagtattcaatatggtgtttatatcgttggtttgtggtcactcaatgtgtggtgtgcctcttgaatgactgaaatcgggaattcagtatgcatgtctgcttgcttaattctgacggaaaggcaagtgccactagtactctagtactgcctccgtttcgaaaatgtttgacgctgttaactttttagcatatgtttgaccgttcgtcttattaaaaaaaattaagtaattattaattattttcctatcatttgattcattgttaaatatatttttatgtagacatataattttacatattttacaaaagtttttgaataagacgaacactcaaacatgtgctaaaaaatcaacggtgccaaacatttcgaaacgagtagtatataaagttgcatgattctggcaaactttggtaatatctagattggcaaatgcatgataatcagtgctactttactattactacgctggatatttatacagaagcttaggttgtgcttagcctacgcctaatttggcaaagtggataatgcacatcaatctatcctgttgttactatccgacagtgagttgtcctgtatttctactcacatcgattgattcagagtgtggctgcctttgatgccttcagtcattcagatagacgatagttactgactctgtgttcaacgtggttagttctccacccaaacgacaatgcttccggttccagaccatttcatcgcgtgaaaaggttagcactaattagtggtggtgttgtgcatgaagatgcctgaccaaaattatggatagtcaaacagtagtcaaattgatgcgtcctcccgggtgttggataggagtacattgctcttttttccttttttgtgtgtgtatgtgtgaatggaggagtataatcaagtgtttaccgcaaacccgctctggcctatacagaaaggcagcccgcaaaatatgggcttcccacgcggcctattgcttcttcccgcttcctccaataggcctacagtgggctgacgatcaatatgggcctaaatcttagggatcgtagctggcccggccttttgtctgatgggcctgaattaaatcaggcccagtagtaacacatccatagtacgaattttttttatttttaattttttttattaaaagttttaaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccggcctccgcgagggcgattttgtactgtgcggggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattatgcattagatgtgacaagacgatcacgcgtgggcgtgattcactttatgtaaacaggcagcgccgaaagttgatagtgataactcgagctgccgcttttcatgtgtgctgttgtggactatgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagatgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgttgtaggtcgcactgctctgaagctaggggcgctcgaaggcaaacgaggtcctgcgaggatggaacatcaagttaccgcggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgaacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaatgggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactgtcgacctatggcaaacctctcggctgcccaaagctgaagcaacatagggcagccagcgatgatcgctcccgcgtcagttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgccttccccgcgcccgttcccctccctctcccgctcgcgccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgtggccgaggtccacctcgtccgcccctcctccgtcgaggttcgtcgccggagccctcatctccacgcgcacgggtgagcgccacctctaccgccgccttcggccatggatcccgatcgccatggtccatctctctctctctaattcctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccactctccgccgccggacgatcgccgtcggtcgtcgctttgcgccgctgccgcatgcgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaacggggatctgttcttgtggttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgcatgacactggtagtgggctaccccgacgcgccggagtacacgaccattccgccgctcagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttccactagttcatcgactgtctagtttttgtttgttagtttgtgtgtttaggttgcttgtttggggtcagttgacggtcgatatcatgtgtctatgatatggctgtcttaataaggatttttgcttgcctttttaagtgttttaattcagatcagaacaattgcagttttaattcctatataataaagcttagttcttgagcatctgtttttcttcttttccccgtctgttcttccctccagatggtctacaccaggactggtagccgcgcaacaggcgagggcagcaacggtgaagaacgcgctgatggtgtgcaccccaacggtgattctggcaatggtccgccaccacttcccgagaatccgacgcttgcccaagttatggcacatcagactcagatgatggccgcgatgatgcagcagatgcagcagcagcaccagcagatgcatcagaggatgatgcagcacgccgaacagcagcaccagcagtttggtccccctccccctcagtccaagttgcctgagtttctacgtgtcaggccacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtacggaagttacgtgggcagagttctgccgtagctttaggaaggcacaggtgccagacggggttgtagcgcaaaagaagagggaattccgggcgctccatcagggcaacaggacagtgacagagtacctccacgagttcaatcgcctcgcgcgatatgcaccagaggatgtccgcactgacgccgagaaacaggaaaagtttatggcaggcctggatgacgagctgaccaaccaactgatatccggggactacgctgactttgaaaggctggtcgacaaggcaatccgtcaggaggatcagcgcaacaaaatggacaggaaaagaaaggcggcgcagttccgatccaaccaaggtagtcagcaccgaccgcgcttcactcccggacagcagggtggacctaccaccatgatcgtccgacagcaccgcccgttccactctagcaacttccaccagggcgctagcggcagtcagaaccaccagggaggccagcccaaccgcggtgcagctccacgcccaccaatggcaccggcacagtcagcccagcccgcgcaagccaagaaggagacgggagcaaaaccagggtcttgcttcaactgtggcgagcttggccacttcgctgacaaatgcccgaagcccaggcgtgccgggctaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggatgtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcggatcgacgatttgtttgatcaactgaaaggagctaaagtgttttctaagatagacctgcgatcaggttaccaccagttgagaatccgggaagaggatattccgaagacggccttcaccactcggtacgggctatacgagtgcacggttatgtctttcggacttactaacgcacccgcattcttcatgaatctgatgaacaaagtgttcatggaatttctggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccacgctttgaagatctggaggcactatctgatcggcaaccgctgcgaagtatatacggaccataaaagtctgaaatacatcttcacccaaccagatctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgaacatctcaacgttggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgacttaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaaatggggacccgtttaaatttcagcacggcctatcacccgcaaactgatggtcagacagagtgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtaccttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtacaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgccttctccgcgcccgttcccctccctctcccgctcgcgccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgtggccgaggtccacctcgtccgcccctcctccgtcgaggttcgtcgccggagccctcatctccacgcgcacgggtgagcgccacctctaccgccgccttcggccatggatcccgatcgccatggtccatctctctctctctaattcctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccgctctccgccgccggacgatcgccgtcggtcgtcgctttgcgccgctgccgcatgcgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaacggggatctgttcttgtggttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgcatgacactggtagtgggctaccccgacgcgccggagtacacgaccattccgccgctcagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttccactagttcatcgactgtctagtttttgtttgttagtttgtgtgtttaggttgcttgtttggggtcagttgacggtcgatatcatgtgtctatgatatggctgtcttaataaggatttttgcttgcctttttaagtgttttaattcagatcagaacaattgcagttttaattcctatataataaagcttagttcttgagcatctgtttttcttcttttccccgtctgttcttccctccagatggtctacaccaggactggtagccgcgcaacaggcgagggcagcaacggtgaagaacgcgctgatggtgtgcaccccaacggtgattctggcaatggtccgccaccacttcccgagaatccgacgcttgcccaagttatggcacatcagactcagatgatggccgcgatgatgcagcagatgcagcagcagcaccagcagatgcatcagaggatgatgcagcacgccgaacagcagcaccagcagtttggtccccctccccctcagtccaagttgcctgagtttctacgtgtcaggccacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtacggaagttacgtgggcagagttctgccgtagctttaggaaggcacaggtgccagacggggttgtagcgcaaaagaagagggaattccgggcgctccatcagggcaacaggacagtgacagagtacctccacgagttcaatcgcctcgcgcgatatgcaccagaggatgtccgcactgacgccgagaaacaggaaaagtttatggcaggcctggatgacgagctgaccaaccaactgatatccggggactacgctgactttgaaaggctggtcgacaaggcaatccgtcaggaggatcagcgcaacaaaatggacaggaaaagaaaggcggcgcagttccgatccaaccaaggtagtcagcaccgaccgcgcttcactcccggacagcagggtggacctaccaccatgatcgtccgacagcaccgcccgttccactctagcaacttccaccagggcgctagcggcagtcagaaccaccagggaggccagcccaaccgcggtgcagctccacgcccaccaatggcaccggcacagtcagcccagcccgcgcaagccaagaaggagacgggagcaaaaccagggtcttgcttcaactgtggcgagcttggccacttcgctgacaaatgcccgaagcccaggcgtgccgggctaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggatgtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcggatcgacgatttgtttgatcaactgaaaggagctaaagtgttttctaagatagacctgcgatcaggttaccaccagttgagaatccgggaagaggatattccgaagacggccttcaccactcggtacgggctatacgagtgcacggttatgtctttcggacttactaacgcacccgcattcttcatgaatctgatgaacaaagtgttcatggaatttctggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccacgctttgaagatctggaggcactatctgatcggcaaccgctgcgaagtatatacggaccataaaagtctgaaatacatcttcacccaaccagatctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgaacatctcaacgttggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgacttaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaaatggggacccgtttaaatttcagcacggcctatcacccgcaaactgatggtcagacagagtgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtaccttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtacaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgccttctccgcgcccgttcccctccctctcccgctcgcgccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgtggccgaggtccacctcgtccgcccctcctccgtcgaggttcgtcgccggagccctcatctccacgcgcacgggtgagcgccacctctaccgccgccttcggccatggatcccgatcgccatggtccatctctctctctctaattcctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccgctctccgccgccggacgatcgccgtcggtcgtcgctttgcgccgctgccgcatgcgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacatcagtcttcgtgcacgcctcacagagggcacggtacgtggctgctagcacggcagaaccccagctccactgcggcacgtcctgtggctgagcatccgtgatggaccgtgcgtagtggaccagccggaagtccacagcgtgcccgtgggtgttagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaatggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtctgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacattgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatctaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgagcctcatacgcaccactgcaatgtgcactctctctaggaaccagtaccagctttcagtgttctcactctctacaaatgcaaaagccataggtagaacctggttgttcccatcacacccaattgctgtcaatatctgatctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacagaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatccccttcctcatcggatgatgcgtcgtcgtccgcttcctcattatccgaatcttccctctccatttcatcaacaattataccgactctctccccct

SEQ ID NO: 58633 - DNA, 87139 bp, Oryza sativa
aacatttgatcaatgtgcagaccagccacattgtcagatcactcatcgttgtacatctggttgttatcatgtcactttccgttaagaggttttggctgaatcaatgccacctgccatccatgatctccaggcatgtcatggtgtgtgggggaatctcgagctaggcaagataccatgtcgtcatcccaccgatcaacaatctagaatcttcattttaggctacaaggcgaaaaccacaaaaattgtataggtaactatacaatattttaccacagtaacttttttttctgcgaaaaaaagagactaagataccatatatcccccataaaacaattaatttaagtgctatgttcataacaaagtacatttatcataattgcttaaatcttactcctaaaatggtgggagtaatttttttcggtccctcttcaagtaactatgagtaaaactagaaattttttcccagaaaatgtcaagaatgggaaacggacctcaaatcaaatcaagtgtggtccttgacatgcatgttccctgttcattagtgaggacaccgaccctacgacggaaaggagtaggtagaagaaaacaacatcccgagaaaatgcctccccggagactccccaaaagcaatgcgcactttagcgctttgagagtccccacatgataaggagatctacgaattgatgcttgatcgatctctctttgccttaaattagcttcatttaactcgccacctctcgtgtttcaggcttccggttattattcccgacaccatcacacaaaaaggctaaagcactcgccagatttcaggagtagtagaatttaataattttttgctgcatgatttggagaattagtcccctagcatctttgtgttttgtatacttgtgtggccagagagtaatcgccatgaaagcagtaagattttttgcattactacttttaattattcagtccttgccttgcaagtctggatcttctttttgtaccgcatcatttttttttattttttttgctttccgctgatgctttgatgttgatgcctatcaacccacttgacacttgaaaatgcgccttgctatctttgagctcctaaagaaacgtgcaatcgagaaagaatcttgaagaagaaatgatcgagttgcctggccaaaattttacataaaacaattcaattcgtgtaagaaccagggaaaaaaaaggtgtatgctctacatttattcaagacagtgaaagtacatgcctctacatggggcataatattgttttctgtcgcggttagaatactggaatttgaataattatgtcctcgatcttgtacttacataggagaagcaagattcgaaatgaccacccagactaaacatcatatgtccctttgtgctttgcattatttttgctagtattggattggtcagaagtggataggtaggatgggtttatcagcttctgagatgtgatgcagctgatctcttcatgacttggcccagttacattgtactactgtgatgtaggagtactgtgtgataagggagtggaccaactgacagtaacatgatgataatccattgcctgtatcgtttccgggatgaaacagaacaccttgtatcttctgctgcagctatggatgctctctttcaggaaggaatcgtgctagtgtttgtgtgttggacatagcaggagaatttatgatatcaggttgctcaagttgggatcggcaagtggcaacagctagagcaatcagagttacaggtgcaaggcaagaagctagtagtacctaactttgctagaccatttgggacattgactgggatcagattaagcaaaagaactactataatttttttcaaaaaggagctgaaagtttgcttgtcaagcatggaagccattgctttctgcagttttctttcgttttcccaatggttcagagctctgttcccttcttgccttgattaagaaataaagcatactactccatattataaggagcaaggtttctcgcatgtcttgattaagaacagtaaaatttctgggaaactgtagagaagactccaaattgttgaggtcagatatagctgtggccttgcagcaaagtcgcaccaacagtagtagaagactattacaaatcatatactacaccactagtgtggttcagtcatgcatgtgactgttgcattcactggattgaaaggaggagagcaacacaagccatttttaatcttaagagccagaagtaaaccctccttctggctgacatttttattttgccatggaacagctaggcttagctgcaaggttgcagttctcatatatttttgtaaactatatattaatgcctgagccgtttgccttagaatattttgtaatgctaactgtcaaccaggtgataaattatacaatattctctgagattctactaaatgattatgcaagatgagattctgtttgattttttaatgtacagtttaggaagggtctgcatcctttggaggcagccaaggtacaacaagcagcaagacagaagcaaacaatttcttctttcacattaataaaaaagcagtactaccttccaacttcatgacatacaacttgagagaaaaaaaaatctaaatagaagagagttggaaactgcctatgacctcatgaactgctacatgcattacaaaaacaaaaacaaaaggcaagtcagacttagcaagccatgagataaagataccctgaatcctctctgttttcttcagattattgagcaaacaaacaagtccatattctctttaagccctgatttattattgcctcacggcctcgacttgcctcatctagaacaagaaattaaaaagaggctattactttaagccgaaaccaaacggcaaatcgatcacgaaaccaccaattatacaacggaccctgcagctggttcggagctaggccccccaagaaaaattcaaagaaaacatgcatgcagcctcatcctcacatgccactcgaccaaagatccaaatgaaaaatccaacttgatttggcgcattgccatgcattttcttatactgccaaggccggtcaagagcgagctagccatgcgagcgtgaggtccagtcatccagcattagccggccggccggccgctttcctttatcgtttctctaaatacgtcgtcgaattgcctcatcccaataaacatttgcacggttgcggcgtcgtttctgccacaaaaccaaaaaaggaaaaaaaaagaaagaagttttcaaaaaggaaatggagtcgtcgtcggcgttggaattatattttctttgggagcaggagaacttagagaggtgtgcaataccacccctcagttgcttacgacttattataaaccgtaatggttttttagcgaaaaaaaattacaagtaaaatttttatatatgtattcttaacgacttaaaaatccaatgtttaaaagaatacgttgaaaaaaaatcaaaatcaatggcatcttttttatatatgttcttaacttcaaaaacaatgttttaaattttaaattttagtattgatttgtaagtcacagggcacatattaaggcccgcaaaatggcttctttttgcttttgatttctggtgcgtggtcagcttcgcatgcagaatcatgggcaggcagcacgcaggacggggatgttttccggtgtgctgcgattaattcagtgtgcgtggcgtacagagaagtcagggtcagaacgaactcggagtctggaaggcagaaggcgtttgcttttcaacttctgcttgagctgtttagcctcttttccgttccttgcaactagaacacctcatttccacgcgctgatgcacgcagccacctacggtagggccgttgcccatatcttctccaggggacatgacaggccaggggacatgccatctacaggagcagagtgatgatgttttctgttattatctgctctagatgcaatgcaagaattgtcttcccggtgatgtatatattcagagaatgatttcatttgaggtactctatccgtttcaaaatataacaacctatatcgtaaatctaaacatttcataggatagttctaggggaaaaaaatcaatttcaagcttcaatccatcagggttaagaacaggagatttttttttctgtgtttggatatttgatttctggttatctagagaagttgactttgctctagagaaaagctcacacattttcgcgaggatatacggcgctgtggaccagggcgatgggaattttgatcttgacataaccaacgtgagaacgactcttctgttttccattggataaataaatgcctgcactcagtgtccatttcaagatatgtcactgtacacgaataaattacaatgtggcaatcgaattgaccgatcaacatgtactacagctatgtttagtttagcgcaaagtttaaattttggttaaaattggagatgatatgactgaaaagttgtgtgtgtatgacaggttgatgtgatgaaaaaggactgaagtttggatccaaactttggatttaaacacagcctacatatgtgcgtactgtagctataccatactgtatctgcgcccatacacagcttgtggctgtgtttagttcagcgtaagattttggttaaaattagagatgatgtgactgaaaaattgtgtgtatgacaggttgatgtgatgaaaaatgactgaagtttggaccccaaactttgaatctaaacagagtctgtgtataaatcggagcgaggcacaacttcgtatgctcgtaactggtgggcaccaaaataaaagctagaagccgtgcattttacctaacttcacaccagtgattgattccaatgtcaacttcaagagatgtcacgttgctattcgcatgacggagtggggggcagtagtaggcttttactgctgaaccgacacaattgagttctggtgaggtgcaatttaactgtgatcaatgatcgatcagagttcggggtttctacaaagccaaacgccaagggtccacgctagaaagaggttcagcgccggacaaaaacagttcgatccaacagctctcagtttggaagctgtagcacttgcagtcgtaaaataggtgaaatatcagtgtgtgcaataataacactgcctgtctctgccccctgaacctgacgtgcttgcactgcaggcagtaccactatagtgtactaggagtacgtttcttgaattgatttcctcggatcaagagacgcacatatcgcaggtttcaaggtggtacggtgagagtacgcgtatatctttcgctgatgcgatgattgcagcggaagatctcaagataagaaatcaacaagcgttctatctcgatcgcctggaaaactgctactgacaactcctccacgggtgagtgagaaacggagaatgtgagatccgagggcgagatttgtttaagttgtacacttggcaaattaacaacaaacaaacaaacaaggtggggtcaaagttttctcaaccctcacacgctcctactcgatctcttccatcgcgttccactgggaatttgggatggatatataatgacgtcgtcgcggctcggcaatggccacgaggccaaccaacgcataagttccaagcttccaatttcccgctgcattcctgcagccgccgcccacgggaacagccgagccggtcccgttcgcccatccgtacgtcaccccgtcgcgctcgcgcatcgcacgcacccacccgtcgtcgcgcgcgtcaccgtacgccgcttctgtcgccatggcctcctgtgagcgaggcgtcaaacgtggtacacgcccaggtagggagcagaggagaggagaggaggggacaccaacattggccgcggccgcagcggcgagtggagggatgagcgacccgcggcgtcgcccaaggggcgcgcgtcccctccgcatgcatggcggccgccgggcgaggcgatcgcgcatgcacgtccttgcatggcggacggggcctaccgccactagcggggaggacacaataatgcgagctcgatctatcgctatagattacggactagtggtaggataggtgaattctgttgcagattaatctactatagtatagtccttggcacaatttgagttcatgataggctattaggctgtgacgatgtgttccttttagattcgacgtagatggacaaaaaggtctgtcaggtgttgaccatttacgtcacgactatgaaaatggcttctggcgagcggagagagcatttggcctgagatatttttagcctagcaatctagcatggtgccaaacggagttgatgagcctagcgaactgtacgagactgacgccccttttcttcacaggaaagacatgtcaaggaaaaaaaacaaaacaaaacaagaaagagtaggataatcgaggtatcaaactaaaccgagcccactagcccaccaagcccaagccgggcccagccttgcttgggctcacccgtaatcctttccccagtcccagacggaccaggccgcctggcccaccccactgctttggtctggtctgtgcttcaatcatcgtgcacatgtctagcacacttcatatgcacttcaagcacataatattcacatttccaaccaaaaggcctatgcacggagcacattcaacctgaatggcatcacctatcaacctgtggcattccaagccactgcatgtccacaagaaaggatgtatgtagtagtagtaaatactggagtggtacaaaatggccacattcacgttccaccagcttttctacaactagccaagagcccgtagacaaactaagtttctaacttattaaatcaattaataagcatatatttagtctaagtagtattatgattttccttattgaacaagtaggtagattagggaagttctattgattgctgctttctccagaccgccggaaaaagcatgaaagaaaaggctcgaattgtacgatccctccgtcacttagattgaaaggggtgatctttttttccgaatgagaaagcctttggccttgcaaatccgtttttgccgggcacaatagacatatctgctcagtcacaacataaggaacccccaatgttccgataagcctacccggcctgacagctttagttgaatgatctgatcccgaagctaatttgagaaggagtcaatagtttcgttcaaagaagagtcaatagtgaaacaggaaaggacacgttaaagggtatagattatgggtactaaatgtcagtggtttgagtagtgtgacacaacaaacaccaccactatagtatacataagcaggctttactatcccatccgtgcttcttccaaaagaaacatcaaaaatacatcgatgtttctaagctgctagtcctgcatacaaaactaagttgctgctttcaagatgttggcaaccaaagcacacccaaaatcaggaatatctattacagacttgcagtgttctctaacctcaaagcaatgcgtgaccaaacaaacgctactcctgcttcatctttgattcaggctggtagcatggatgcagcaacacatggatgcacaagagccagcagggaagatggacaagaaatacatacagatatgtcgcgctgctccattcccacaagaactccatccacagccagaaatcaccaacaatgtctactgtccatgatcccttggatagacctttcatgataagaaatgcagctggagggaaacccaagacggtgagaagtatgtttgaggccaacaatactgtgcgaggtaggaaattcatctcgagctgtgccctcagcggtcgagaaaacaagcacattgggatcaatatcagagccccaagctgagcagtagcaaaatttatgatcgacataagccccattcctatggtgatggaagtgatcatcgtagcttttagaagcttccattccacaccagcacgggatggagagccaaacattgcatacaggatgatcaatatagtgatggagagaacggcccaaatcactgcatactgtattggcatagcaccaggaatttggctaatgtagtatgggagtaaagaaacaagtactgcccaaaattggatgataagtagtactcttgcagatttaagccatttccacgatccaccctccatttgcaggtcatcagcattaccctttgttttacattcatcctccaatttccccttggttttactaccaccagcaagagcagcagcaactattgggaggggtgccaggagtaatgcaaacggaatcatatatacaccaactgaaatgaacttgcttggggctgtaaggaaatacaggaaaaacgattgatggaacttctcgagcaggttatttacagagcgcaccaccccttcagttaacctgaacaaaaggcattctcaaacatgtttagataatcttgtggtgagatcaacataaatgctgtgctaagcatctgctctacaaaatgcagcaggtgtattttactcaaaaataaagtgaaccctttaatatgataagtcagaggtcttgtgatcctgctcctttgttaagttcagtccaaaacttcatcaatttgggggaaacgccaatataccattgcccgcccccttatcgccctatatgaaaataccgtgtgttgcgacaatgacaggtgatgtcgggtatggcatgtcattgacacacactggtgtttttggcaaacttggattcaggcaaaggcaacagtacccttcccttatcgtttccattttttttcttgaaataagttaaattgtatgttctatcattggataagatcacagtatgctaatgccattagcaaatcctactatggaataatccagacacacatactgacataaggacagacctagcaaatttttgactgttatgaggctgacatgcaatcagacctctcaccagaataattccgcacaagaatatgcaaggttaacaggccaaggcagttacagaattattttataatcagccttttgttgcctgagattatacagctttagcatcgaacatgtgctttaatgctcactaatagtatattttgacaataaaattaattgagcatcacaaagcaattagatatatgaaattaggtaatgtttgacaaagctgaattactttggttatcagagagaaatacatacatacaaatggcacaagctagagtttgtttaaaaccttcagtatgtattcagttttctggtatctgacaatcaaacacttttgaataggtaaacatgcactctaattaagtaatgaactgcttaatgcatgtcaacaatacctacttggcaacatatcctatgcacacaggccctcacgtgtacacacgtgtataccaactaaaaaatgtcaccaaaaaatctagaaaaaatcatacccatactttcaattgtattacacctagggttaaaatcttaacgtcaaattcattatattttagccgtaacaaaaaatctgacagttttaaggttgtaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgcataggatacgctccctacctacttgctctaaaaaagagcagcttaaaataacacaaccgtaacacaatagaaactgaccttccacccctgagaagaaatgaagatttagcattctcgtttttaagatgaaatgctggtgcaaattctaaagaaactgcatcaacttgatagtcacggaaagcaccatgagaacctgtgggcactccaagagcctgcagttgcaaagccaaacaagaagggattaacagagttgaaaaaacttatatttttatagaccaaatggaaatgaatgaacaatatatatttcaattacctggttatacatagaactagcaaggtttgcagtaccctccacataatcaggaacggtcacgtcaagcttccagtcaggatttatttttctcaacaaactcccaagattttgaaatacttcagcaataaccctaagccatgaagagctcaacaaggaattaaatgtctcgacattcacgcgaaaaccttgtctatgaacagctaaatagtgcaccacattcagaaggtccaagtttggcatttggccattagatgcctctgcatacatcgtgacactatctctatcaccatatttcctggtttctccaactttaaatatgagtgcagcagccattgttccagcacgtttgaaagccataagttctgccttttctgcagtgccatcaggtttatataaaatttgatttgcaccatagatcttggtatccaaattcactgggtgactcagaaacataggattatgatactgatttaaccatgaagagaccgcagagtactctccaaattgtgagtctgcagacagccagacaatatcctttgatagccatgcagctcgacttaggagggagaagacagagaatccaagtgcaagtgataataattcatttggtgtaactttctgagaattataaggagtaaccagtacaattgcttctttgccatcacctcgtggagcccgtataatgccaactgtgttaatgccaaagttggtgtaggttccattgggtttggctgccatattatttgtcatggatgtaaagaacttcagaggatgaaaacatttgctgtcagggaggaactcatggtaatacacttctgctcccagattttttgtttgttgtgctatgaattttgggatctccctacaataatgcataaaattagacattgagaaaatcatataaacttacaagctatggaaaacataggattataccacttgttccttcacttcttgtaatttattatcacttattcaatgtgcagagtatcatcatcattgcacaaacttataatttacttttagattaatatttcataagcaaaaatgtagaagttatatttacatgtgtgtctcaataggaaaggacatgacggtgcttgatgatgctctgaacttatgcgcagcatccaccattctactcatgtgctagggtttccactcaagtgcatgtatggtgtgcgcttgtgcatctacattgttttctcataaaaaacctgaactttgtatatctctgacttttattttatcattcgtttgttactacccatgaaaaaacttctttgcgtttagagttatgtggataccatgtctatgctcaatagtataactaaaatgcggtattaaggatgtatttcatcagaggaagccccttaacagtagactcaaaatagagcatcacatgataattaaacattatgtacacagtgcaatttttgttaaagcccattgtctatgaaggaagcagaatatgaaccaagggaactctatacagaataacatacgttgttccacctcttgattccccaattgcagcttcaattcccttcgcaaatctgtttgcttcctggacatcctcagtagaaaataatgtattcgcagagcctacattttaaaacaacttaatttgcagctaataccaatgagaaagaagcgtctgacaatcagcatcggagatgattgtttcatggaatagcagtataagaaaaaagcttaccgggtataagagcgttctctgataggtacgtgttcttggcaagcgaagggaggaagaggagcgcgattatgcccgccgtacaacacacagcgctggtcacagagggtgaacaatgtcaatgtctcagacagaaagaaacaggagaatcaagattggatcaaagacgaagagatgagagcgaacctgaagagtatgtggtgcgacgcgaggaataccccgaggcggacaatgaggcgcggcttcggttttgcctcctccttagctgacgacgccatggcagcaacttggttcaggtctggagaccgggagactaatcttggagcggcacagatcctgtctaccctcgccgcgcggggcaggatcccatcaaaaactgccacagagctggacctccgcctccgcgtgagcttccacaagtagatatgccgatggagagcagcgggagcgggagccaccagcggttctcccggctggggaagggatgcggctccggcgaagtggcttggtgggcaagacgagcggatgcggcgtggccagggctccgcggcggcggaggcggaggaggagagaaggcgagcgaagcgggcggcgaggggaagctgctccgtcctacctgctcgccggaggtgggcggggggtgccggcgagtggtcgccggtgggtcgccgcctcgctggagatcgcggcgaaccggcgagtgaaggagatgggggaggggcaggcctggccgcgggccgtcagaagtaaatgggtccagagagaaaccggctcgtggacgggcagctcggcccacctaaggcccacgagtcaagcgaaatatttatccttcttttttctaaaattaaagttttcatgactggcaaaaacccacaaaataattttgggtactaatatttatcgactgaaaatttttcacctgctgtattgtttttccacgcttgtaatggttacctctcgttcacgattgctcgttgttggattttcgttaatgatggagaagaggtgcaaagtagaggaggataaggagtacacacgactccgtggtggccaaggaggccggccttgttgagctatcggagaccttgaagagtttgtgtcacctcatcgacacttgctctctctattgtcaatgtgtcacgctggactttcccacagaaagccaaaagagtcaggacatctttccctcctaactgattggcttatttctcctcttcttttaacccatcgtctcataattatgtctctcaatttcgaagggaggagtgctgtagctactctctccatctaattttgatagtcatatttcatcttggtgcacagaccaacgataagtgattctacttatcatccatttaaatatgctactagtcattcctcataaacaagcgatttattaatatttactccctccgtactcgtaaaggaagtcgtttaggacagcgacacggtcttcaaaacacaactttgacttcttgtttctataaaaatatttattgaaaagtgatatatgtatacttttatgaaagtatttttcaagtcaaatctattcatataatttttgtattttcaaaatcaacaacttgagagttattaatgatttatatttccaaggtttgacttaaacattgtcctaaacgacttactttatgagtatggagggagtacatttctcgatacccatgtagccaatcttgtgtggatgaatggagagtcacgcattaaattcaaaaaaatcattaagatgataagttgttagattgaaatatgcctatcaaaaataaatttttcagatttggaaatatgactatcacaaatagatggagggagtattaattatagataaatgaaacgggtaggatgcatggattgttaatcaatgggtgcattatattggctcctcgaattttgctatagctagctcaaattttgaacacagatcaattaaaaaaactaaatggtgaaaaagaatattgtgcctagtcgtactcatcgtgatgaagtttgtccgttgtgttttgtacgtgcctatgacatttttgttcgtttgtccgttgtttggttgcataggagatcaaataaattttactccgtgttagatccctcgtctcttgatatttgacaatttcatccatgaactgagatacagatatgtttttttttcgaggtttagataatatatacaacaagattccccccaaaaaaaaagatatacgactagattggccaataataattttccaagcacgagaaaacaaacgtgactacacagctagtggctaccactctatttataaagagaccatatccacctatacttcaaataaaattttatcttaaattactcatacgatctacgatccgattacaccgttgtgttcgtaacaattaaatctttataacaagatctcacatgattatattttgaggaaaaattataaattacttttataatatatctaaattacttttagatttcactaaattacttcttcgatatacaaaagtaaattcaataaagcttaaaagtaatttacatatattatagaagtaacttataaaaaaagaaagtaactttaatgcatgtattttttcattggatatgactgcttgtttgtactccaatagtatatatcttttttaatctctttaataacttatatcttttaaatcacatattgtttttaagatctatttgcatcattgtactccactcaaaatatgtgacaaaataatattcatattgaatatattctcattttattaatttaaaagtaatttattacatgttagaaagtaacttccatgttataagattatatcttatacatggttaattcttatgatttattctatcagtgttatttacaatccatcaaaggtttttatcttcttttttcatcctacatgaaaaacaaaaataaaaggaaaaaaacaatcggtgattaaacatatgtatagagagttacttctaaaccagaactatgcaaaagttaattccaattaacattgaagttactttttaaaattgttaaacttacgtgtgttgatctgtgctgattaaatttaatatctagataaagtcatatttttatccctacaacgaatctacttctaatgtcgtgacaaagttacttccgttttgtttttagatatttttataatatatatgtaaattatttttagactttattaaatttacttttatatgtctaagaagtaacttagtcaaatataaaagtaacttatatatacgataaaagtaacttacacatataataaaagtaatttacaaatataaatattttttcattgtaatataatcgtgtaagatcttattgtgaagatttaattgtaacgaagacaatagtgtaattggattgtagatcggataggtaatttgagataaaactttataaaaaggaagaaaaagacatgcatgtctaagaggaaaaacagcatatacgctaacacgtgtagcagtactttttctcataattgtttcgtcgctggttagcactaaatcgagagactactcggtttagattttgctgaaaacaaaaggcaaagaagactgggatgaacatgggcctttttacgctttgacttcaaaggtagcccaggagaagcccgataatagtcaggcgaactgccgattgccgaagggtctctcacactctcacagcagcatcgcacggtcgcgcagaatgggcagaagagaagatgtcgtcgaagtcgaagccaaccaaaactgtgccgccggctgctcggctgcgtacgtgcacggcgcacctgcgaatgatctggccaccgccaccgagcggcgcgcggtttgacccttgacagcctcagcccgcgtctcggctctcgagcctcgcgaggagaaagcgaccggccgcgtgccgccgtgcaggagctgcatcgagaggctccctgcactccgcgcccaatcctgaaaaatcccctccgcccgccccgcctccaccccacgtcctcctcctccccagcagtcccacccgcgcacgcacgtcgatccgggagagagagagagagcgcgatgacgccgctccacgccgccccgcaccatgccgcggccgcggccgcggtcgtctcctcgccctcatccgcgccgctcctcctccgcgccaagccttaccaccccaaggcggcggcttgctccttcaccgtgaccgccaccactccgtcgaggaaaggttagcaactcagacatcattagaaaaaaaaaaaaccatctaatatctgcgtgcgtgcgtacgacgagaggtcacggcggcgcactgtggcaaccaactaggagtactttggctcgtctgcgctggtctgtgccgctgtgcgcgcactgtttctcttctcttgtttattgcttgcttggccttttccgtgctcgcgtaagcggataagggtcgtgtgccatggtgttttgcaagcgtacacctgcccctgcgtctgactcgacgagccgtttctttatcctttttttttttagctgcagagagcaatgtttgatcatccatataaaactctcgcgcatccgtttttctctctcttgctggggtcaagaggtcaatacacagttcggtccttcaaagatttggtcctttttgctatagtttagatcgtcgatttctcaggttcttgacaccgcatggatggtaggatcaagaaaggcatcgccgcgcaagtcacgattcctctcgccattttaactgatcgccctgtttctttctttgcgccagctttcctgtcgtgcccggatcacggccaggcggcggcgggggcggcgccgccgcgctccgccccggcgtcgtcgccggcgctcatctcctccgtccaggacctgtacgacttcatctgcagcggcccgctcgtggacaggatcgggtacaccaaggagaagatcgccggctccatcgaccggtggctgcgctgcggtgtgcaggtggcccggctgttccgcctcaacgagctccacctctcggaggcggagaaggccaggatataccacttctacatccccgtcttcctctggtgcgaggaccaggtcacggagcacagggccaagtacaaggacggcgacgagatccctccattagtggtatgcacatgaaacatttttctctttatcatagaagaagctgatgaaatctgacatgtagctttgtccactagtgcctgatagcatccattccaaacctctcatggcatgttccatcaggtggacatagcagaacatattcctctgcattatgagtacatcgcacaaaatatttcatcatgaagcatctattgctttaatcagcatgacacgcactcatggatcgttttatcacgaagggatatattaattataccgaaatgggaactgtgaatatcaagtcacaagaacggacaagtctttatctgattctaattcacattttgtaaatgaatcgtctttgtgtgatgtagattggggtcagcgctccccaaggcagtggaaagacaactcttgttttcgcacttgattatctttttcgggttgctggtaggtgagttcttcttgtcattctagtcatgttatgtttacccgtatcaatgaaatttaaaagacaagacttttccgtgccttaggaatgccgctacattatctatcgatgacttctacttgacggcagcagaacaggtgtgagtcttcaaatattgtgcaattatccgttctgttttactactccaagtacttggcaaattagtgaaaacaattaatgaatatttccagggtaaattgagggaaagaaatcctggaaatgctcttttggaggtacaaagaacaccccagatccaatatacactgttttggttcaagtattgtattgtgaactgagagtaaataaccaaaactttacagcttcgtggaaatgctggaagccatgatctcccgttctcagttgaaacacttgaatcgctgcttaaactaactaaagaaggtactgatttttgacaagtatatatatcctcttcagaccaattttattatatttgaacagccttgcacatagtatattttttattttggagaatttattgaaatgatatgcatcctagtttcaatgtaaaatagtttgtcactgatattacaatatatttaggtttgaagatgaagcttccacggtatgacaaggtaaaaggttgcagttatcgtcgcctagatgatttttataattgagtagctgcatgatacatgtcacatgtccatgtagtctgcttttggtggaagaggtgatcgggctgatccttcaacatggccagaggttgaagggcccttagaggtaagctcatgttgagctgtagggctttttgagatgagaaaattgtaatttttgaacattttctatgtctgttttctctgtcctaggttgttctttttgaaggatggatgcttggattcaaacctcttccaaatgaagttgtaaaagcagtggaccctcaggcgggtttccgatattaccacattatctgatttctttgtttctcttttacttaatatgacttgccttttttcatcttcagcttgaggtggttaataagaaccttgaggcatactacgatgcatgggacaggttcattgggtcatggatggtcataaaaataaaggaacctagttgcgtgtaccagtggagactgcaggtcattaccagatttatctaagtaactaatggtgtcagaaaatgcacaaccatgaattgcaattttcttatgttatttggatttacaggcagagatagctatgagagcagatgggaaaccaggaatgtctgatgaggaggtttgtttctcacatagctatgcattcattataacatcctattggcttcctttccgtcctagtttgataatttgctaatgccttgctgttactaaccgtcaagtaaagtagacaaattgccaccaattaggaatagctcccactgaattcagttgtggccaaactgagtaagtacaccactcacatcagtacatttgagtaaaatcttcagggacgcaaaagtacttgctactcagtgaatcacctctaaaaacctattcatgtaacagactggttttccgtgttgaaaattgaaagaaaacagggaattcccgtgattggaaaaagaaaaaaactgcatcacttcacctgaaagttgagcaacaagaactgttactagtattgaattatctgatgtattcttcagtgaacaattttatgctattcactgaagctcattcgagtcttggattctctttctaatgcatttgatgagctaggttaacatgcttctggtaattcttgcaggtcatggattttgtgtcgcgctacctaccagcataccacgcatatttgcccactctatataaagagggaccaaacggctcgaacccagaccacctgctggtcgttgacatagacgaaaagaggaatcctatgtggggtagatgagccctgaatgtacattgctgaaagaaaatggatcttctgacccaatggtggagtttgggatatctgatctttctgagaccacatattccaagcaagcaccactggcctcttgtttcttgtggcttgaacaagtactaaacgtgtaaaactttgatgtatacgaaatcttgctattacttataaggaaatcggaatcccaattcattttgctgagtgcatctgtgataccgtgatgtgatgttgcatttgggtgttttggaatttggacatgaggttggtgtatactatcgacaggaatatatataattttataatcttatagtatgcatgatccgttgtagtctagctggttaggatactcggctctcacccgagagacccgggtttgagtcccggcaacggaattttttttgttcagagggcgaacagatttttgatttttttttttttgttcagcttgagggcttattcgatttgtaggattttcaaaccgtaggaatagaaaatacataggaataatgtgggaatacatgtgcaaacctatagattaaaaaacatatgaaattttcctatggttaagttgcaaacaatccaaaggattgaaaacattgggttgttgtcacaccccaatctttttttttttggttcagcttgagggcttattcgatttgtaggattttcaaaccgtaggaatagaaaatacataggaataatgtgggaatacatgtgcaaacctatagattaaaaaacatatgaaattttcctatggttaagttgcaaacaatccaaaggattgaaaacattgggttgttgtcacaccccaatctggcaccgccgtacaacggcacctgacaggagcgtgtcgtaggaaaacggcatgaaccgtgtcctacgaaaccgcgatctcagtaccagtcccaggacatagcgctggtacccacggtgacaaacatgaatcattacaaatccttataattaatagaagacttatttaccttaacttagattgcagctcaaacagcccgagaatgcaaccgacgacacggacgaggcaaacaccaacaacagcagcagcggaaccaaccaacggactaacacccaacgccacaggcaacggcagggaactaggacgaaatcctaatattcacttcacttcaacttcatcttcagagctggcagaactatatttatatagagagcaagggtgagtacttacgtactcagcaagctaggggaacttaggtggttaatgcaagcttcaagggaaggctgttattttgcaaacagttttgttttcaagttttcaacaatctaagtgtgtgctttccacaaccagagcgagacaagtctcagctcggtcgggaggtgagaagtaacaaatttatttatcaagatttgcacaactcccagagttggcttcaaatctggttttcccaaaccaaaccaattttccaaacttcccgataatagtggtccccaaacgaccaatcacttccagggactcccggtcccactgtcccccggatagctaaatgcttcccaagcattaggtttccaaaacttaacaccttttcataaaacagggtaaaacaaaaactacgctaaggaatcacctcacatccgcccatgaccgtgggcacggctgtttgaacagtttgttaacctctgcagagggggtacactttacccacacgacgttactaacccgggtcacccaacccgtgcagaacagccacgtctggcgactttgaggctttcacgacaaggcatttccaaagccgacacagggttgccatatgccaacgagaggggtcccagaccaacaacaggttaggtcccagaccatactgtgccaggaagcccgggggttctccccgacaccaccccgttgaatccacatgtctcttggcatcaaggcacccctgattagctacttactcagccaggggcgtcccattccacccatgtggtcgcactattgtatgctcggatgtaattccaaaggaatcggtccttagatgagaccgcacaagtattccgcccaggaatggccttgtgtcgcgagttttatttttaaaactcattttctttcacaaggcaccgacccaggcgtcgggttttccaaagcttttgtaaaccaagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccaccggtctgccttgcagacggggcaaacagattaagtgcaatcctatcaatgcataatattttgcaagcaatataattaagttcaaatataggctcaatatgttcaaaggtggcttgccttgctcagggtcttcacgaagcttcacaaatcttcgagaaatccgcttgaagaaaaatatccgataaccgcaactaggcgcaaacaatcaaaaacctaagcaaagaccaaataaaatgtcctatttaggctaattaatagtgccattagatagatcacaatttaatggaattactggaagtggaacggaggcaatcggacgaacggattaagggatatgaattttggaagtttaaatgaatttttctggacaaggagatgatttgtcggaattttctggaatacgagaaatggtttatggaatttatagaaataatattctcaataatattattgacatccactgacatgcgggctcgaggggacgaattattggaatctctggattaagaggatgggtttatggaatttgcaatataggaaatgatttattgaatttctagaaaagagaaatatgtgtggagtattgaaaaagatattcccaagaatatctttgactcattgacacgtggggccaacaagaaggtgagagagagaggagcaattggagggagtaattgtggacttttagctcttgggtgtgtgggcactggactcggaggagggactaaaagtgaactttttccgtgtcatcaggcctaaggggaggttggctgatgggccaagcccgcgagcgagaggaagaggaggcggctgaccgagtcaagcggggccgggtggctgaggtggcggccacgtggtcgtcacgctggcaggagacagggggagaggaggagcgcgtccggagatcggacggctcacggcggcacaacggcgccggcgagcggcggcgagccggagggaggggacggcgccggaggcaaaaggaggagaagttgaactcattccacggctcggattagggcgccggggtcggagggggggcggcgacggcgtcaggcggcggcggcgggagcggcacggcgcgggcgcagaggccgaggctagcgactgcggcgacgcttctgggaggtccgaggggtcacggggcggtgcgcgaccgtgcgcacgacggcggtggaaaggacagcacggcgcaggagcaaaagaggaggccagcgggcggagcgacggttttggggtggctcaaggggactcaaggagggtggcggcgcgaggtacggcgagaggggagagaggccgacggcggcggaaaacagagccacggcgaggcgagcagctagacgatgtaggggaaggatttaggctcggggctcaccggcaagaggaaatgacgtcgacggcgattttgtggtgggagagggaaggccgacgggggagtgcggccgggatttccgaaggcggtggcgaatcgggaccggcgcggcatccggaaatacggggacagggcagggcggcacggacgggttttgcggcgaggtggcaacgaccgtcgttcggccaaggaaggagaaggacgcggcgaggatggaacgactcgacggcgagatgcctccggacatggagctcgacgcggcggccaggagttcccatggcggcagagcttcgccgcttgggggaaacgaagcaaggggggaggaagcacgggggtgggttttatagagggggtgtgggagcgtcaaggtcggttcgggggagcatgcgagctggcgctcggccggcgttcacgggcgacgtcggcgttttcgtgggcggcacgaaacggcggatggcgcggatgcgatgggcggtggaggcggtggatcgtgcggtgggaatcgaaccgcgagcgcgggctggcgcggctcggcgtggtcaaggtggggcatggcgagctggcgcgcggcgtcaggggcgctcgctgccatggcgctaggtgccaagcggtggaggtagggcgtcggttcgagagaggaaaaagggagaaaggagggggaaaagggaagcttgctccatgtcgcttcgggaaaaaaggcgaaggaggaagaggggcgagaccgagtgctggctctcgcccttggacgcatgcgtgcagagcagcagggccgggcggcagcgcgggcacgggcggcgtcggggctgacgcggcggcgaccgagcggcgagcgcgcgcgcgggaaaccgacgggcgaattcaaacggcagcggcggaaatcggcgccggggagaggagttcgacgagaacgagagatggagagagagagagagagagagaggaaggagacgagagaggcgctccctctcttgctcggcgcgtgcagcgcacgtgcggggaggaggaggagcgaccgagaggagaagatgggccggaaaagggaaaaacggcccaacgaccgagagggaggtgaaatatactttttttgaggaatttcttcaaggaatttaaggagcatttgacattggatttgaattcaaattggatatttgaactcaacaaaatatggagaagccaaggaggggattcaaatagcgaattcgatactttcggaaatgggaaggaatttcgatgaggcgtgattttcgatgtcgatgagtggttgaagttcaaagcgagaattgatattttaggaatatgtttgtatttggcagctcaaggattatttgagagggaaacaaaatgagaaatcaatgttcgggggtgaatcaaaggatgtggcggtagaatgcgatagatagatagatagatagatagatagatagatagatagatagatagatagatagatagatagatagatagatagatagatggatggatggatagatagagcgatggagacgaggagagggggaagcttggatgttagagctagctcaaggagggaatttgatcggagaggctttagggttggagtctggttttggattccggaattaggcgatatttgtgctttagggttggagtctggttttggattccggaattaggcgatatttgtggttatggtttctggagtgaaatccgaatagaaggattcgaacttcgagattattttggaacagaaattttgaggaggcgatctttgatatcagggtattgagacaagggagggattttaatttgagatatatggcacaacttagactcaacactcaaagaatgaaattttcgcaattaggatttttgtaaattagctttttaatgccacgcgaaaagcggagcgttacagttggagtggattattttttttcctttgttttccccctaagggcttattcggattacagggtaggaaaaaatgcaggataggaaaatcgtaggaatatgaaaggaaatcacatagaaaacagaggattgaaaaacacaggaatgtagaagctaagagcattcggtttacaggatagggagagaacaagagcttggagtggatggaattttcctccgtttttcctgtggaatcggcagcaaaggatttttccctacagttttcccacaaccactttttaccatctgaatgataagataggaaaaatatccaagtgaatagtattccaatgaaattcccgtaaaaaacctacaatccgaatgagccctaaaagtggagggatatgaatttttcctttgatgcattcctttgaaacgaatgatagtatagtgctcattccaaaggattagatatttctatacttttcctttacaaatcctttgaaacgaataagccctgaagttgaattcccgaccttttttgttcagctattgaaaatttgaaatcactaccatccacgcgcgatcgtgtggtctacatcgcacagccagatgaatccggattacgcatggacgcagccggtgggcctgcatgacaagtgggcccagtgacactgacaatggctgctcgagtgtcagtgtcaccgtcgtgggcctgattgtgagaagtgagaacacgtcggtgcggtgagccaccaacaggcaggcagcgcctcatccacctttttctcccaaaaaaattcgaatcaggcggagccacctcacctcgccgcggctgtttctcacgccgccttcccccgtcgacgcgcctcgccggaaccctaccacccggatctccgcggcggcggcggagatggtgagcgcgctcgcggggctgcaggaccacctcaagctcgcgcgggactacgcgctcgagggactctacgacacctccatcatcttcttcgacggcgccatcgcccagatcaacaagtgagctccctaccatcccccccccctccgcgaagccgccttccctactacccttctccctctctctcgattcagtcgcggttggggcgtgtgcggtgacccccgatttcgtgtgattcgcggcgtcctcccgcccccctgcggatctgcgcgtttggacgcacggctgtagatttgtgcgtggctgagccgtttgactgccgtagcttagtggattctattaaaatgtgctctgcggaaagaattgggggttgtggttgtgtcataagtttgtcgctagttcgctactttggggttgggggaaattgtcgccagttctcgttggtgaggtgtcatatgacttaggtaaaatcgagcggtttaactgggtttggtacattttgatgtacaagtgcccaaagcgacacagttaaactggggattatgattgggtgttagatatcatcaggcaatgtatgtaataacgttgaagttaggtgctccacatttgagtatctttggactttcttaagaaaaagcatccttgtttcttcaaaacatcaacaatgttcgcatcattgaacctattggacattgatgctttattcgtaggcatgtgctcacatcagaactcatacattgatgtgtaaatgtattttttaacaaaaaaaaaactgtgctgaagaaagatattcacatgcttgttcatttagtggttaaataaatgtttgaaggtaaaacactgagtatgacaaaatttgaacataacaaaaatgcatttatccttatattgatccatattatgatagataagattcgattgtgcaggcatctaactactttggatgacgctctgattcgcacaaaatggctgaactgtaagaaagctatctgtgatgaagtagaaatcgtgaaacagctggatgctcaattaaaggcgtttaaagaagctcctggggcaaggcggtcctcgtcaccccccattcgctctaataataaatcctttgttttccaaccactggatgagtatccaacatcatcaccagcgccctttgatgatcctgatgtctgggcgccaccaagagatacaccaaatcgtagaccaacacgaggtcaatctagtacaagaaaatcctcccaagatggagcttgggcccggggtccatcaaagactggaacacctagtcgtggtgcaaaacctaatggaagtaaaggaaactctggggcaagatcatccactgcctctagcactggtgggaggaaagggaagtcaagttcaagcaaggctgattcagtggtaatttctgtcaaacagttgttcttctcagttttcatttgagcaaatatgttgtgttcgtgttcttagttttctcctgtaaatgataggcaaaacacaactgttttttcttttggaatcatcaccgacttatctgcctagtgcaaaattatagattcgcaccaactagcatacaaacttcttttgtaatcagtacttctatgtatttatattgccaaacatgactgtattgttcgtttgagcatacttcttagtgtatacaaagtagagttaaccgtttttatgagatgcaagcacttgatgcaacttagtccaacttatctttctttgttcatagcacctattgttaaattgtaatttcgagttgtccctaaatctagtctagagatgttctattttaacttcaatgtaggaatattatcatgaccatctatccttagttcctactgtgctattgtattcatattgaactagcatggtggcccgcgcagattgcgcggctagcatcgttatattgtctctcatataatagcatatttgttttctcattatattattcaaatatattaaaatgacaatataattttaaattttgcagtaactttataaaactactaatgtgtaatattcatattgtattttatatacgtgttagttattaattatttttaatatcaaattttagttatttgtaaattataaatattcctatatggactctaaactcgtcttttaatatttcttttttttaattccgaattttttgtaaattatatttctatatagactctaggctctttttccaatattatttatttttatttctgaatttttattatttctaactgtatttctatgtggactctaaactcatctttcaatattctttaatttttaatttcgaatttcagttacttctaaattgtattcctatattgactttaaactcttcttcccatgtttttcttaatttcgaattttatttatttgtaaattgtatttttatacggactctaaactctacttttaattttattatgtttatttcaaattttagttagttttaaattcctatatggactttatactctacttctaatattccttactccctccgtcccaaaaaaagacaaatcctggtttccgtgtccaacgtttgaccgtccgtcttatttggaaaaattatgaaaaaaaattaaaaagacaagtcacgcataaaatattaatcatgttttatcatctaacaacaatgaaaatacgaattataaaaaaatttcatataagacggacagtcaaagttgaacacggaaacccaggatttgtctttttttgggacggagggagtattttttaatttcgaatttctattttttttcttaattcttaattgtatttctatatggattctatactctacttctaatattccttatttttaatttcaaatttctattatttcctaattgtatttctaacctggactatatactctacttctaatattccttatttttaattccgaatttcagttatttcctaattatatttctatatagactctatactctacttctaatattccttatttttaattccgaatttcagttatttcctaattatatttctatagcaattttacggtccttgaggagataccatgaggtaccatttttttctattgtaaatttggtatctcttggtacctaggtactatgaggtaccatgaggtaccaaattttacactaaaattttggtacctcatcaaggaccgtagaattgctcatatttctatatggactctatactctacttctaatattccttatttttaattccaaatttcagttattttctatttgtatttctatatggactctagtctcctcttctaatattccttgttttaaattccgaatttcagttatttcctaattgtatttctatatggactctagtctcctcttctaatattccttattttttaatttcgaatttcaactatttctaaattgtatttctatatggactctagtctcctcttttaatatttcttattttttaattccgaatttcatctatttctaaattgtatttctatatggactctgctttttctttttctccgattaatgtgagaatttctaggccattagaacgaatgtggaggctcctttttctattactttaataatataatagataggtacaaaatatgatgtactaatgataatggcattttcttaaaattaaccttctactgaagagggggaacctagagcctctatctgtttatcttcatattccaaatacaaataagggcattgaaagctttagttacataccatatacaattctttgcttatcttgtctcatccttctggataggttctacagtatgttcttctatatggtggtcaagtttcttgaaaaccatgtattttcttattattttcttacagagtagcgatgctgaagaaggcaagtccaagaaggggcaatatgaaggaccagatatggacttggctgccatgcttgaaagggatgtcctggattctaccccaggtgttagatgggatgatgtcgcaggtcttagtgaggccaaaagacttcttgaagaagcagttgtacttcctctctggatgcctgaatatttccaggtaatgatttttactgtgctattctatcagattctgtaaccttgcctgaatttatttttgatgctagccaatgttatggccatgcacatgatctggcatgtgcttgttgctgccttttacttggtagcttgaaagttagctggacttgcatacatgttatggccatggacatgatctggcatgttttggactcattcaaaacatgccactcaaatcaacatgcacccaaatcaccgtaccctcaattcagccttcaagttttgatcgtattcatttcagtcttttcttcttgcatgtgaccttgttattcagtttaaatttgttttgatcctcatcctatccatgctcactctatttctgaccagggtattcgccgaccttggaaaggggttctaatgtttggtccacctggtactggaaagactcttttagcgaaggcagtagctacagaatgtggcacaacatttttcaatgtttcttcagcaactctggcttctaaatggcggggagagagtgagcgcatggtccgctgtttatttgatcttgcaaggttctatgctccaagtacaatcttcattgatgaaattgactccctctgcacatctcgtgggtatgtgaatgctatctgtccatacatgttcatcttgtttaatgtctccaaagacaatcaaagttttctcaatactttttagcataatcatgggtgcattgttctgcccagtatataaattctttttgtttgcaagagaagctgagaagcaacatacttgtgcttctgtttctatttttctgaaaaacaaagctcaccaagaaaataaagtagagacctcattacttgcattttttaaagctactatcatcatagaagtactatgtcatcatttagaaaatactatgaccagatgtatgagctaatgtatttaccaagttttttaccaactttcagagcttctggtgagcatgagtcatcaaggagggtgaagtctgaacttctagttcaaatagacggtgtaaataatagttctaccactgaagatggtcaaccaaaaatagttatggttctggcagctaccaactttccatgggatattgatgaagcactgaggttgggaaaccctttccattcacatttgctttagaaatttattgagtctactaaataattggaaatttataagataaatcacataaattcaattatatttagtattggagcttgtttgcttgaggtgctgctattggaattagaatatcgatttcctcaaaaaaaaaaactgtggtttgggtccggtttaattttttttttgcatcacttcttatgggttaagagcgtagaatatttgaacttatggacaggcctcaaaagccttgttccaaatgtaaactccttttggggctagagtcatttatagtcaatagcacttaaacccattggtaccatcagaagtggcatgcaattatctgttactcctattagacttgacctggccatttctttatccgtcaatgcactagctacatgacattactgttaccacatactcccttcgtcccagaatatactatgtatctggacagggactaggtagctatgttttgggacagaggaagcacttttgttcttacttttaatcttccgaacggtgtccgtatacaacctctaactcttacattcttgattcactcagacggaggctggagaagcgtatttatattccacttccaaattttgaaagcagaaaggcactcatcaatattaaccttaaaactgttgaggtatgatattacttatcttttctgtgttgtaattccatcctagttccctttctgtttactccttcagcgttttatgattgcctccttaatcaaacagtgcagttcctgcacacaccataactgttgcacagcataggcagttatgtctctgaattgtgtttgctatgcatgcagtgcacatacctgtgtgatcgcatgcatatgtaatttctgtaaatgacaccttttgaccataagcttcatgcctactgtacaccataacctgttgactatcgaagttttctactcagagttgtaccttatacgtgaaaatgaccaaatactgttcgctacttgtcatctttgatgaaaaagtactgtgccatatcttctgttgtttgttaacgcctcttttatatcggcaggttgctaccgatgttgacatagatgaagttgcacggaggacagaaggctatagtggtgacgaccttacaaatgtttgccgtgatgcttcaatgaatggcatgagacgaaagattgcaggcaagacccgcgatgagattaagaacatgtcaaaagatgagatctcaaaagacccagtggccatgtgtgactttgaggaagctctggccaaggttcagaagagtgtatcacccgctgatatagaaaagcacgagaagtggcaggccgagtttgggtccgcttgaaatctccattctgttcccgttcaaatttctcagatcattgtttctccttggttgcttgtgttcgcaagtatttcattcatttgtaccgctgttatgttgtttcaacggccttatgttgatcggttgtattgcctgcgccggtgttgtatcatagagacaaaccagacagtaaactaggaagtgagaggtctctgcccgtggaactgctttgttgatttagtttcagtgtcactggcactgccgaagccaaaggttgcgtcactctgtaaccatttcgaacagttgatatccagcttccatgtttcgcacgggcagttgcgacgtgcgcgttttaacagtatgcttcttgactcattgatctgctttacggagtacatcactgaatcaggctctgttcaggcttctgaacagagaaaaacaggtgcccagagctgaaacggtgcctgacgttctcaggtctgatgctggaagacccagatgccgtggcttttttacccatctggtgccatagccagaaaacctacttgtcctacacgcaatctggatgaaggcctgctgcagatgccagtcgtggacttgactttctttcatgtgacgtctcatggtactatgcatcaatagcttccgtggatctgaacttatacagtgatgctatccctgtactactatacttcgttaaaaaaaagtcagcaaaaactgagccatcggacatttggactgtccagatttatgtaaaaagaaaagtgaactaattttgagatgaaaaggaacatgcaatcgagctgctcgaggagatgtaactttagttgccaaaattttggtaggatttctaatatagttaccaaaatttggcagcatactaaatgtagccacttttttggcaactttaccaaaatttggtatgtttgaaaatggcatcaaagtgaatagacccataatgttaatgcaaaaaaaaggtacatatatcgccgttgccgttaaaatgatatgtaaaaataaaagtgaactaattttgggatgaaaagaacatgcaatcgagctgctcgaggagaggtaatgcaaaaaaaaaaattgatatgtaaaaataaaagtgaactaattttgggatgaaaaggaacatgcaatcgagctgctcgaggagatgtaatgcaaaaaaaaaaaagaagaagaaagagcaaaaatatttttgggatgaaaaggaacatgcaatcgagctgctcgaggagatgtaatgcaaaaaaaagaagaagaagaaagagtaaaaatatttttgggatgaaaaggaacatgcaatcgagctgctcgaggagatgtaatgcaaaacaaaaaaagaaaaagaagaagaagaagaaatgtaatgcaaaaaaaaaagaagaagaagaagaagaagaaaaaagagcaaaaatatttttgggatgaaaaggaacatgcaatcgagctgctcgaggagatgtaatgcaaaaaaagaagaagaagaagaagaagaagaagaagaagaaaaagaagaaaaaagagcaaaaatttcgccgttgccggggatcgaacccgggtcacccgcgtgacaggcgggaatactcaccactatactacaacgacttggttgttttcgggaaaacacaattttatctttatagagttagccctcttttgaatcgcatgcaagatagagttcagtcgcgcatacatccgtatatgtataatctagttatataagcacaagttacatcactcctaatacatgcatcaactgtacagaacgtagcccgtgttggcctgtacgtacacaacaacggcacattgccttgtcgcctctaggcctggtcgcgcgctgcaccaccagccccagcgaagtcaaaagcagcagcaaatgtagtagtaggaggaggaggaggagggtatacccctacctacgctcgcacagtagcaagtaacgtgtgcgctttacacgcctcacgcgcgccaggatcgatcgatcgagagagcgagcatgcatgcatgcccaagcccaaccaccgcgtggcgcgcattaaccagctgcagatgctttgccgttgcatgcagcgccgcgccgcgccggggcaacagcgcaacacagtagagagggcacgggagaaagcgctggtgtgaacagtgcagcggtcggagagatgagatgagatcgacgacccgatcgatgtcggggtagatgtactgtatacatagaaaggacagtggacagatcgacgtacatgcacacattgacacatactactgcgtatactagtctagttgctgtacgtagtagccgtagccacaaccagccaaccacgcctctgcccctgcactgcgcacgattgatctgtcgcatggattgatcgatcgtgtgtaccgctgcatcgataattcggtatacgactagtagcatgctctactactactccatccatccaaaaatatagcaatctagaatcggatggaatatatcctagtactagaatctagacgtgcccccgtctagattcatagtactataatacatctcatctgattttagattgttatattctagaacagacgatgtactatcttattaaatatgcgtgtcgatggatcgacctatcaatcgccaaaatacctgtgcgatcctctggtagtagtaatagctagcctgcgtaagtgcgtatgcttgcttgcttcaggcctgcagctgtggcatgcgttcgtgtaccggtcaccgcctcaccggtgtacgtacgtgcatttgcatccctctgtcaaaaaagaacgtgggcccttttgaatcaaaggatttatgtaggaattttataggatttaaatcctataggaaattttcctatttggccatttaattcaaaggattgaagctttccaaatcctatgaaatttctatggaatggcacattgcatgtggattttggaggaaatttagcaagagctccaacctcttgaaaaatttcgtttgagtctatctctctcatccgattcctgcgtttttcctgcgctccaattaaacgatcattcctgtgtttttcctatgttttgcaatcatctgttttacactttaattcctatcagaatactgtatttttactattcttctgttttttctgccctacgattcaaagggtccattaacatgtgatcctaagctgataagcattcaggccgcctgcttgccgcaccggtatgggtacgtgtttggggtctctttttatcgctttggagtttgcgcagagtcttcaaaagttggatgcttggagcagagcctatctatacacgcagagctagtttacgatttgtctcccacagccaagctagaggcattgccgatcgagccgtctagctagctgctagaggccaggataccctatactcgggtatagtctgggcttcagctggatgcacacagtgctagagagcccagcagcgtgcaagaaagattgtgctgtcagcgatggaattgaaatggtgcttcaccaacccattcttcattcttcaacctccctaaagacaaaacgaaaggcatgcttcaacggcagggaggataacatgcacggttaaagcatctcaaacaaccccttcaaatataactctccaaatatttatttgatcaactaaccaaaaaaattaggtagtgaaatatatccttcactccaatagtttttccattatacactccaatctaacagtggatcccacatatcaggctccctacttcctgtacactcccccctctttttctcttctctttcttcttctctaacgaactatcatttgaatccgcacaaggaaagaggcggtagagtggaggctggaatgtgatggtggaggccttcgatcgcgctcccacgcggtacccggcttgacatcccacgcaatgaaggcggtggcagatcgacgatgacgacgggcgcaggggatggggaactctagacaacagcaacgatgacgagtttacttgatttaggagagtgcagagagtcagggatggagagagttggggagagcctctctaggcgtgggcccatggttgacaagctaattttggcttgccaagtttgaccaacgagggagccagcttagctagtgagatggcttggtcatttagttgtgaggtagttggagcctgtttttattcataattgctaatttttatgtgaagagtgggatagtcgtactgttggatacgctcatacatatctatatatagctcatctacggttttagctatgaattaagagttcaaaccagcaggaatagtagccaacaacggaaataatcaggtgagatgcccggagcagatttagagtgggattgtagataagagcaaggataataatatagctcactttctactattagtccatcttaaaatcaacacatataatagattagctataaggttggctataatttttttctcctctctctatctctcacctatatattcaatgtatttgtcttggagcttgtgttaagctagctcttacatgagagccaacacccttctcttttgtttacctctctcctccacataggggggcctaatgggcgatcgtgcccagcgatcggtttgcccccccccttccccctatactcctccctcttctccccctttctcctccccttcttctctttctactacagtacactacacaattttttttaaaaaaacaaaagttaaaaaaatttatgtatagaaatactattatataaaaaatttgaattcaaattcaaatttgaatcgggtatgtaaacttttgacttataaactttgggtctataaactttagatgtatagaaatactatatatagaaaatatttgaattcaaattcaaatttgaatcgggtatgtaaacttttgacttataaacttttgatctaaaactttaggtgtataaactttagatgtatagaaatactatatatagaaaatatttgaattcaaattcaaatttgaatcagatataattcaaattcaaatttgaaatgggtatataaacttttaacttataaactttagatgtatagaaatactatatataaaaaaatatttgaattcaaattcaaatttgaatcagatatataaacttttgacttataaacttttggtctctaaactttagatgtgtaaacttaatgtgtataaactttaggtgtataaatttactaaaataggaaagtaatgcggtgccaaaaaaggaaaccaggtggagggagggaggggggaggggatcgatcgctgctccatccctagggcgatcgatcgccgaacagcatttccgctccacataagcttataatagatttatagctcactattatacttgctctaaggtgtctataattcagtgactcgctctgttcacgaaatggtgttttttcaatgcgcatccaaacttgcattaattactttgggtagctattattgatcgatgagcgtgcatctcttttctcactactccatgtatgtgggggtagctgcattacacgtaataattgtcattatgtacactgacaaattagtagtagtcctgccattttagtttaagattgggaaaaaaaacatgcatgcagccgagctaaaatttacgcacgcatgtgtaatgtacgtgccccatagctcttgtacccgggaatccggatcttggtgccagggaaggtagcccaacatttgttcgcttcctcccagacactgcgtcgcaataaaatcgattaggtagtacgagttcttccctgacaaaatggaagtagtggtagcagaagtagtaaaaggggaaaatatgcaaatacaaaaaacctctggttgttgtctgctgctactacttcacatgaaaaacatatgccgatcgatgtgatccatcagtgaagaagcagcagcatggccacaactccctcctctccaattcgtcaccagtgccattatggtcaaaaataacaaggcatcatcgtatccgctgtccccctcttgctcaatctctgcatgcgcacacagttcagtcacactgtatcacctaacctttccagtagctccattgtactgtgttacagtagcatatgtaatcagtttaaacggcaaagcagattaaactcagctaagcccaaaatataacagagtgaccgtgcaagcaaaagagaggttaaaagaaaaacagagagagacaaggaattacagctggggccggcctggcccagaatgaattgatgagccgtggtgtcgtggtgtcgcgttgcgcgcccgacaagcgcagatccgccggacgagccgtcgtaggggggtgagagagcgcgaggtgcgcgtatgcatctgccgctgcacgtttctgccggcgcgctgccgcgttcgcgcgcgcgcgcgccctcgatctctatcggctaagggtgtgtcagttaacgctaaaattaaaagtttagttaaaattaaaataatgtaataaaaaagttagaagtttatgtgtataggaaagttttaacgtgatagaaaaattaaaagtttaaagaaaaagtttagaactagcctaagctggagctctcaacctagtgtctgcccccgtgacatttcggcctttcggggccatttggttgttgtgtaattttgccgcagctaatcttgaagcaaacaaaattatataattagccgacaaatgtttgaatgacatgcatatctaaagtttttctttttaaataaaacaggtggtaaaattaaggtgtgacagtgaaacaaatgcctaactaataaactatgacacgactaaagcatgtcgtggcaagatgaggcgaccaaccaaataccgccatctttctcctaagcttgcagcttaattactcccgcaatcatgtttagtttatgctgactagatataactataacgatttatcagcaataaaaaaataatttgtaacaaaccttttatacatgtgttctaagaaataaaaaaaaagcaaatgttaaaaaataaactgcaataggaaaaccaaattaacttcaatatcaacttttaaaatttaaattttacttgtagcttataagatgaagagtaaatgatgggattcctttttttcccttgttacgtcccctaaacttttggatatataaccctccaaactttacaataccatctacataataacaccctctaaagtggttttggttggtgctttttgtatattttgatgtttaaactagttgttttggctaattaaaatgatatattttcattgcgtcgatgctcagtccttaagctattgtgatatcatactaacatgcatgccatgttgatctatattggtctgattaattatcagtgagagaaaggtaataaaagagatacattcaagtgaagattttgacatatatcttcaatatgcatgccatgttgcaaaaattttccattgtacctgcaaaattagacactactttaggggcttatatgaacgatattgtatatttaaggtgttggatgtctggttccaaatttcagggaatagtgttatatggacaggggggaaccacaaaaaattaagttaggtttcgacgtggaacaagagcaaattttgaggcaactttcaaatggttcttgatatattcaaatttaaattagtaaatttgagcgaaatttagtcaaaatttgctaaaaactattatgccaccgggggtcaagatcccacggtccatcgtaaaagctaacatagatagactttcagtcaaagcttaagggagtatgtatatacggacttcttcctctcctttttttcccattagataatcagagaaataatgagcagcatataatatatgtgcactatggcctggtttatttcctaactttttcttcaaacttcaaacttttccattacatcaaaactttcctgcacacataaactttcaacttttccgttacatcgttccaatttcaatcaaactttcaattttagcgtgaactaaacacaccctacgtgccatgtttaaaaatgctaggataataaccacttaatttgttgcttgtcttactaagccgatttagaattagaaaccgcttgataaaccgactaaatatgaaaggattttttgttttaaaaaactgtccaaataaaaaattactggttttcgttgttaaccgtggttatgaatgaaacctagggagctcgtgtttagtaaccttgtcacatttgaaatagaaaagttttttttctttttttctttgtggggcacctgagtgctagaaacagtataactgtagtctattaattcagagcagagagttaatctgccctgtcggaagagcaatatatacagtacttgctactctctactatatataaatcagaaatggaaatgtgtgtagccaccagttgatcatccgcgtcttgttgtatatgtcacatatatgacgcaccactaaccttccaatacatttacagtgatgactactgatgactatagcaggggcatgcacagatagctgtgcgagagactatttactctggcgttgttactgtcaagccaaggcgtggtcacaaagctcacaactcacgtctcacagtatagctggattgtcggcattgtagcctactacagcccactgttcaacgacgaaatggacaaagcacaagcaacaaaaacgctatctcgcgtggttgcgttgcctaatcgcctgtgatctactactactagctgcttctgtccttattgcatgcatggcctttaaggctactactaacaactctagagcatattacgtgtgtagtacttcctcacaaagctacaaattaatctggatacgtacaaccacacgcaggtgcttaacctcttcttggccattaattaaacacacacacattctcttctcacgtacgttgtgtcgctctctctggtctgtcttctcctgcatgagcactcacatgagatagatgagatgagagggccaagcacaagatgccaacgcaggagtaagaggcaagcatgcaagatgttgatcgatgttgcagccctgcagtgtggggatatgctagttggagtagtatagcatgttggttgtgccaagcctttgctaatttagctctctcttcttgtacctctagccatctaatgcatgcagcagaagccagcggcggcagcttgtttcagtggcccaagggaggggagggccagtagtaccatggatggactatggagtactctcaccgctcttgaataaacaaatgtaacaacgcattctaatattacaaatttgaataatacttcctccgttttatattataagactttctagtattgtccgcattcatatatatgttaatgaatctaggcacatatacatatatatgaatgcggtcaatgctagaaagtcttataacctaaaacggagagaatagttatttagatatgtagtaataagatgtatcacttcttatattaaatttatttatcatagtaccaatggagtatatgaacttttctctgtcccaaaataaatcaactttatactataatgtgacacattctagtacggatttagacaataataaatttggatatagagtatttttaaattcgttatattaaaatatgacacattctaatatgaaaggttggtttatttttagatggagaggagtatgcatggatcagtctggtgcaggaagtgctgccactctaattaaaagcaaaggagaggaggtccccataaatgaggtagtacagtggttgcatgcattaggctcctgcacagccgctgaatattccctgcaacaagcattaacagccagagttttgaatggttgtggagaggagacgagcagcatactatctgagcgccactgtgcagctcagccgcagctgcctcggacagtagtagctcagccggccagccggccagcccattctgttgcttctgcattgcaaaattgcaaatgcagcaaaggcgaagaccacgctagctactactatagtaggagtagtagcccacatcacaggcggcacaaggagctggtctatcgcactgcacaccgcccctgcatgcatgtacacgcatgcagcgccaatgcagcgtagtagtatatgaccaatcagatcagggcaggccactgcgccaaccacacaaggcggtagcagatgtagaacggtgaaacgcattcaaggccacccctgtatgctatctagaacacagcaggttagtgtaagttgtgtgtgtgtggatggagatggaatggatctctctctcatccacttgaagagagagagagagagggggggagggaggtgtcatagatgcagtgccctgcactcatctcgtctcttgctctggcctcactgtgtgtgtggtaccacctacaattcctcgatctttattctccctgcagctagctggtttggaagaagaatgttcataatgctaattgattgtgggtgtaattaaacagatgcattaaacacttctgaggtagcctacatttaggatagggagtgcttgtggggatagggaatttgggcatgtacttatcatttatcaaagggagctttcttgatgtatatcagtatatgggccgagcacatgaatacatgcatgttaaatttgaggtagcaataagtaataaattttcaagagaaacataacatgttttctcgtgatgggaataatatagaaacgaagaacatcagtttcctgcgacgacgaccctacaattacaatacacattacagatttacagtactatggctagctagactatttctcagggcctcacgcattggatgtagtcatgtagagaaaaattgatacagaagatgggtattattcagtaagttcaaatataaaatcggcatatatagatacagattcaagttcctactaagtaacaatactagtagaatacaataggcagagacagaaacgaggaaatcgggggaaaaaaggaagattacatgcattacaaagtgtaaatgatgcattctaggcttaaagactctctccaactcttcacactatgttactcaagaaggctgttaagatgtctgaacatcacaaacaagctccataccaagaatgcgtcacttacagcctctcaatacaccagaaaaaaaaacagaaacaaaagaaaacatcgagagtaatctagaactaataataataagctaattaattaagatacctagagatatttatatatctcggaccatgacgcctcaattccccacacgctcacaccggccgtttgcccccatcatgctccaaatgtagctagagcagaaggagagatcgtggtgagagctcgaatacaagatgctcgccagctcttctcctatctgtgaggctcatttccctccaacgtttcctctcttggattctcagatgctagccaggaggtcgtagcagcagcagcagtggctgcaccggcgccgagctccattggggcaggaagaaaagcagcaagatgaggcatttccatgagacgaaaggaggtctcactttgcaaagtttagtgtaagggggtgatgagaagtagaagaagaagacaatagagaaaagctagggcgatgtgtttatatactcacatggctacaagggagagagaaagaaaggggcttaaagagagaaggggtaaaattgctacagctacagaagagcctgacaaagtgtgtacacctttccgagcaaccgcaaagaattcattgtattgtaccattgcacagtacatatatgcctacatggtcatgttatgtgcattatggtcttgtcttagcttggtccatacgcggagacatattcattttatagcactcattatgtgggactggtagtattttttgtagaattgaattcacagcaattaattttggtgtctttctttgtgagctttggcattgcttgagcaattatataccgtgcatatagagtactaagattcacccggcctaatataaatgtggggacaggatgggacaagtttagtgttttaccagtaaatggaatgtttgttgtgtgagtgtgtgtgcagatatgcagattgataggcctaacattaaacaaagtatgatgggaggcatgtttgtggggaacgcgaaacgcacctacacggactccaaggcaccttggggtgagcaaggaaaataaacagctcattgttcgtatgatatactcttactatgatgcaagactggcatggggtggaccatttatcagtgagacgaaattatctaaggtacagtttattttcacctgttaattaacaacccacttgatcatctaggagaataacaaaattggtagcgttgttagtggatcattcaaccctaaaccagtctggaaactctcttactgatgtatcggtagaataaactgcctagatggatggagttaacaataagtaattaatcataagctttgtctagccagaaaaggaacttaaagagcaagtacaatatatagtatcttataaatcggctgtaaacacatgtaaaaaaagataattaaaagagaaaagaaaacagagatggactacaactttatagtcggttgcagtactgattataaaacgttttgtgtgttaaaggtatgactaggtattgtggtattgatgagtgtagtatatatttataggcaactattatataaattgagtattaaaatatgtatagataatttaattaggtcctttttgttggcccatattttttaataagccaaatcaacttattaaggaataaaaattagttagtaggtaaaatatacatgtgttcgtagcaacttaacaatcaatataaaaaagaaatcatgttgaaaatatcttaaattaactttaaaaacaagtttgcaattttgaattttgactttttcttttgtttattaaagcaaccaatggagcttttggagctggtagctaactgaactactccctccgtctcacaatataagggattttgagtttttgattgcaacgtttgaccactcgtcttattaaaaaaaatttataaatataaaaaatgaaaagttgtgcttaaagtactatagataataaagtaagtcacaaataaattaaataataattttaaaaaaaatttgaataagatgggtggtcaaacgttgtaagtaaaaactcaaaatcccttatattatatgacggagggagtatgtatatattaaacttgctgtaattaagatattaccatgcactgttttgtgtagtgggagctatagccatgaggtttgtcagttagtgtgattaggactagtttaattaagaacggtgttacggctagacaatcctttgcgtgtgcatgccactcactcacttaggaagtgatggaagcttcacccgttccttttatttgtctacatctctctctcctctttctgctttcagactgcacatagagggggggggggggtaatagtaatactctatcatatagctagatgccgatcagaggaacggtgtctcttgctttcctaaaggcgaacaatgtttcggtgtgtgtagaaaaagattcaccccatgatagaagagaaagctgcggtggtttgtttatcaccggtgattcaaatcatgtttgttatcattggaggtagcacccgtcatgtaattctactagtctactagtgttagaatagctaggttcgaatatactagttcaattataagttaaactcgttgaagttagaatatgtataggatagaattagagttgaactttatcattggctctctcttaaacagagagcatcataatataaccataacgactacaattaaacgtaaacacataggaagatgatgacggcgagaccataagactcgtaaagactagatgctatgttattggggagaagcgctcataatcagagcttcagagatgtaggcttcggttcaatttcattaacaaatatcgtgggctcccgtattgtcttctgatgtgtcttgggtgatcgatgattgaaacgatcggaaaagttagtcattatttcgctatatctactaaattttataacaaccaacgtgtactacagctctgcattttgcagtgttcaactgttcatcccatacatggtttaaagaaaagaagctagatagaaacgaacgcattgggcattgtgaatgaatccagtttacatttccttcccctatgaagcacgtgcattacattgcttgcagagcataattccatgcatactacatgatgctgcacaaacattcagctagcatatgggtaattcacaggacaaatgaacaatagacagcaacgcgatcgaacagcgaaaggagaagaatttttctggcaatgcacacacaagacgcacgtacggcgcgcggcccagtagtgtcgactactagcgaatattctcggagacaaacgttacagaaggcaaagcaaagcgaaggcacacacacgagctagtggagattcaggtgcagggccatgtcacttcgcagcaatcggccgggcaacaggaggggccgatgcatccatgcatgcaaccacaaacaaagcacacgcgcacgcacgcgcacacatgctctcgcaggcggcagctagctagctagcgcatcgatgctcctatacttgcagctcgctgccgccggtcgcgccgtacgtgctgcacgcacgcagcacaattgcacatatatatggagctttgctttgctcagggattcccttgcacagttgcatctcgaactctcgacgcgacgaacatatatgcccaggcacgcacaatctcagcagtcagcaacgtgcatgcatgcatggatatatacagcacggcatgccatgcattgtgccaaaacgtacaggatcagtctgcgtctagcgtgcatgcctatgcacggatgcatctactctcgcgcaaaagcggtcaaaacgggcagattctctcgcgggggctccctctttgggaggcctctcttgctcgggcgcgcgcttggctggttggttggcgcatgcggatgccggccggctgcgcctgcgcgcgcgggcgcgtacgtgctcgcgaccgcgcgcgcagtgtgcccagtggtttgtgcgtgttttgggcagcgccgcgcgtgtgctgggctaagagcggtacaatagtaagctataagcgagctataactatatatcgagaaaaaaagagaagagagagaagaaaacgggctacagatttatagctgactgcaatacgaactccaagacgttatgtgtatatgagaggtgggaccggatattaatagtgtagtatatttttatagttaactattgtataaatggactgttagattagctataggtgttttatagccaacaattgactatactattaaacttgctctaatgcaaggacggtaggcgggcgagcgggcatcccggccggtctgttggatcatgagaatgatggccgctttaggacgaaggggaggagtcaaaaataaacgcagggcgcttttgcagcacaaaggccccatttcggaatatatgcgtacgtacttcctgtgtgtccagcttacctagccggagctcccttttctccttaccttttctgttgtaatttcttgttttgtgtggccaagcaatgcaatgcatgcatgcgacgccctccctctttaatcgtagactggaaacgagcaaacgatcgggtacgttcgcgacaaactcgcaagaaaataatgctgaagcgatgcatttcgtaagctctctcgttgaatcgtccggccgtgaatttcacgacaatatatatctatatctatatctataatattataaaaattgaagatgttttgccgatactttggtatactatccgtgtatgagtcggtttttaaattcgttcgcttttgaaaatacatatctatatttaagtcggtttttaaattcgttcgtttttaaaaatacagaaggagtcatataaaaaaatctcttttaaaaaaagaactcgcatgctaatttgagacgatcagactcctaaccacagctcatgacttaaaaaaaaaacatccaagcgaattgccacattgaatttcatcttagctaaaccatataataataataatattaaaataacctttacccattacaatgcacggatattttttctagtatgtatataaaagcaaaaataagccaagatcctacgattcgcgcgtcacgggagaaaaggtgaaaggcgcgcacggccggccggccattaacaccaaaagatcgcgcaagttgcttctaatccaagtactaaatgattgagcactcaaaccccctcatcgccaacggctcgtcgacacgacggctcagcgtgcggaatcacctggacccgcgcgagcggcgtgggggcaagctagcggagtagtaggcgctcctcccgcccttctttccccggccggcccattctccccttccctgttttggtaggcgtgcgcgccatgcgtcggcgtccacacgcccatgcgtggcccggctgcgctcgaccgcgcgcctcgttctcctcgcctctctcctcgtggtggccggtgggggcgttgccgttgccgtgcacaagggcggccgcgcgcccggtcgcgcgatcgattgccaacaaccgccgcgcgatgtgctgcgctagcaaactttacaacccagagacatcacgcacgcacatcgtaccggcgcgagcacgctgtaattatctcccccagcaacttattcatataagcaaagacaaggcatgcagttagtcagctagcgcgagacagggtccaaacaagcgccacagacggctcacagtagcgagttacatcagtcacaggagcagcagctagccgcgtgcgtgtaggccctgtgagctactacggcataaacagcagggatctatcgatacaatgagtcaaatccaagcgcatatgatctttccgcctgcgctgcgctgccctgccgcgcgtgactggtgtgacaaagcccccctccttgccttgccggctcagctcgcctttcctcgttggccgcaaagatgcagcaaaagcctcgaccgctgtcgatttacacgatgagacgaaactggctcgtgtcgtgtcgtgctcgtatcgtgctcgtggcccatgggaggcttggaaggggaatttaactatttgccacttgtccaaataagtgtcttaaattcacgcttaataatttatcaatgaagggaggggtcatttcttaactatttgtcacttttgcttacgtgacgagccatcatagcgtgcccacgtgaaaaacgacgtggacccacccgtcagcccctccactttccttcttctccacctcgccggagcttgaattgagcgtagccattacacggacacatctaaagcggagattttcgccctgagttggcctagctcggccacgagcgccgccgccaccatggtctcctcaagcgccacgtccccaagccccgcgtcctacgccaccaccgccccgacgacgagcgtgaacaacagcagcagcgccgccacggtagcgcgtctcgtgatctgcatcccgagatccgtgcgaacctgtctccctcgatccgtgcatcgccggagccactcccactcccccttcttcatctatcgttgaagccgctcccactccccgttccgcacatggctatcaccattctcatcgtctgttccggtgcacgcaagcctctgggcccgaggaagccgtagcggccctgtcaacatcgcggtcgtcgttgttctccgcttcctcattgtcgtcaagaaactcgcgcaagtggaggttctcgaaggatctcctccatcggagcaactccgaaagcggcaagaacccgtggccgcctttgcccaccccgcagcctcggtcgccagcgcctgtaagtggcgaggcgagccgaggtggaggagatacagcagccgtaggtggagaaaaaaagagaggggagggcctgacggggagggggtccatgtcgctttccacgcgagcacaccacaatggctcgccacgtagaaaaaatgataaataattaagcacgaatctagaagaggcatttgaataagagcaagataataatagagctcacttcctactattagccaatcttaaagccaacacatataacagattagctataaggttggctacaattttcttctcatctctcaatctctcacttatacattaagagcaagttcaatagtatagtcaaatactagctccaattcatctatagccaatctaatagctcattcatacaatagttacatactacattattaatacctagtcccacctgtcatagacacactgcgtcttggagtccgtgctacagctggctacaaatctgtagctcgctgctcttctctctcctgatttatctccttaaaatatgtttgcagttaacttatagcctgctattgtacctgctctaattgtatttgtcttagagtttgtgttaagctagttcttgcatgagagccaacaccttaactttttattacatctcttctccacataagtttatagtaggcttacagcttactattatacttgctctaagtgatgtacttaacagtggtaaatagttaaattccccaggctggacccctccacccagagtccaatctccaaagcggtggaacaccagcccagccgctcagcctcgcagagtcgccccgcgcggctcggccgctcacccacccgtaacgccgtcacgagacggcgctagcccggtggggaggtggcgcgaatccgaggcgccgcctcctaatttttcccgcgccccaccccgcgctgtggcggctgttcctcctcctccttcccccgatccccaactccttccaactcacatggcggcggcggcggcggctgcgtccgtggcgagtcaagcgcaggccgtgctccgcggcaggctctgcgaccaggccgtcgtccactccgccctcaggtcctcgccggacaccaactacaggtcagccagagtcgctccccctcccgcgaaatcagcccgggagtcctcgcgactgacgcgctttgttctgggttgggcacagtaagctgaagtacctcgtcgccagctccgtctccgaagcctgcaacaactccgtcctactcctcggcccccgcggctgcggaaaagccgcggtgaggttttccttcctagtatactcttctgccccactttcagcggttttctcggatgcgggggtggtgttcgacgaaatgtgccagtgggcgatctacgactttacgctatgggttgtttcggcatggactgaggtggtgtttggatcagggacttaactttagtccatgtatttagatactaatttagagtattaaatatagactacttataaaactaattacataaatgaaagctaattcgcgagacaaattttttaagcctaattaatccataattagagaatgtttactgtagcatcacataggctaatcatggattaattaggctcaatagattcgtctcacgaattagtccaagattatagatgggttttattaatagtctacatttaatatttataattagtgtccaaacatccgatgtgatagggacttaaaagttttagtcccatctaaacagggtctgagatttcaattcttcgcaggtggtcgacatggttctagatgatctgaagaaggatcatcctgatgcaatatcagtggtatgtataaacgttatattttacttgttgctagaaatgtatccatgtatttgcgtaatacacgatcgatgatttacctacgttggccgtgaaataaacatacatgttacgagaaaatagtttgtttcagggcgctttagggcggaaggggacaaggataaatgtagaaactccttgcatatttttatgttctcaaatgcatggcctagccaaaaggacaatatatcataatgcacaattagttagactttgttaacttgtagttcagttggattattgtgcaaacttttttcagatcaggctgaatgggatgctacatagtgatgacaactgtgccacgaaggttagagctttctgatgccagcttttttggttcaatttccgtattccacatgccctccgaaccaaatctccctctctcttaactcctgtccaccaattcagttaacttcatagttgtttctatgctttatcaactccaatgcagccatgctaatgcttttgttactttgcttttaaggaaattgcgaggcaactttgtttggaacatcagttatcattttccaaaatggtgtgtggtgtctactctagccttcacctcactcaattattgttctctctaccattttaaaagatcttatctcttttaggcttcttcagatgacaacacggaattcatgattgacatgttacggtaagtgaagtgttaagatgatgagcatctgtacatcatagagacatactccttgattcttgaaatttatgtccagtcatctgtatcctctcttctgcagggagtgtggactagctcacaagacaataatttttgtcctagaagagtttgacctctttgctcaggttgaaacaaatacatgcattctggtttaactatacttaattcatgctgaatgttagatgcatagaattgtagcacgtcatggtttatgggacatttgtcttacaggaatagcttgctttctacaattgctgctggcaattattagataacaggataacagatgattctatttatggtttcctattacaggggaagcagaggttactctatagcttacttgatgcaatgcaatctctcacctcacaagctgttgttattggtgtgagttgccgattggtatgaaatatatcctctcccatgtttctgcatcttagccgtttgtaatttgtgtgctagtacactgtcataagatcaccatctcccatgtttcagatgaccctcttaatcgtgtggtagttgatacacaatatgcattagtgcagtagcatgtcacatgcattgtggtaattaatgataccaacgctgtacttgggattgaagtggctaataactttagacattgatagttctacgaaaaatctactgtttcctttgtgagctgttttgtaatatcaattcatttttaggatgcagaccaactcctagagaaaagggttagatcccggttctctcataggaagcttctgtttgttccttcttcagtggatagtttacagaggttagccttgtgcatttttttttttcaggctaaaacattcactgtttctcaagatctctattcaatccatcttttgacatttgaatgattgcaggttaatggagcacttgctagcacttcctgaagattctcccttaccaacaaagtatgtcagggagtacaatgcacggattactgtatcctttgctcaatgtgacatgtcactttatgtgcttacaaaacctgcaggtcactgttcttgctttataatcctcacggcaatcatatttgaataggctgacaaatacccacagagtgttttgttaatgggcagtttttctgtttcttattccaagaatggatgctgaatgtgttcttttctatgctaaaaagaagccatggtggcaaactggcaatggcactgtttcttaggctaaatggaactgtatgtgatcatcccatcaagttctataatattgtttgtgttattgtgcaaaacaaaattgtaatccatataatcaactaggtaaggtagtgcagaaaattgcattaaaagcttgggatttccttgtatgctgctgaaagttcacattctcatgccactcattgtctcagtgacatgggcttggatccacctttgtcataacgacaatgagggattttagagttcaatgcaatataaggaactaatcccccccaaggtttatgttatcctatacacttcagagcattttcaatgacaaaaagttcaaaggaattctcagctccctcactgatgctgacgcaacaacaagccacatccttagatttctgtaagtatttcagcagcttcttttttttatcctcccttttcttcacatttccacactttttagtactcagttaaatataggagaacgaaaccttcagtttcagagtggtgtcatacatggacatagattctggacttctgtcaatgcaaagcttcatgaatgcgctatcttcgatgcagaggcagcctaagatggacagtttgcaaggtctattttgtttgttgtccctcatttacttatgtaggatggaattgttcgctgtattgatttatatgctaaaacaaagctaccttcattactccacaccataaaacagtggacatgaatggcaccatatttctgacactgaaatttcgatagcagatctctccattttggaactatacattcttgtatgcatgaacaggctagaagataaggagaaaagttcatacaactttatcactattatgaaaggtagaatctgttcctctccatttgtgttcagtcataggaaagactaagtaagttgatgaactggttgtctgtcagagtacaaatctgtgcaggatgcctacaaaacgtcggacaaatattcacacactgtttgttttagagtaagtattagcacaatcaagaattcatgaaccttccattatattgaaatttcaatataaaaaaattacaacttttttttccccttcgatataggcttttgagcatcttttggatcgcgagttgattagctttgcagacaacaaagggagaaatcaggcgcttgaatatcgtcctgtcaaacttctgatatcttcacgtgagcttgctgagtccctcaagttgaacacgacctgccctgtgagttaaacgtccacctgttttccaatttaacgatcatctgatccttaccccttttgtggcttgccgttctatctcaatacgctaacaggttgtcatgctttgtgaatgatggtgctctggtttactattgcaggctgttttgcagaagcttcttgaccgtgaaagatacatgtaaaagtttctatatgtttgctaagttgatactggttcaagtgctggcatacttctttcttctttgttactccctaacaccgtgttggaacatcctatctactgcaaagagatttaccttgaagatgaaaaaggtatatcggtctctggcaaggtaacaaactaacaacacaccatttcactcgatgccctccctcttgtgtgcatggatgatacttgagaagttcaacgcaaggtaaacgcactagtgcactactgtgctagtaaaactttaactggattaccatggaaaattgacaccatcagttttgtgctcatgacaagcgtcctaggacgaacatttgttgtcctcagttctgtagatcatacacattcaaccaatcctgtcatcctatgcatgcgttgataccgagaatctagctcaggtttcataagtagctcaaacacatgttgcatagcaatgctattgtttttctcaaataaaattgttccaaatattataattatcttgaaactctcgcaatctcaggcctgtaatggcggaactattgtcaagtaaaatttgcctaccttaaggtctagttaaagagactagctatgtatagttatcttgaaaacaaacaaatacaaggtaatagaaggtttggagcagaaacactgcgatgaagctattacagctgctttattgagcgtaagtgatcccttcgtgaccattccagcaagaaaagcgcaagagaaatccccacacaaatccaaagagtaatcaaccaagtaggcattggatcttgaaacaaacctggttatgttgattcatgttagcacaaagactgaccaagcatgtatcgacataaactgtatgcccttgttaatttgccaagaatatgctacatactataaaataactcaccgtgtccaaacttcatgcatataagcagctctaccatgcatatagctaacgaaagccaacaaaaagctcccaccttcttcactggttttctgagataattgatatattgaaaaaaatatttagttatccatcaatagaaagattgcacgcccataaacaaaagccgggatgggaactcatgattctagaaaaggtgtaggaggatattataatctatatgtcaagaagacctgtcttgcaagtaggtgttgtactcacgaattgccgggatagcaattaaccaccaaaggatcagccgatacacaaccaaggggttcctgggaggaatccagagacaaaatttcaggaagaaggtgttaagttccactgtcatgaaaccgacgcagagacagaacacttggatgaatctccttggctccatgaaaggatgccattgatccttatcccatttagcgggtgtgaactgacataatgacctttttacctgccacaatggaagtggttaaccaatgaacttaaagtgaacttgactagcttgcgcaggataaaccagctgataccaaaatcataattttgaggtcatgataaacatgcatatgctctggtttacgaatttgtctgtccaattcataaaatatcctaccaaatcagttccagactcctattcttatcctaatgtttctattctactccttccgtcccaaaatatagcaacttctggctagtatccctgtgcgtatggttggaggtattttgattagccaataccttccatgcagcccatagttcaattgctcaactctcaccctttaggcaggtagctttagcttggagccttagaagtgatcaattgtttttcataatctacgaggctttcttttttcttgaaaaaaaaacttatgagactatatatgaatatgacccacatgtagtcagagtatttaagtgatgtatattgtatagagaatggtataaagtggaataattacttgcttagaaattcagggattaaggataccaaactgcagacaagacagcctgacttctgcggcaacagaaattcattgtacagtcccactgggaaaatcccagattctgcctgggatctcccatgtatggagttaagatctttacacttgcatagtacatgcagttataggatgacttatcttttgttaatactctgccaagtccactagaggttgtctaacttgaacagtcttttgttgacaatgggaaaaaaacaacaacctctatatcaagatatacacagccttctaactcaacactcgaacagtctgcataacgtcaatcttatggcagcagcataatcaaacaaaaaatcttatggcagcagcattggcgcacataatcaagcattggtgaaagtatttgtgtcaggatgataaaatagcaggacaaaacagcaaaaacttggaccactggtcattttttttaggtatgcaataaccaaattaagagattaaaactgaaaaaaaaaaggaatatgccttctattaatgtgttttcgttgagcaattgagcataccttacccataatgcttggctgacggctcagtccaacccattcgtatgttttgccatcaaagtaacggactgtgtgcatccccgcccaaatacctgtatcaagattcaaaatactagttgaatggaaacatttcgatggaacaacagtaaaacttctgatgttcatacactgaattacgaccgtacatattcgttatttaaaaaagaaaatgataataacaaaacacagtgaaccttttcaaaggttctacatactcaggccaagacaaaacagtatcaaggcaatgacatcctagttagtgcattctgctacacatatcaaaagggaagttccgattgagaattgaaaatcacgaaaaatttatcttgcagacaagctgtcctaatcaaccaagcaagtctacatatgaaataacatgagaaacatcgacataacaaagcccatattcactgctaatctgtaccagtacctctaatgttttgcactgacaactcgatatccttaaatctagcactctatcagcatccagaaaagaaacagctatgtgagaacttttgatacttttaacttgtatgactataataacatttttttattcagaaatataacaaccagatggatgaattgtaaatttagatactgccttgaaagacagagatctcaccaaaccaattacatatcatgatatccaatataatactgtcccaccaacactcgttaaaatttggcagcatgtgcctaaatgtaagctgcagaagatatcaagtgtgcattgttacaatagttcatgaaaatttactaaatgaacatatgctaaaataaaaggaaataatatttcactagtcaaggcagcttttctaacctccatgagctcaaaaccaactgacaagacccataggagaagttggttccgtatcattactgccttaccccaccaacccaagacatgggcaataacaaattcatcaaacaatgtctcctataggtgcatcgtattaccaattttgatgaaatagcattaaaaataaatgagtgttgtgaatagtgatgctcatatggaaaatcatacttgaatattaataaatctgttggtagggttttctggaacatacatacggcagtcagaaccatatgatctctctggtagttctgcattttgatataaacaaatgatcagaatatatatatctatagatgatattgtgatttttcccttgtgaatgtattgcataaatattctaccaactccgagaccagggtgaaggtgcttcataaactgcctggcatcatcacgtttctaaaagaaaacggtatatagattagacagcagactaaatttgaacacataattacaatatctaccttgagcatcaagtttaaatggtccaagtgaaaggctaatgagtaaattttaagaatagcatgttagtgaatacaataaactgtagacatagccaacctggaaaagaagaaaagttagagcaacaaggtacacaacagccatgccatgcaccaaacgccacacagcaggatgaggcctaataagtatcctgtacaaaagattattagcctgatcaattagcatcctcataagtatttatagttctttacagagcaaaattagataagactctcacaaaggtatatctactcataatggccaaacatcaggtgcttctccttgcatcagaaaatcagcataatctaagtagtaaatggtccaatcaattatgtactatgagaatctggttttgtgagatcaagaacatagatgccttttgtggtgctggtaaaatgaaaaacatgtaatatcgccagagcgagttttctttgctaaatcataaacatatcatatatgaaaagaatagcgtatttcatttgatatctgaccaatggatgcctgctgacaagatgatgtgatttaactcatttactagaaagcatatatgcggggcttttggtaggatagaacatttcaccttcaatgtcaatcttttaatactttaccagaaaaaaattacctaaataatgcacccagtgccaataataaaatgtatgactgtaacaatctccctagccaataggggaccataatgcagaagaattggtcatgaaagatccacaaggacacaataatgcaaaaaacatttatttaactaccattggaatacagcaaagatttggagacagacaaaaaacaattattacactgataattgttaacatatggtttacctaacaagggataattcacttacgttgaaggtgcttggagagtgcagtatgctaggaaaactgcgatcatagcccagacacccctgagaaaatgtcagtgagtgaatcagtttcctggcattgttgcttactagtacataccatcaacagaagtccagtaaaacaataatattggaaatcatcctacaaattcttatcatttagagtaaatgtgtttcacagtgtaataccttttaataggtatgaccttatcatgagagcttgtaatctctggatgaaggaccccacttgcccagctgtgagaacaataaaagtgaaccaactgccagactgatgagaaagtaaagaaaggtgttcagatctagctacaacattttttactaataatacaactgttaaattgtcaattcttgtatacgaatagaataggttggcacccaagttagatgactggtaacaggcagcagcagccaatacgagctcgtgtttatatatgattgtttatgaatttttcaagcataaactagtacttttcatgccatgatgcaactgtccttaaataaatcgtagccattcatttcgtgtcattactctgaaaccagttcaaagaatgggctggattcttcatacttccaattaccatgaattgttccctattccaagcgcttgagggttataacttataggtaactagtatgagagtggtccaagtccagcaagactaaaacacatggtttgtttcagagtttgagtatcccagccacatctcacacagaaaagctaaaaaccagaatctgcgcagaatctcagtggatgttatggatttatagttgtttgcctgtattgcgaatactgaatttccaactgaaccatgaaatgtttggtgaagtggcattgaacatcagaaagtatcccatacaagacacaataccttgtactatttacttttgaagacaaatggcacacaaactatgcatatatggatcactgagaagtccaaaagccacaccagttaaaaataccagaggctgcagtaacagttctctgccatttttcagcatagcgtaccaaaaaacgttagggatcaaatatggtttccatattaagttcccaattggagcagcaagtacagtcttaatatcttttactaccatctagcaaacttaattagtatatcaatttaatctgcacattgagaaataattttactggttataaactctattaagctccaaagaactaacagaaactaacccattttctacatccctaagagccttacgctcagacaattcttgcaaaagcagatactagcaatccttgcacatgtatttgagaatttagactacttacatcaggaggcatgcgccggcaaggagaaccgagaccgtgtgtggcttgtaaagccaagccgtccacgggtcgtattcctccacgccgccgccgtccgacggccatatttccatgtcctgcatcctctgatcgttactagatccatattccatcacctcaccgctggcatcaatggagttgattactcgtctacctgcatggccagttagagaattcggatggagagatcaatatatataaaaaaaaaaccaggatcgcaatcagtaatcagaacgaacgctcgcttgtaatgagggtaagaattagaaccaggatcaatcaaattatcagagacatgatagagagtagcaaatgcattggggttcacagggttgatcaattcgacggagaatcgcagaaggatcgcaagaagcagatagaagcttacggtgatggatgggagccgaatgctgtggaagcgacggcggtctctgctgtcgagaagatgggcaggcgtcggcgtcatctgtgtttacatcgcctccatctgggctgggctgggctgcggtggagctcggggggtaccacctccgacgcactggcatctggcagtggcagatcaggtagtcaggtccccggcgggcctcccgagctggcactcaatgtgcatgcatttatctgtcaagtgtcaagtgtgtttataacatggtaaggattttcactttgagatgtttgcaaagaaattctggacaaaatacccacatgaatactatgaaattctttatcatatgcgggtaactcagcgtagaaaacgtcaggtacacctacaaaatgctctttaggctggtggagacttctcaatgcgcacgtaaaattgaacgataaaatagtacatagttaattaaatattaactaaaattaaaaaaatatattaatatggtttttttaaaggaaacttttctatagatttatttaaaaaatatatcgtttagtagtttaaataacatgcacgtagaaaaagagaaagtaaaagttaaagcgtgcacgtgaaaaataagagtagaagttaggaaaatgttcaaaagagggagtagaagttaggaaatttactcttgggtccatttttctctagcatattctttcgtataaattgacatcagacaatcatatctacttgaaggccactacaagtagagtagcaggcaagtaataaaaaagtataagggtaatattcatatataattagtaaaaataaataaaaatagatttttcacagttttttttaagatatatcaattataaaatattgataagattagaccattgtcatagtaagagaccatgattccttatcgaactcatgtgaagaggacatgaaagcattattcattgtcgtcgcatctacccttgcgatgccactccttcccttgtgtgcacctgacgtgactatgtgtgcgtctctgattgctctcaacttgctcacaccacccaagagttcgcaccgaggacgctcgtgaactcgcacaacattatgagtttgcacggtgaactcaaaaactcccacaatctcaaccgccgatgacatcacgaatttgtgtgttttggtggtatgaactcgtgcgcttctattgccatgtcaatgattgcgtatctttgcggatgcgatgaccgtataatgttactgttggttttgaaacgagtatatttctgtcacgccgataaaaaaaatatattttcactttttttcttttctataattgtcccgttttctttaagaaaaaaaaaggtaatgaaaggctaggtctcgtgttagtagaaaacgaaacatactggagggtatatatgcaaaatccacaatactggtttgtagcctgggagtctgggacgacttcgatttctgtcgcacatccgtctcccacctgactcgttctaatcggcgaagagaaacccacacaagaggaagatggcggcgccggcgaccggcggcgggatctccgccgacgtccccatcctccactcggagaacctcaccagcaacgtcaaatccatctactacaggttccgctcgttctcttccccccccccccccccaaccaaagtttagaattcgatctgatctgataagtagggtcatgcttatgtctgttcgattggatctgggatttatgcgacgacatggtttgatctgctcagattagccctaattctttcgattcaatccggaaccgtgcgacctggtagtttcactgtaggcatgcttccgctcttcttgcggcaatttcgaaatctcggggtgcagtttaggatcaaaatctaagtactatgaataataagaaaaggatcaagtaattctgtgggccagttcatactgccagaaactgtgggtcaaattgcacacttacactaggatctactaaaattagagtaatcaggcttcatgaatcaactgaaagttttcaatgtttacatgcttttctacttcatgctcagatagatgctagatacctcccattaactattaactcttttcgtaaccctttcagcaattctagtcattgatgattatttttgactgcttcacttttataccaagatggcaaggtgatatgtcttaaccgtgaggattgattttgcgttgcagtcggacattcttgtcaattatcagtggagttgttgccggaatctggggattcacaggcttgatgggattcgtgttctaccttcttgtaatgatggtggcatcccttgggcttttgctgaaggccaaattttcaattcatacatactttgacagctggaacaggattttgattgaaggagtttttggtggccttatggtaagccatactggagctgtaacattgtgatgcacacctttatttccataaaacttgaatgtccagatcattcaacatgatttacatgaacttgtatctttcatgtttaatctatattctatgttattatgaagcatgggatgatgggaagattgatcattttagaaagttgatgaatgtggaacatcccttaacaatctgttcgggtttggcattttaaccaaattgttagaaacctcctagttaggaatagtgtgacattatcatggatcttcctagctgttaaaaggtggcctggtttggtggtagaatacagatttttgatggaaggagtataaaacattgggagcttcataccctaactaatgattcacatctcaattgttactgttgactgttggtaaatgttctcaagttatacaaccacattttcttaactatatgtttggtgttgctagtattctaatatcaatataggattctattgcctcaatgtatagttcatcactagattatttcctcaaatttcttcatgataatgagctttatcctgttttggatggtggcctaacattatttccttgctttttttgcagtcttttgtgctgttttggacgtatccttgatgctgtaaatattattgctattttcaattttccatatatacacaaaccatctagtatttcttattcagtataggtgtcaggcaaggtctgattcgattactagtataatggctcaccaccatagaaccatactaaagccacataactgagagtatgtaaatcattattatgtgaggccatagcatgaatttgaggtagaccattgtggttatacatttgaagatgccatataaattatataatgcatgccaatttttatgtttgagtttgtccttaacaatgaacagatttgcgtatgatattgtgcacatcttctgatgcacggcataaagaactcaactccgaagacttgaagggagctgtggggtttctccttgaactgaattaacgtgtaaccgcaccaaccctggaggactacattcgttggactgctgtcctgttttgttccttttttttccactccacatgtatcagttatagctctgtactttagaaagatgcaagcttattaagtttaatttacaaattgatgtagaagtgaatccaattgctggcaagtatggtgcttgatcttttgaacatcagaacttgctaggtaggggacaactggtcattgatacatctattgctgcccagcgtgctgatactatactccactagtagtatgttatattgttatcgttggagctctgaacttgcatattgttgatctgatatggcaaagtaaccactacgtggtgtttgctgaggaagttttcaactagcacttcgctatcaagacgtggatctttccagccccggcaaattccggtagctgcaagtcagagggcaacctcccattccggcatccagcaaaacgttgcccgtgggggccgcaggatacaccgcgcgccaagtcgttagcgttggtgtcaatttctttcttgcttgcttccaacatagtgttcccagttcaaagagattgcttttacggcttgcttggcaagaataattgggaagaggaatgaatacaagccattttttgttgggaggagcttccaacatagtgcttcccagttcaaagagatagcttttacggcttgtttgccaagaataattgggaagaggaatgaatacaagccatttttttgttgggaggaggaatgaaatgtttcttgggagttgggaggaggaatgactgtgagttaaggagatttgggtgttctgaattcacactctgctgcagacacgattaggagatcgtgcattgccaccatcgacgtctcactcgtaagagcatccgtgtcttatagcaccaggctagttagttgtgcggtggcgctgcggtgcacagaggctttgggggaagcagagccatggtccgggaagagaagcttgactttgtgctggtgccgctgggcctggccgtgctggccgtctaccacctgtggctcctctacgccgtcctccgccaccccacccgcaccgtcgtcggcctcaacgccatcgcccgcaagcgctgggtcaccgtcatgatggccgtcggtaccaattgattctcttcttcttgtcatctctctctagagattctagaattgtcagcctgtctgtcgtacgttcttgtgggcgcagaacacggagaagaacggcgtgctggccgtgcagacgctgcggaacaacatcatggcgtcgacggtgcttgccacgacggccatcacgctcgtctccgtcatcagcgtcttcctcggcgccacggcgggaaggtccccggcgtccccctcgtcgtcgtcgtcgggggcgccgctgctggtgtacgggagcaagaccggggaggtgttcgcggtcaagtacctggccatctcgctctgcttcatgctcgccttcgtctgcaacgtgcaggccatccgcctgtacgcgcacgccagcttcctcctcggcctgccgcccgtcgccggcgagggggagggggaggcggcggcggcggcggcggtagcgcgggaggagttcgcggcgtacgtggcgcggacggtgaacagggggagccactcctggtcgctgggactccgcgccttctacgcgtcgctggcgctcttcatgtggacgttcgggcccatcccgatgctggcgtgcagcgtgctcatgtgcggactgctctacttcctcgacaccaccagggagcgcgccgccgccgtggccgggatccaccacggtcacaaggatagcaccgtgtagcagcactagtagtaagtagtaaccagtttctcgatggcatggatgtacatctattgatctatagacccatcaattgttttgcttgagtaatgaactcagtcacaggagagagttagctcatctttcgaatttcactatcttttttaaacaaataattttgatagtgtgaagtttcattaaatatagcagaaaataattacagtactataatcctgagaaaacaccaccaaaccaccatcacgcacagacgtggtctacccgcacacctaaggaaagatcaacatcaaaccggctgccgctagatcaataaggagctaatgatcaaatacagacccaaagacgcccaaaaatatcgtgggaacatgaggttgtagagggagaggacgagagagaagaaagatccctctccctagcacacacccgccctcaggcctccattgccatacaagggctccatccaaacatattgagaacgttttttggtgataaagaggagaaaagcgacgaagagcattgtcatcgtccgacaaggtatcaaggagatccaagacaaggttttcacccaacggccccatcaggaagggagagggccgtctcgacaacgccccctagagggaaaacaacgctcaaagtgtcgccgttgtcggcccagcaagaccggggtaggctttcacctactgtccacccaaagttttgcagaagccactccattgctccacccccggtcatccaccatcggcatgtggacacgactaaattgatgccccccaccgaccagccttcgcgtgcctcaaggttcaccaccgctggctaccccaagcatcctccaccgtgctgccacccggtgaagggtacgacagctccctgccgcaccaagccgaccacatcgcctctgcgggtgcgtgctaccatgcctccatggttgcactccccgctgctcgctccacggtcgcaccccacctccacggtctcttcactccgcacctccacgtgacgtcgtccgctccctcttgccgctgcctagatgcctcacgtgccgaggttttgccgccgtcattggctacgctatcacggtctcggcgggcactgcacacacaccgcggccatgagcacggcatctctagattcgcggcgccggaacttctcctctacgtctccaggcctcgttgtcgtcatcaccaagaaccgttgcaagggatccaacctcccttgtcagagaggctagctccacacggcgaggtgtcggatctggccaaaaagggcggcgctgcgtgtggcatgatccgtcaccacgctgcactgcgcgtcgcctcagcgcctgctaccccgccgccatcacctcctcctctgcctctccatctgccactctcgtcaccactaggcgccgccgcctccatttccgtctcccgaactgcttcagtgttaacattaacatgcaaaatgcaaaagaaaaattccagatttgcattcgattgtgctcctcagtaccgtcaacaacactgacatgcaaaatgcaagagaaaaggaaatgaattattgtttgcgagatatgcattattaatgtttaaatgattttttatagaggaaaaaagatttagtaatttggaaaagttattctagaggagtatttctctccaggctccccgtcatagacaaagaggagcccatgaggcgaaggctcatgttagaccgagtttacggagagggccagacctaaattggtgggctcggatcatggttcatggcccaaacaagtgtggcccagtaggaagtgactaggtccacgtagaccaggtgtatgcgagtgtggatggagtagtcggtggacgggccccgcgtgtcacgaaccgagtgcacgatcacgaatctacgaatggttggctgctcccacactttttcttctttcgtctctgttctctctctgctgctttgctttcttcgtcttcctcccccttcctcctcatctcctctctccttactctccatggagatccccatccccgctggatcaccatggagatcgagagaggggagaagaagaagaggggggggagaaagaagagtagggggttggaggaagaagattcgcctctatgaccatggagaccgctggacggagaaatagtggttgccatcggagctcactgtctcagtcactacccctctacggattcgtcgacgtcgacgacaacgaggagttaaattggtttactactctgcctcctccagtcgaccgcgccgccggtactcctcctcacgcctcttgccgccgcgctgccctaaaccctcacccgctcggcctcctcccctccccatctccctcatccaccacctcactcgatccttctttattgcaacatcccgatcccctcgcatcgccctcgaaattctcccatcttcgccgagatagccggcgctgctcccgtcttctcggcaagccagcagccgccaccgcctttcctcgcctcctctcccaggcggcttcataggtacggagaccagcactgaatcttgcaatttttaaatagtaccatatatgcgcaattattcaggattatcataggatgctgtacctgttagtcatggttttgctgaatgctgtatctgctctgttggcttatgatgccattttcgtcgttaatctatggattcatttgaaatgagtccctttttttttctgtcatagttactctgatagactgccatatcaatatttttgtaaaatatagttggcttatgcactgagacatgtagcattcgtactgaagaccagagatcatatcatgaaatagtgtggtaccaaaaaaccctagtaccatgacattttttttttttgctctatatttatactattatgcttgacaatttttcagatgcaagtgcactcttttgactgcttttttgtctaatcagtgcgtttacttcacttcaccatagatccacaaagaacgtttgatattcttgtagtgcaaatgatagtgcattttttttatatttattactgtaagtttatttgcaggtgtgatatctgttaattcttatcttggatttatcatttttgttatcacgttatctgttttcttttaagtgatgtctattaacttagggtgttgtaattagccaaaacaaacggttaattagttatcttatcataatagtttgtacgtttgatcaattattcaaatattgatgtttatttctataggttctccccctccactttagctcacatggagatcaagagggtgaagattgccgttcacgtagcgaggatcatctcgatgatcctcgccatcggggtaatgtgtgtcatttatataccgacatcttatgtcaagcctctgtcctacaggttagtgtagagtttgttctcacttttccccggttgttttgttccaagttaatttagagagtttgttcaatgttgttgtttactaaaataattagctaccatgactaatatgctaatcgactttgtgtgcagatatgtcttagtggctatgtggtttgaggtgatttggggtttgctggagttgctcctccaagcaacacacccgttcctttgtggcgtgggacatatatccactacactgctcaccatgatggtcatgatcaacatgatatgttcactggctcaaataatcatattattatttatactggaaatggagggaattaattaatactttgtttatatgggcggtcttaaaaagatgtattatgtcggaaataaaatattaagtgacaaatttgctttccttttaactcataactcattcgccccctctcaaacgtcttcctaatttgattaagttatatttatggtcatgcaggtgcttatgtgttgcacgtggggtatggctattgcagccttgagcactgccctatttgctagacagcacagattttgcatcagcgtgtttaagtgcacacggttcctagttggatttgtgctagcggtgtctgttggatttcttagcgccgtcaaggcattaggtatgctatggatcctcggatcccaatttcctcgtgccgagtaggagattagggtggtatatgtatacacacaatctctgtactctcgtatgttaagtacatgtgtagatctgattgtgttagaaccatgtaaacatctatgtctcatgctgaggactagaaaggtctgtctacacatctacgtctcacggcaatatgattggagaagatgtgatagaatgacttaatatgatatgattggagatgtgttaaaatcgctagtgtgcttgttctttatcttgcttttaattaagttataactagaagtggccaagatagggcatttatcaagagtagggctggaacatataatttcaataaaatatagtatttgaaattccagctaaattctagtgttttttgaaagaaaattgcgacgtgttatatataatgggccaagactggcaatatggcattcaatcagttgaacaaaatattaatacacaatgtctgctacaggaaagagttgcttcagcagtcgtgaaaattatagtttttttttcttcatcagttcatcaagattcaagaacaaggttctccagccttgcccttttattccttctcatttctcaagatatcaaatataacagacatactcctattagcgtctacctttactccctccgaagaatcagcaagctgcatattttttagggggaactacggcgggtgtttataccagcctgaactttattaattggctaaaaacagatttttacaatgaaagatattacagggtcggcaagctgcatataacgtagcatcatatcaatccactgttcagagtaagccattaaacagtatacaagtccagtgattacatacatatcccttctttctataaagttagacttaaagctgaaacctcagtgttccacgtcatcgctaattcttagtcgttcgatcggtggatgagatcgcatatgaaccgttcgatcgaatgcttctgtcgttgatttgattcactcgccccgcacggcctatcatggcgccgcatcatacatcggagaaaataacgtgtgcttggatgccggttccctgtcctcattttctcaatcgagtaatagcatttatgcgccttaaaaccggctggcactatcgattggtctgccatggctgatttccatataatgcagacctttaatcctctgtggcactagagttcatctttggctttttagctcacgagctctccaaatcattctacatattattcttctttcgagaatcattctacatattatttagatttaattcatatcaacttatgtaacttatgtttatgtaagcttacattgtttaagctatcttacacattatttttatttattgttataatagtaaacttccgtagcaacgcgcggggtttcacctagtataaacaagatacattgccatgaaaaagaagataaagtctgtgctagacgcccagacaagaaacttgatagtggacaaggaatataaatggtactgtcccagatgttcctttaataaagaaaaaaaaaggaaaggttctatggttcagaacatgtaagcaacacagttacaaaatggaatctagtaaggtatatgttgagtttccagtcaatggcattgaataatagcaccggacctgctatctacctcacagactcatggtagattaatttggagggagaaatgaataccacgatgaaagaaatgcacaggtggctattatggtttcattgctgtctattatatcctctattacaaaagcatatggttacttgcctagttggctacctgttcaggacgaatattttcggttggcctcgcggttcattttgtattgacaaccgcagtcttccgctgctttacttctgtattcatgggtccaaatctggaaagattaagatttgagtggtttaagtcattggccaagcagacggaaagcaagaaaatgatgtgcttatataaagatggaggagcttcattacatagtgcagcatccaggtgaagccctgaagacatggggcacagaaagcccaacatcgccccagcgcaatgaagcagcctcagattcaaggccccctgattgccccaaatttcttcagcgttgctgttacgaaatcagagggagtgattccttcacttgactgagacctcacagatgttaccaaagttttttgcaatgtccaacagggcttccgcatcagctatttgctccgtaggcctctgcactgcattgtaaaccagcaaaatatagcataagcagttatttgctttctagtaagtatgcattctggcatgccacagtgagtcctaaccttttaatattaacatggcagtaaatccaagttttgacaagaaatgcaatattgcaaacaaacgacaaggcgtcagtcttgcaaaagaaaagaacggagtaattacatcgaaattaacatggaagaaccaacgcgattaaaattccatagtcccactatctacataattacatattgcaatatccagctccaatgcaatacataatgttttagaggaagtctctatatattaatgaacagaagaatcttgatgtagttggcaagaaaataaacttgtccacatgctacacataattcccctaattcctaaggggcatcaaaagtccaaaaaaaaaataatcaacacaaatgtatctattttgctccataatttgctgatgtattctgatgttggcaacttggcatagcaatttgaagtaaaatatcaatagtaagaatgaaatgggaacatgaattttgatccttaaccccttccctaggcatatttagttcttggacaaagttgtgtctcaagaatggggaatatgctccatgaagttttcaagtgaaagcttttagttggcgaaaatgttatctcaataatctgaactaaccaaccaatgttcgaaatcctgctggaatttattgcacatactatgcagatcaacaactttttggtacccattttttctaaatctgcaaaaagtgcttcagtagccacttcagcaactaatagtctaagcatgcagttcaaatatcacaatgtctttctaatttatcaactcaaatggcacacaaatttgaaacagcaactccaaggcaaggatgatgacgtcacaccacttcaaagttgaaactgtaacctcaaacagattgaaacatgacttccagaaactactcagtttgctaaactgcaacaaattccaaactgggcaaatcatcggattggaaaaaaaaaaacgcgaactgtggtgattaggtaccatctcaaaatcctgacagtaagctttagtcctgaattttatacaaactatatcatggaatgagttctaaacatattagataaaagaaagaatcaaacaccctgcaacaaagtttagtttagaaattttctatagattatagcatggattgacctcagcctcatgattctgaacagtttagaatacaaccttggttgaaactggacatagaccaaattgaggtaaccaataatatggtagcttttccatggtgagcagctgcacaactggacgactccaaattttactagccttggaagaaaaaaaaaaccattcaccataacctgcatctctctaaacattatgcttaagagctaataaggaaaagagacaacaaaatcaggacctcacacaaaatataccaaaacacaccaacagtccaactaattcaggggacaaaacactaaacctcatcattcattcattacgtgaatcaaacaaggatgcgcggcatgctttgcgtgccctaccagtcgccttataattaacatgttgatttgagcgtgtatatcgctggttgacatagaggctaaaagctaatcattagatatatgcagattgtggacaggatttatctagcaaaatttgacacatgcatggtggcagaatagacagtacatagtaatagcggtagcattacagcagttatgctagatgagcattacctgcagtacagatggctaaatgctaaggtggttatttagatgcctttgcagcaattaccctttccccccttgaattcagaggattgcatcacttcaagggcctttttgttgatgtagaaatgcaaggcacatatttgtctaacttgtaccatcttgtttctatgatgaattgcttccacttatacatagctgtttgaaaagtgctccataaagacaagtgtcaatactgggagtcaataaccttatggcattgaactactcaacaatatttagatcataagcatcctcccctcataatgttcttttgctgaatgtgaataaaataagttcacggcgttatttttgtggtatatgtttagattgtaaggattaatacaggcatacagcagtagttgatgtcaagtaatctgtaaaaaattaactgaaagaccaagaacaggtacaatatccaaatttaaaccaatttcaggaaataaattgaacacatatatattatggttatggaaatacaaaaaggtaccggccaataaaaaaatgatttatccgtactaaaaaacataagaggcagacaaacaatctaatctattgtcttagcaattttctcataatcaggaaatgtaaactgagcaatttccccaacaacataaacatgtctgttcagcaaagaaagttgtaatggagaaaaccaggtcagagggggagagctcgagctgcatcgctacctatctctcttgttcgctctttccggccgagccaaagccgccatcatcgctgtccacctctgcatcgctcgccctcgacgaccccagccctccgccgcgagctgcgccactaggacaactgctcccatccgcaaggccaatgccgagccacctccgcgagcacgggtggaagaaaggcatctatgtcctgcggcagaggagctggtggcgccgaggtggcggcgcaggggagctgggggcggggcgggccgtggtcgccggcggcggggcagctcctcactcctatgtgccaaccggccgcgttggcccctgtcccagcaggagaacaagggggggctcaaatgtaaaatagggagacgactccacgtcggacgtccaatattccaccaaatatcagatgcccgactgtttgtacgtcatcacaccacctgcatatgcagcatgtaaaaaaaaatcggtcggtcaaatgttccagttgactaatgagtgaaacatcaagttatataggctgaaataaaaaaaaatcagtaactgaaacattaactgaaacattatgaagatgcgcgttgaaacatatcgctgtcacatatgaaacaaccagtgttaatggattgaaacatatgtttttttcatcaaaatataatcatgcgatatcttgttgtaaagatctgcttcctccatttcacaatgtaagttattctagcatttctcatattcatattgatgttaatgaatctagacatatatattcatattgatggtaatgatgtctataatataagtcattctagcatttttcatattcatattgatgttaatgaatctagacatatatattgatattaatgttaatgaatctagatttgtgaaacggagggagtaattataaagaatacaacggtgtgatcggattgtagattggataattagtttaacagaaaaatcgttttgaaactagctaaaatgcatgcatgcatgcatgaggtggagagagaggacagagaatagtaacaattagttttgtgaattttgtgaaatacgctgaagacacatgttgaaacatgtcctattacgtatgaaacaaaaagtgttaatggattgaatcatatgattattttttattagaatataatcatgcgacatcttgttgtaaagatttaattacaacgaatataacggtgtgatcgaattgtagattagataagtaatttgagagaaaattcgttttaaatatcattaaagatgtatattatatggttggagatagagatacattttcttagataggtgcatgtgtatcagtttgtcagaggctgcccgtccaacttttctcattggttcgggggcaaaaatcacctaatctaaacccttctcacaaaactaccgctcaacgtcatcaacaaatatgtagcgtccgatttcctctccagatgattctaaccgttcgatcatctgattgactcctcaagaaagttcatttgcaatcagatcctttcacatccctggcgtagaaaaaaaaggtttactccgcccccaaaccgcgacgagattgcgggggcacgccgcacgggcaccacctcgccgcccgccaccaccgcttcctcacccgccgcagccaccgcctccacctcctcctcctccaccaccttcctagccctgctgccgcttctcgtactctccatccccgtagtcggcatccgtgcggcctcagcacacctcctccatctcccagatggccacatgactacacagtggcgctcagccacgtctcccctcccctacggcaagttcagagaagacggagctgggggtaggccggcaacgagtcgccatctcctccccacgagcccacgcctccccgcctcagccgccgcggcccaccactccggcttccacctcagattgcgaatcgcaaggtaatgagtactaaaacacaactaaatgcaaattcttgaaggtctgtaagttgggttcagaaaaggccatgcaaatgtggtcagcgggtgctgatatagaggaaatagttcaagccagcacatgcaaacaatttaacttagaagaagcaaattaggcatgcagtgaatgagatctcccatttgcttgactggttttcttataagcttgatttttctctcagatacgttgctcatatcatgatgattgccatggcaaagttatctgtctatagttccataatcaaatttcatgctgtaatatcttggaagtgcttaaatgatgaattgatgttgaggaattatatatcttggaggtgcttaaatctcatcctggaattatatatatccttaaagtcaaatacccatgtcaaagttagtaaatgtaaactttcttttctgaaaacactagaaagtgctgaaggcaaattaggaattagatatcttgatggagagcacatattggtatttccctttgttttttcaataaaattttcattgttacccagcaatcatgtaaatttgagttttactttcagacgaaacatcaaaatttataacaagttgagatattgaacatctcaacaagccatatgtgataggtcaaggcgtcaagcattatacctttccctacaatttctaaaaaaaagacttaacacaaactttaatttttagaaatataatactataattaattaaggatgtcctaagcattcaaaaagggataagattaaagctaatttccatgtcacctcaatctatttggtacaagaaaaaaatgagctctacttgatccatcttaatctggtctcctcaaaaatattaaatctaacatcctgatcgacaagaacatatattaaaattttgggcttggattgattcttctcaaagttgttgtgtgtggtatcatgtcaagggctttgtgcgatatggtagctggcaactgaaaactgtcaaattaatctatttagcttagttcagtgctgcaattgctcatcaaagagacatgtaaagtagtaattccatagaagaagaaaattataagggacatgtattttgcagaaattaagctccatttgctcatcaaagagacatgtaaaggagtaattccatagaagaagaaaattataagggacatgtattttgcagaaattaagctccatttcatgcttacacaccataaagaagtttatgttagtttttagtacatctggagtttacctgagaacagattgcaaaggttgtatatgtgatcagtgcactgtggtaaggaacagagttaggggtgggtgctgtggttcactgaccttattcaacaattactggtgaaccttgggaattttcgctaacatatataactgtcatgtcacttcatttatttttgaatatggtttgaggaatttcagaaaagttcaattgttattttaatttttcccattgttttagtgtttatggttattgtattttttcctgttgcaacgcacaaacactttgttaatcaaatattaagaggaatttgggcattctttgtttctttagcaaggtagatatggcgttgcttgtttgtatgccagctttgaacccaataaactcccatatgacaaagacaaaattattagtcttgtcaagtcttatcccagtgaattctcaagtatgtacattatgagacttcgtttcattttaataacttcgttgaggatatgcgaagtgacaagaggttcaaggcgtaaagattggtaaattcatttaataacttcactgagagagtctttttttaagattagtgattaccgattatgtgatcgagcgtttctgtgctatggaaaagcgccacagtgataaatgtgattaaatttcatcgtttgtgctatgtaaaacttgattctaactgtacttttcataaattaagacctttgttgtatttatgtgcatgaagactttgatttggcacttgaggcgtcagaacacaaagggtaaagatcctcggtttgccactggctggggtggatctggtgtgacgcagataccccaaagcactgagaagccattgaggaagctcactcttgaggacacgcgcccctttggctgcactagcacagatttcacaagaacagagaagagtgaggagagcaatggaacaagaagcagcaacagctttggcagccaagcaagaggaagtggcgcagctcggggagggtatcctccaccactttgagcaaatcctccatcaagattccctcatgtaatcacatttggtttctccattcaaatttctccctgcacgcattttcttgtcctcacttcttgcattctgcaacacaattttttttttgaaattcaatttcctgcgtaatttggctgtttttaactctctgatgagcattcatgcagagatgaagtggggttcttgcacccgacacagttccagtcactagaacacagccagactagtaattggacatttgaagtacctgaatgtcctcagagatacctgtggtgcaaagaccataagcttgccatatccacggaaatcttacctaagctctaccgtgctgcacagcatgcatactccaattcagcagcagccaaggatggttcattcatggaaactgatctgatgaggcacagcaaggcactgctcattctttgccctgacatgctcaccgcatggaactcaaggtaatgctgtcaacctatcacggtatcgctaaaagattgcatctttcatagctagaaggatgtgactttgattaagttggaaataaggttcatcactgcctggaagggattccacgtggttgttttatgcttcttttcttttggcaggaagatagtgctatcagtgaattatgatttcactaagctcaaggatgagctgcaattgtgtgctctgatcctttcatactcaccaaaaaacgaaagcacctggagccataggtacagcttgtcttttcacttgtcaagttgtcaaattatggaatttggggaaactctttcaggtcacctcttaaataatttagggattttttaggaaaaaaatggatgcctatgaccaacaggtatgataatcttgagatatatgccccatgattatttatgagttcctctacatttcaatacctcccattcttccgaggaccgctgtaaaaaactcgttggggctggattttatttgggcagcacagaaatattatgttgattttgcccatgcccacacagtttacagtttaaactttaaattgattgcctactacaggagatgggtgatcaagaaggtttcagagcacaaccaggatgtgtcggagcttatagagatggaatctgtactagtgaaacagatagcagaggtcatacttataaatatttacttctttgggatgttaatagaattattcccatctactttacggaaccttcatttcctagcagataattatccgaactcatcatattagcatttcacacagttccttatttaactggttattaaattacttttttttgccgggtggttattaaattactttgacatttcacacttgtagtgataaacagtgtacaacaagatagtttgatcctttatgcagaaatcaaagatgaactaccgtgcgtggaggcatcgctgctggcttattccctacatgacaagagaacaggtatgggtaaaggaaaatcaagctgctaaaaattctttgtccacttttcttaatcttatgtgcaaacttctgagcaccaccatggtagctaggttaggacttttgttatattgcaaaaaccctacaaaatttctgcctgtctgttatcagttcatgcttatcctcatcagcatctaatttctgttaaaggttctgaatgagttaaagaaatcaacaagatggaacgagttacatgtcgctgacaactgttgttttcactaccgacgggttagtccctgcccttatttgtgtagctagtactaattactacttccaaagcaaacttgtatcccactcaacatttgcatattgaacaacctgtggcatatcgtttgagctgtctcaaacatgtcattttattgattgtttgcagtccctactgcttgcattactagacagttgccatgtagaggacacagaagattcccttgataggaagtcagaagttcatttactgtggaaggtatgttgtatttcattaaaatctatacctgcttcactatggttccccttgtgccatctttccctctgtttttcattgtacatctgttacaaaggaaaaactcgcctgtgcatttcattttatttgagaaacacaaattactctggtgcttgagtaattgcatctgacaggaggaactgacgtggaatgagaaacttatcaggcgctaccaagggagagaggtttgaagtttgcccatcatgattgtgacatttttatgttagtgccataatttctagtgaatgttgttcccctatgttgattgtgctagtgtgttggtgtagtctttgtggatccatcgtaggttcctctcacaatggtggatgaagttcttgctcagcagtgaggaaacagagtgtgctgcaggcacatcgctggtggatctcttcctagtccaggagatatacctcctgtcagactgcctgaatgcccctgccgatgaatttggtgaggcatgtgtccaatctgaacttgcagccctctacattctctggatatcaaaggtaaccccatataaacgtttgaaactaaaaacaagtgatatatcctcctcttcacgaatgatcaacatttgaaaaaaaaaaaaactaagcatgggcatgttgttacttgcagcaagttccggctgtgaaactaaagctggaagaaaggctacattcgttggggagcctggaggatgtgttagcaagggcctgcccggagagaagtagattgtggacgcatttgatagcttgactattgaaagcagaacaaggacatgcattgtagcaatatgtggtactcatatccaacggaaaacgacgcttggaatacaaccatttctgaggcgactagacattttgcacgactcctaaaaaataactcatcttaggatcctatatgatagcagatgcctgcacactattcctgtgaatcctgtggcgtggctgtcgctagtgaaaaagctcacaaaccacatagagtgcatacttctaaatatatgaagttagttaaaaatacagagggagtagttgaatccgccaacaaagcgcaattcctgtctccattaacatgaaccacagaatggttatctgagcatcccagcagctcatctaaatttcatccttcgtactcccatttagatagtcatccaaaaagatttctactccatattacttttcacttaacagatcatccatattacatcctttatataccaacatcatatattttactaatattttacaactaccacttatttatcaccactctaaaaaaaaaaaatcttcccacctttatctcttctctaccgccggtgccgagaggacggggaggacgagggctgatcggaggggcgacgcagtcggaagagcggctgggcgaggggcggtgcgatcgaaggagtggtacgagtggcgcaaggggcggaggagcggcgcaagtggccgacggcgggaggcagccggcgggtgcggaagcggcagcggcggccgacgagcgcggaggaggcaggcggcggccgacggacacggatgcaagcggcgacgctatccttctggtatacctatctctctccaccctcctcccgacgagtccatctctctccttctcccaccgatggtccgctgccaccaccacccagtctttgcgaggagtcgattcggatggggcaaggccgacctgcgacgacggcggtggacggggaattgatccggatgggggcacaaatttggtctgggtgctggcagttgcaggatagcgtgaggagagaggaatgccaaatttagcatttttttctctcggatagatgatgcgttaaatttggagggtgggatagggtatctactggagggcgtttttcttctgctagccgctattttctcgatggatgttcggatggcatatttgctgggatgctcatctatctagaagcttagcttacactttgcctagcttattttgtactataggctagcaacctatggctggaggctggtcaaataactcctactgccttttgttggcacatattggaaacgactattcacctaccaatggaatatatatacacaagaataatatatgaaacatgttgacaatctgggtagcacgcgagcagcttagcttggtgatgtgtcccacatctacttcaatccacgaattccaaaacttggaccctagcaagagtgaaacgatgataagaactcatcttatatagccttcttttctattacagttttacctttatacttgtacaattacaaatgattttttcccctacaatattcaatgaaatttacacggtctagctccgattctttaaaatagaagtataagtagcaggataagtaaagtagacacgtagcattggaagaaagaggaaactgcatgtctatctcttaagaagcaaattcaccggaactatagaagaaagaatgtacaggaaggtacggtacagccacaacagcagtagatgcgaaaccactgtggttgccatcattgttgttattggtcaccatgccttggaacgttgttgttcgccatgggcattgggcaacgtggtcgttcccgtagatcagtgagcagtcgtggagtagtcgttcacgtagaacagcgagcagtcgagtatattgcgctccaaaaactcgattcgcactttctctcggtgcaagatcggggaggcaaatgtttcgaaggcttctctcctagtgttcgtgcgcgtagacaccgagaagggaagaccctagtccgtataagcaatagtacgtgtgttctcttgagatgagatctcaattgtgaaaaatccttcagtttttattgggttactcgtgaagatgaagagaatttgtcaggaagagcttggcaacgattacttgcaccgtgtctcagttgttctgtcgccacacacatttctttgttttctgtttgtgtggatttgcgggttaggttgtaaggtttttaagcccaatttcacttataaagtgggtcaattctctttcttaatatatccggcagaactcatatgaatagtggaaaaaaagttgctagaaaaagaattactagcaatcgagattagaataacaaccacctgttttacttccatagttccatttacttctatattggagcaacagacgaaggcaaaaggctttgcgtcaaaacaaatcgtgcagtgtaaacctcttttttttttagttcaacagcaagtgcaacataaatggaagattatgtcaacaacagtcatgcactgtactccctctatcccataaaaaataaatataagactgtatacgacatattctagatatattctagtacgatgaatttggatagattcgtactagggccttgtttagttgggaaaaaaatcttgggtttggttgtcacatcggatatacggatacacatttgaagtattaaacgtagtctaataacaaaacaaattacagattccactagaaaactgcgagttgaatttattaagcctaattaatctgccattagcaaatatttactgtagcaccacattgtcaaatcatggcgcgattagacttaaaagatctgtctcgcaatttacatgtaatctatgtaattgctttttttttcctacatttaatactctacgtatatgtccaaacattcgatgtgacagcgtgaaaatttttattttgagaactaaacatgacctatgttaatttttttttattttgagaactaaatatgacctatgttaatgttttttgggacggagggagtaaatggcaaaaccgaagataggctgaccatgctagcgagaaggatgtatgcgtgtggtaaatgtggtttctcttttgtctgtgcaattccacaattaagggcatgttaaatggtagagacgggtatggtctcttaaacaatataagattatttagagacaatgtctttacaatagttgagacgacgaaggctctaatcattaactcaaaaaatattctttttgttaatattctttctatttttttactctcatgcaaccatatttctatattatagtgattaagagtcattgttaagccgttgttatgcataacaacgatgtttgtctctccctttttctctttcttccatgtcaataagtattcctaattaacaatgctaaaaaaccactaatgataaccattgtacataccctaagtcggttcatctctctatgtggactaaacacacgtgacttaaattgggggaggacttaagtttcatgtgtatcctgatttaccaattgctctggtacctttttatgcatttcttttgttaataagattgttttatttttgtaagttttatgatgtataaaatttgttcgacagattatatttttccgatatagatagattctaaattttggttgtgattatgctcttaaaagatataatcatgttttacattaccaaaatattaccattgcattagtacgagcatattactactagtttatttaatttaatttagtgggccaaatgcccaattaaacctaacacttatgcggcttgctgtagcacacgagaattgctcccgttcgagcgccgggtacagataagaaaacaaacaggtgctctgttgcgtgagtagctaattctctctctagaaatgcacctttgcaggccctcgtaagataatattcataatctagtttatatcgaattatgaaaagagctacaaagattacagtagagaagaatagaaccgacgagtaccgattagactgttctcgagatcgacttgacgagatcaattggcgagctggcttatagtcgatttgatggtcccgtaccccctagggccttgtatttatacccctgaataccttggcttccaagtagaactcagagaatatcttacacatacgaatcataaatccgcatcccctccaaataggattctaacaccttttatttggggagttggtttctttatacatcagcctaattccttaagactaaggtaaccttcttgtatacttgggtataccatattcgtatgctgcctaaccccaaggatagaaggtatgcctcatccgtaaccctgacaacatgcatgcatgtatttgtttttagcaattttgaaatgttttttctccttaaactacttagccgatccaagattcaatcatgccattatattcatcgcaattaaatctttacaataagatcttacgtgattatatttatgataaaaagatatgtgtatcaactaggggtggataacgagccggctcggctcggcttggctcggtcaagctcgttaggataacgagctagctcggctcggtttgttatcgtaacgagctagaaacccagctcgactcggctcgtttgaaagctcgagctagctcgttaggctcgcgagccaacccatccaaaccatccagccggcaacagaagaggagggacctagcggctggcgagggaggagttgggccgggttgatgtggaggtccttggaggcgacgccgccgccgacgacgatgacgatggcgatggagatccacacgacgacgatggcacggcgcgggcagatgtg

SEQ ID NO: 58634 - DNA, 16222 bp, Oryza sativa
ccattagattctccatggatggtagatatcaaccattcccatcccctaatgtgtgaattcaccgcggggaatcggtgattgggttctcattatcatctctagaccgaaatgaccagaattttcaaaatttcggaaatttcgatccgcaatgtctaaccctgctcaggagcactcccttgctgtcgcacgcccggatcatcacgcagctgtgtaccccatggatggtattatgcctccctcaactctgtgttctttctctgtcatatatcttagaccagtaggccaaaccagcgcgtctccacctccctggatgaggccatgaggtgaccttagccattagcaagagccgtgttatatggtactgttatgttcaacacttgtagttgatttgttctctaggcccctttttttttttagataatagattttcattaatccagtctctatatccacgaaggatatacacagccaaaaggaaacaagagtacttagactcatatctcaacaaggagaacacaacacaaaaaaaaaaacaaacaacctcggcacatcctgcttctctgtctcccgccatattctcctgaaacggccgcccctagtgtgccgttgatgcaaacctccatttgtgccatcttcatcaatttcaggtaagctgacgtcacgcgccgcttattagcccactttcaaccgccgtcattcgtcgtatagtcggaactagacaactagacacgaaccgacgggatcggcttccacttcgccggattctaggcatctactatccaaagtgctcaaaccatcactgtctcgagccgccgcaacccctagggccgccggtgccgacgggagccgatgcgtcctaggccgcagcagcccctagtgccgccggcgctgacggaagccgtccttgtcctgcatcgtagcccccctagggctaccggcgctgacgagagccgccgcagcccctagggccaccaacgccaatgggagccgccgctgtcctccgctgcagcctttagggctgccggcgccgacgggtaccaccgccgccacagcacccacgggaaccaccgccgccgcagcgtcgatgggactgccgccgtcctcctccgcagccctagggccaccggctccaacggaagccgctgccttcttgggccgccacagcccctaaggccccctccgccgacgggagccgttgggccgccgccatcctccgccgcccccagcaccgtcaaagagactccgtcgcctatgccttgccacctccccgccgccactgtcctagccgctggtcagctctggcggcagcatggccagatctgggagctggggggggagaggaagagacgagctggggggagaggaagttgggatctgggcagaggccccgttgccactgtcctcgccgctgcacggacgtgcgggagctggctctagcggtggcaaggcagtggaggggagggaggaaaccggcggcggcgcgggatggggtcgctacccgtgtcgcccgtgagagcgacgtgggggcactctgtttctctattctctaggcctctatatagttgatttgtgtacttaaatctaatagagtaaagtgcattggcggtccttaaacttgtagggttgtgttatataggtccctagactctcaaaatgcatatctaggtcccagaacttgtcaaagtgtatcatctagatcccaaatcgacacatctcatttaggatcctacatggcgctgatgtggcatgccatatggatgtgacgtgccattttctttattttcttcatttcttttttctttttcttcgttttcttctcgttcttctttttttcctttcttctgctcgggtcacagagaaaggagaagaaagggaaaaaaagaagaaaaagaaaaaaggaaaaaatttaaatgggacccatttgtcagtcaaaatgatgtcacgtcattccgtgtggcatgccacatcaacaccacgtaggatcttgaaggggttgtggcgatttgggatctagatgacacactatgacaaattctaggagttggatatgaattttaagagtttagggacctatatggcacactgctataagtttaaggaccgcccgtatactttactcaatctaataatctaaagggttaccctaatctaaagctggctcttttgctagcttttcattggtccacttttttttaactagggcggcaaggcccccatttctcttactagaaatgaaagtcattacagatagtcttgaaataaaaaaaacaaaaaaaagaaagaaagtcggtccactgaatataacagggacagcaaaaacatgcagcctaaccattacaggcctgactagaacatagaacccagtaacatagaactaaaaccattcagacagtccaaaagctttgacacagcacagaagtaacaaaacaggcccagctgccgaagaggactatgtcaagccaattcttctgatgcctcctcgccagccgtgacttgaattgaagacttcatttgccacctgtcttagtacactggttcccagctgcaaacttcttcaacttgcttcttgtttctgcagacaagtcgaggagtccaccagattgcaagccatatacactaagtcactaggatcatgaggaaatttcatttcaatacaagctttgtttctagatttccaaatagtccagataacatcctctatcacgatggaggtattgtgtgctgggatgcggagtcgaatttggaaggagtccaaatttggtatgagtggttatgtaaagtttgtttcttgtacgagaaggtttcctagggggattaggacttctagtatgagtttggttcgtgactttaggctgcctacctcgggtataaatagagggggagcgtgaggcttccttgcttttgagagcaattgagttgatagtttagttagggtttcgagtttactcgagatttttgtaaggtgtgctgttggcgcactttgtaaacacagagagaatcaataaagtcgtcttcgatttgtgttttctcgggtgcggcggtccaaccggcggtcagactagcggcatcgcggcggtcagaccagcggcggcgacaagcagcagcaggcgatttttggcggttagaccgattgatctatatcggtgagaccgacattcatcaggcggtcagaccggcgcagctacttcggtcagaccgcgatccgtcgaatttgagggtaacttttatttccgctaaaagttttggtttttgggcataccaaccattcacccccctttggttagcttagttcttgctgttcgatcctacaaatacaagattttttgtaaacttctctatattattgagccaataaccaaaaagattatgtctatttagacaaggcttaagattcagagcaacagcaatgacattccataacaatctggccaaaggacactcataaacaggtgccgaattgtctcctccttatcacaaaaaaggcattcctccaacctcttttgaaaaggttatctttggtgagtattttgtttctggtaaacaaccaaatgaaaattttaattttcagaggaattttaaaactccaaatctttttatgtggataattgacctgttgcatgttgagagccctataaaatgatttcacagtgaatttcccatttttggacaaagtccaccaaagtttatctgtacaattgtcatctaaattcaaatgttcctagataagaagaatcgtttcccaatttctaagtttgtccccccgcaaatcccttctaaattataaatttatactagagaaaaaacacctaacaatcatatgtgagaaaaaatctagagaaaaatatcacatatggattccaaaggcttctaaaactatcttcctttccaaccacacgaacctctactcctttgccttctataaatataccacgcctattcgatactactcctataactctaaaatatatctaaaatatatagtaaacctaaaattattaggcaaaaaacaaatataaaacaacgaatttacattcattatcattctttaaatattctatgcctactcggtactcatataactctagaatatatatagtaaacccaaaattattatgcaaaaaaaaaaaaaagaaagaagacaaccttgtttttatatatcacggaataggatcagtaatacctcctcagctaaaaaaaataattgtgtttttttgttaaacatgatatgtttaaaaactatgaatatattaaatgattgatctttaaaaaattcaaatccacaagcaaatataattaaaaccaattaattttgattaatctcaaaatttattttacttatttggatttcatcaaaatttatgtataaaatgacacattaaatttggtatttttgcttgacatgacatataagtcctaatttttttataaaaaatatgtttttcacttgtatatataataaataaatcatttgtaaatccataaatgttttttaatatcatacatccatttgtcaaaactaaaatagtggttcaaataagaaaaaaattatatacatattttaaattagggagcacacaaattttatcatgtagtgtttttgagtgataagtatatgtgtgtgtatatgtatatatatatatacacacacacatatatatatattctgactagcaagcgtgccaacagcacactgattttctggttcgcatgtaaaatagttcaacggtgttgttttcttctctattacaaatctacaaataaatgaaaaaaagtagtcatctaattaatcacatcatcagatcatcccattttgatattatcattcaattctttagattacagtgaatagcaatatcccaaagccaagatactcaaatcacagtttgtggtagcaccctaagccctattagagttgattaggtagagagtggtggtccacgacgccccgcctgctcgcccgcatggccttgctcgctgccaacactatgctagagtatttgggcttggtttgcgctaccacgaaacgctgccataaacgctgtctctgctgatgctttttgtttgactggaatctctgctgatgctttgtaagatgagacatctagttgaaatgcttgtgcttttatttgctgttgaaatcatttgctctttttgcctcatctttccctcccagcacaggatgagcattaacttgtgaagctgacaagctggcatcacagctagctgattcttgcatgaatgggtcttcccccgatattaagtgctgcgagaaaattgtagacctgtcccttcaaacagaaggacgcagccctgtgctacggcttcaatggttaaaatatttctgctgttctctaatcaatgaaatttcaaataatgtgttcttttgcatgctagctagtactaaactggcactgtttcacgcgtgcagaaacaaaagacgagcagccaaatctttcgccttcggctggaaatggcgttggcatagccaaagtgaagcagcctaaggtgatgcttgatcccgtggataacttcagtaactgggattggtacttgatcccgtggataacttcagcaactaggattggtacgttatggcaatcttgtaggtggtgactggacttcagatcgtgtacgcactttttcgagaagtagtaaattgcttgccgacaatccttgcacggaataatattcctcgtcaagtgtaagaggttagaactcttggatctatatatgagttggggtcgatggtcgatccatgtatctctgaattgtagctgctgccttatgcatctctgagttaattgtaggtagttgtaggtagcagctacatatgtatccctgagtattcttgtatcttggatctctaaacttaagtctggtacttatttattgaatggctatgtattaagcagtacgtagagcgtgatattgttccttttcttccctgtcatttgctgttcagatggcaccaccttgcatctttgcattactcagctgtccacactaacgattactggtggcctctgaagccagctagagttggaaggtgttgactactcctaccattgatttcatggaaacattagttatggaaaagtaacaaaataatcgccaatgctgttggaaaataaatattaaaaggtgcacagctaagttaaaaaatgaacttaaaaatgtcattggttgaagttgaagcgactgattttgctgggaaataagtccactttaggtctctcaatgtggattttgaatcacgtccctaaacaacaataccaaatattacacgtttcccaaattacaataccggtgtaccagtgtgatgacgctctctcgtggcccgattttctggtgaggggataactcttgctttgatcgagtgcgacatttgcgatgtggctaccaaccagaacaagtccaggacgctgtgcaatcgctacaccacaaacgatgtcataccaaccgtgacgcgcatttgatgatctctgcaatgcaaacgagagaacactgcaagaacaagataaaatgcaatctaaatattgcaaataggtaattaagcacaatggaatagttgcgaatggagtggtagcaaatcaacacaccaactattgggggttctgaatctaaagtcgccgactaatcgaacgaggactaaacaaaacccaattgttctagatggtgtacatagatatttatagaggaaaatatatctagggttaagtgctaattcgtggaggtggggggagacacttccgagatgagctagtctattacaaggcccaaggcccaagttcggtttcagtaacagcactgccttgttttgatgattcccgttgactcggaatgaatttggatatgatactagatgcgtttgaaaggtagcaagataagctttccatcaagtccaagatagcccaaatcggagttggcatgaaggtgctaggtctgtttgaagtcggtgctgtatccggaggttgaactggattccaaaactcattggactttaatatcttgtagatcctctgttcactcgatgtattctttggccatgttgtatatttctcatgcttgggtgtatgcatatacttgatggtcacattatcctcctcttcttgtttggaaaccgttatcgatttgttattgcaattgtcgtcataggagagatcaattgaaaaaatatcaaacaagcaatcattgtgtagcatcatttgttccttataaatccaatttacatcacgaggaaaccaactcaccgtactgaatgaatatgtcttaaaatgatagcgagacttgaccttcgaagttaacagtgcacagcactcaccttcttgaatattgtcatcgatatttaaaacaacgttaggtgaatttatcccaatagcatcaacgttgtgcaatccatttggtttctcatatttttccatatttaaaggaggattcatatctaaacatatataaacacgatgcaccatataacaccctctattattatatttaccaatgacatgataattgttccaagaataacatggaaaatcataaattttcttctctaaggtatttagatcacaaagaacatcaaattcgatataacccaaagtacataaagaagacaataatttcagctcttcttagtcatcagcaataacaaagacacgtttattttgagtggaaacaaaatattcagaaatagaagtaacgtgttctttcactagttgtggcatgtatataagtgaagcattgcacaactcttcctgattacaagcattatcaatatcaacacaatctgaatttttagcttgtgataaaggcaaattagaaatctgttccactagaggttgcttaacatagcataattagtggacaattgtagcatatcacaatctttcttaccttggtccatttgaccatcagttaaattacctgaaacgctctcttgaccaaatttaggtgcttcattcttcttttcttcaaaattgtttttaccttcctgcacgatgttagatataatagaaggcacaggaatattgtcatgtatcatagctatttttgtttctttctcaatctgactttcaatatcgcaagcaagcagaagtaactgaaaaagatggctatgtgttttattttcaagcctatgctgaatttttaaatcaagcccgtgtaaaaatcttttaattgtatctcctctagactcctctataccagcatacaatatacaaattttaaactcccggtggtactctctcggttctactctcttgtttcaaattttgcattttcatttgtaaatcacgaatataataaccgggcataaatctagctctcatcattgtttttaagtcattccaagaaccaggtttattgccgataagacaaatatcactccaccaaagagatgcgaaagaagtaaaagaacttgttgctgccttaatcttttgttcctcggaccattcataatattcaagttcatcttctactactaactcccaatcaatatagtccctaggattaaacttaccaacaaataaaggcaacgatatcttattttcacaaacctcatcatgtacctcttctcgttgtgaaagccaatgttttatttgttcaatcccattctctttgtacacttctgtcattgtcggtagcaaataagaaaaacaaacagatgcatgtaacttcttattaacaacaatattttgtttgtggggttgcaattcgctcagcactgtagcatataccaagttctcataatgttctcaaataatgcaaaaacatatcaattaccatggctgatttgtggcacaatgacacgtttgatgagtggagcgattgcaaagtcggacttgtaaagattagtagtatctggatcttggtaggcttaactaaacagatttgcgaaattaaataatagtccaaagtactagtcaaaattgctggcctagcctagacttaatcccaacttaagcaaacaaatgatcaccactcagactagaaacaactagattttatcacaaagctctcccaagaaatccaacaactaaaaaaaataattctaaattctttttatgattttttttgtgcggctttttttttctttttttttgcaccgttctgccttttctatatttttttctttgttttttttaacaaacggcagctattacacaaaatagctgggcaaaacaaaaaaaatacagaccacctagcaaactcacactaaaaaaagaacgaaatagcaaaacttgctagtctgcatgcacatacaggaaagatgggctcaatattcggtacagaattaacttctcccatgcatgcccatcaaatcaaggagagaatcaaacaagcaactgatccatcaaggaaacacatgcgcaataaaatactccatccgtcacctaatattctatgcaatgtttgaccactcgtcttattcaaaaaatttgtacaaatataaaaaaaaagttgtgattaaaatactttggataataaagtaagtcacaaagaaaataaataataattctaaatttttttaataagacgaatggttaaacagtataagcaaaaactcaaaatcccttatattatggaacggaggaagtaggatagctcggtttaaagtatggtaaatatatctgggttgtttttttttcacttggttgcacgataaaatctcggagggaataacaaggaaaaacaaattttccctaattatctggcacatgcaaccgagaacaaaataatctcagatgcgaacggaacctcagctcgcaaaccaatctgctacccatcaatcttctgcgaaactttctctacggtggcgacgcacacttgcaaactcaaaccaagactaatctaggcttaaaccagcacttgactcgacagtgcatcaaaactcagtaaagcaaaaactgaatgaaattgcgtggctcaaaactaatgtttggtgatggaaaaaaatagtgtggctatatggtagacgatgggtagatgaaataaaattgcaaactaaaatcctcaccaggcaactgatgctctaataccaactaatgacacactctctcgtggcccgatcttctggtgaggggataactctcgctttgatcgagtgcgacgtttgtgaccaaccagaacaagtccaagacgctgtgcaattgctacactgcaaacgatgtcagatcaaccgtgacacgcggttgatgatccctgcaatgcaaacgagagaacactgtaaaaacaagataaaatgcaatcaaaatattgcgaatatgtaattaagaacaaaggaatagttacgattgaagtggtagatctaatcgacccagcaaatcgacacaactattgggggctctaaatctaaagtcgccgactaatcgaatgaggagtatagacaaggtgaatagcacctggcaaaattcaactaaacaaaacccaattgttctagagggtgtacatagacatttatagagaaaaatatatctaggattaagtgctaattcgtggaggtggaggaagacacttccgatatgggtctagtgtattacaaggcctaaggcccaacttcggtttcaacaacaacaatgccttgttttgacgattcctgctgactcggaatgaatttgtatatgagaccggatgcgtttgaaaggtagcaagataagctttccatcaagtctaagatcactcaaatcggagttggcatgaaagcgctagatccgtttaaagtcggtgctgtctccagaagccgaactggattccaaaactcattggactttaatatcttgtaaatcctctgttcactcaatgtattttttggccatattttatagttctcatgcttggatgtatgcatatacttaatggtcacatcacatcacagtgtacatgagatcctaggtactactgtccggttttagctaacgtgatggttgagtcaacgtgaaacccacctaaaccccacgtgtaagcttcctccctctcccctctctcccctccaattgttcctcctcctcgtttcccctctacctctcttcccagcctccaaggcagtgggctggcagtcgatagggaaatgggtagctgagctccatcatctcatcacaacttgaggccacaacagagcacacgagaaggagcaccctgttggggtcagtcggactcggtcccatcaccatggccacacggccacgctagatgccctgaggtgcaacaacacatgattttttgcagcgacggcattgatgggcaggttgaacccaaccggagcccgacgcatgtctgctagtcatggaacccaggcatggacgggagccccatggcgaacaccgcccgtagatcgtagatcgggtgggaacatgaatcccatctcagtctcggcgcacgcttgctctgtgttagacagccctgggagcacagccatgcgacaacactacgctcgccagcgcgtggaacgaccgaacgagtggagcccatggtgcggcgaggccgatgtcgacaagggccctaccacgatgtgcatggacaactgccgaagctctgccagggacaaactggcccacactggtggagaaaccatctttcgtcggtcggccgaattccacgatagtcccggttgcaacaaaaaccgggactaaagatgatctttagtcccggttaaaaagggtaacgggcatatttgatctttagtaccggttggtgttaccaaccgggactaaagatgatctttagttatctttagtcccggttcaaatgctgtcagggcttgttaggcccccccgggatctttagtcccgtttcgtgttaccaaccgggactaaagatcgtaactttagtcccggttggtattggtataccaaccgggactaaagatcccggtgatctttagtaccgattggtaacaccaaccgggactaaagtcccacccctttatatatgtcttcttcctcctccagcccgagcaagcttcaaaatttcttcaaaaaagaggggaggtcatgccaaaatttatagtgaatttactttggtgattatatacaaatcggaggtgcctaaaaggttagcaacttcatcctccaatgttttttttggtcatattacatttggagctatgttttgcacacttttttgtttaaaaaaatttgttgtaagttgataagagagaaaatttgtgtgggaaaagaaagaatatacagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgttattattgtacgaatgattatttgtgtacgatttttttttcatttcatgtagatggatcggcaatggatgtacgctgaccggcggtccaaagagtttattgacggcgtgcattattttttgagagtggccgaagctaacaagcagaagagttttatttgttgtccatgcaataagtgtaagaatcagaaggagtattctgcatccaggactattcatttccacttgtttgagtcagggttcatgccaagctataattattggacatcccacggagagcaaggggttgaaatggaagaagatgaagtggaagacgacaatattccagactttgctcagtacgctggatttgaaggaaatcaaacgggcgaggaggacatagatgctgatttataacgacgttgcggatgatcttggtcagatgttgcaggatgccaaggaggactgcgaaagtgaaaagggggcccataaattaacaagatgttagaggaccacaaaacgtcgttgtacccaggttgcgagcaggggcacaaaaagttggataccactctagagttcatgcaatggaaggcaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcacagtgaggagtacgagaacctagaagcatgccctgtttgtaaagcactacgatacaagattagacgagatgatccaggtgaggttgacgggcagctaacgaagaagagaattcctgctaaggtgatgtgatatttccctataataccacggctaaggcgtttgttcaggaacaaggggaatgctagaatgatgcgttggcacgctgaagaacgtcaacaggacgggatgctgagacaccccgcggatggttcgcagtggcgaaacatcgacagaaaatttaaagactttggaaaggacgcacgaaacatacggtttggtttaagtacggatggcatgaatccttttggagagatgagcagcggccatagcacttggcctgttacgatgtgtatttacaacctccccccttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccgggcagtccaacaaggggtacaaggcttgcactcactgtatggatgaaacaaaaagtacgtatcttaagcactgtaggaaggttgtgtacatgggtcatcgttgattccttgcagcaaaccacccggtacggaagaaaggaaagcactttgaacatacggcggaccatcgtacgaagcctaaacatcgcagcgggaaaacagtgtttgctatggttaaagatcttaaagtagtgtttggaaaggggcctggcagccagcctatagagagcgaagatggtcacgcggcgatgtggaaaaaaaactccatattttgggagttaccctattgggaattcttggatgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccacaggagaaaggcagccattacttgagtccagccagctacaatcttagcaaggcagagaagaaaagtatgtttcaatgcttggagagcatcaaggtaccgtctggatactccacgaatataaagcgaataataagcacgaaggagaagaagttcacaaacctaaagtcttatgactgtcacgtgttgatgacacagctgctaccagttataataaggggtatcctcccagacaatgtccgggcaacaataacaaggctatgttctttcatgaacgcaatttcgcagaaggtcatcgatccggataggttagaagcccttcagaatgatgtggtgcaatgtcttgtcagctttgagttgatatttccaccttcatttttcaatataatgacgcatctgctttgtcacctagtgaaagagatcggtattctcgggcctgtgttcctacacaacatgtttcctttcgagaggtacatgggcgttctgaagaagtatgttcgtaaccgtgctcgtccagaggcaagcatcgccaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttttacaacaatcttcattggtggctccttacatcgaggagcacttggctctagttcgcgctagaaacatcggtaagtccgatgcatggattacacggcatcacattgatactttccccgcatggctgcgacaatatctcatgggtaacgagacgattaaccagcaactggccttcctggcgaggggtccatctggctcgatcgcgacattccagcgatatgagattaatgggtatacattctacacaagagcccaagacatgaagagcacgaaccagaacagtgctgttcgtatcgatgccatgggacacgatggtacaactggcacgtattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaatcgtcggagtagaggacaagactgacgaggattacgatcagtttgatgggcaaccccctttcacggtgatggttgaccctagcatcctcctatcaaacgaagacaccccttactcacgtagcgatcacaaggaaggaacaatagtgaggagaaagtacgtgcggacaaccgtcaccgccgatctattgccgtaattgttgtaaactattttggatgtattgaatatgctagttatatatgattaattataatttttaacaatttaatatcatgcatatactaattatatacgattattagaatttttaaaagttttaaatcatgcatgtgggatttacatatattagttacaatttttaacaatttaatatcatgcatatgctaattatatatgattattagaatttttaaaagttttaaatcatgcatgtgggatttacatatgttaattagaatttttaatgcattatttactattttagaaacacatatgcaacgaaatttaatattcagtgctattaactttagtcccggttcttaaccctaaccgggtttaaaaaataatttggaaatagcgggaaaatatctttactcccggttggtgaga

SEQ ID NO: 58635 - DNA, 6842 bp, Oryza sativa
aaacgtgaacgaacgcgaacgaacgtgactgaaacgtgaacgaacatgagtgttagtgaacgaacgcgaacgaaggtgaacaagcgcgaacgaacgcttaacgaacgcgaacgaaacgttaaagaaacgtgaacgaacgcgaacgaaacgtgaacgaacgtgaacgaacgtgactgaaacgtgaacgaatgtgagtgttagtgaacgaacgtgaatgaaacgcgaacgaacgtgattgaaacgttaacgaacgtgaatgcacttgaactaaaagtgtgagaacgaacgcgagcgaaatgtgtacgaatgagataattaaactattgttgaacttagcatatatatatgattatatatacttgaaaacgttaaatacattatatgttcctttgcatttagactaatacattttttttgcatgttgcagagaagacgacgtcgtcgtcgtccctcaagccgaagtggtagctagccctcgaaggaattcgcgcaggcaagtgatgtaaagatgtgattgttagagatataatataagattgttggatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacatgacacttagacttagcatatttgagtgttagagatagttagagatttaatataagattattagaggtttaatatacgaaacatatttgattgttagagatttaatataagattattagagatgtaatattcgaaacatatgtgaatgttagagatttaatataagattattagagatgtaatattcgaaacatatttgattgttagagatttaatataagattattagagatgtaatattcgaaacttaattagacttagcatatatgattatctaccatacaaatacatgacacttagacttagcatatatgattatttgagttttaatacaagattagtagagtgttaatattacgcttagcaaatatttcttctatgaacagatggctgatcgcgatgaggaacagatactgtacgatataatcgcatcgggaagcagccagtactggaacgaggaagaggggaacgaagatccaaaccagtacttgaacgaggaggggaacgcagagagggatgcagaggggaacgaggaggggaacgtggagagggatgcggaggggaacgaggaggaggctagtggaagtcatccctccgctggacagaagagggcacgcggacaacgaggtgccgcgaagaaaatagagggtcggcacatcataactgaggtggacgcagacggccgacctagtgccccggcacaagcagccaagaattttgtacgccacagcggttgggttgtgagggataacgtgcctgtcagcaaggtgtactggcgcagaacaagggcacgcgggggtgatgacagcttcatcccggaatcagagaaagagatgctgtggaccacaatgctcgagacgttcacgctccctgcgggtacagagaacatagtgaaacagtggactcttaagaaaatggcagaacagttccagaccttcaagggagatctgtaccggaaatacatcctgaaggagcagacaccgaacttcgacgtattcccgaagctaagggatcactgggacgagttcgttgcttacaagacaggtcaacaagggcaaggcgatgatggaaagaaacaaagaaaatgccaccaagaagaagtaccatcaccacttggggtcaggcggctatagcatcgcgatgccaaactgggaggagatggaggcaagcttgcttgagaggggtatcgaaccgaccaccgctaagtggcctgatcgatcgaagttctggtactatgctcacggtggaacgctcagcccagttgatggctccttggtcttcagcgatcagatacgcgaggctgcgaatcgactaacggacgcagtcgaagcctcttctcagggcacgttctgacccgacagagagaaggacgagctgtcactcgccctacagactcccgagcatccaggacgaacacgagggaaaggcgtgattccctggaagatgggattcaaggaggacatccacacgtataggagtcggatgaggagcaagagagatactgaggcgaagattgcagatcttgagtacagggtatcgagctatgagctcagcaagcaagaggaggtggcccggaaggtggatgaacgcatggcagcacatcggtcacacgatccccagccgtacatacctcctccaatggtcagcccatcaggcaatcatagcagctgcgcctcaacggggcaggtagtatcacatagcatggacgccatgcaaacccaggatgaaaccacctgccccgttgatgagatcacgcatcggacaccatgtgagctgcatattcccttcaagaacttatcaatcaaggtatgctcgatgtaatatatgatttttgactcgtacgttccgcaagttgctgcttatgttgattactaatagataacttctcatcacgtgaaggtggcgtcgggaatggccatcccaacggacatttcagggacttaccactgcagaccgattccagcaggatactcgagggtcgaagttgagctggtggaagccgtgtacgaggacctcgagttggactacccaggaggagatggtgagacgcatctatgagacacaagccacgccattatactatggcgcaagcggtacatcatcctccctgggcgacaagcggcgtctcgtgcaccatctcctccggctccgccgtctcctcctgcaccatctcctccggctcctccgccacctcctcctgcaccatctcctccggctcctccgccacctcctcctgcaccatctcctccgcctcctcctccaccgtgttcgcctgcacctcccaagacaaggtctcgccaagctccacctccagccagcacaagggcaatgaagaaagccaaagttgacaccaccaaaaacaaggagccaccgtacggttgcagtcaagaggagcttgacgcttatgtggcaggagaagtgaagaggcaactcaagcctcagagtcctgaaaagaagatacctattgacccgagcgtgaagaatttcttgaagggaatgtccaccgcaaacaaggaggccttaaagctctcggactatgaccgaacacttaggaaagcctattacaagaagtccaaaccagttcctcaacttggagaacaaccacaccaagtggtcgagccgttggtgaccggcgaagactttggcataacggatttcatttcggacaccggtctaaccatggctcagttggatggaggcgcaccaatcccgaaagcggaagtggcatacaagtttgagctcggtaaaccgcttgtcaggcctgagcagctacagtccctaccgacacaaatgtataaattccatgaacggtacatggaaatgagcgccaattgtagagagatgttcgaagcgaggatcagaaaccccgacttcttgcaaggagaagatgttctatggatccatttcaaggatgtcttcgatctgtaccatcgggatgccctcgacgtctctcttctgagcgcatggattttgtaagtatctttgagttcgatttgtttcgttcaataattagctcctggcatatatgtaagcaataataattttctttcattgttgtagaatggagattcaaagggcccgatggcggagggtttacgatactgggttcatcgaccctcgaaaaatcaacaccgaaatgctcgacaagtacgaaaaagacacagaggacaatctcgtccatctcctaacgcagcagcattacaagacgttcatactattgccgtacaacacagagtgagtttttattgtcgttcgaacaaatttcattcccatacatatcacatgtacattctgatatttatctcatctcacgcatattccagattccactgggtcctgttctttttcgacttggacgcacgcagagtcactgtatatgactcaatgaataaagaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggatggaggtttcattttccagtgagtacatgcatgatccaaaattatattgaattgaatctctagttacagttaatataaagagtatattaaatctctcattgtttctcatatagtgtgcaaagcaggacaagggaactaacttatgtggctactacgtatgcgagtttgcccactgcctatcaaaccaaatatacaccacacgagagctcgatgtacgtatacataaatcattcaaaatttcattgtgtatcgatttgttaagttgtttattaatttcatatattgatatgtcattatttttcgaatgatagcgtattcacatgagggaaaaactcccacacaaggattttatcacggctgttcaagaacaactgatggggttcatcaacgaagaagtccttaatcctgatggtgaattctactacgacggatcgacaattcgtaacgtcggtccttcctcttctgacgtaacgcaggcgttgaagtcgtagctatagctagcgagcaaatgaattgtactatacatgcatgtatatatatatatatatttatatatgtaagtacatttactttagtgttaatatatattttggtaacatatatgtacataaaatgttaagtgctttaaattataaatatgtgtgtaatatatgtatttatacatatatacatacgcatatatatatatatgtattctatatacatgcataatatatatatatatatatatatatatatatataggacactcatatggggcaccatggtgcccgggcaccatggtatgaaatacacaaattcgcccaaatgtttcaaaattttcaaactgtgagtatatacctacttataagtattcatttcatacctatacctagcaacaaaacaactcaaatttaactttatttcacaatccattattacatacctaactaattatatgtttggatgctatatacctaggatcaaaatctaacaaaagtaagtttgaatttagtaaatttcaatcatggtgcccgggcaccatggagcaccaaacaaatttactatatatatatatatatatatatatatatatatatatatatatatatatatatatatatatatatatatatatatatataatcaaccatgtagcaaacagggccatgcaaataaaaaaatggtacatagatctttagtcccggttatttcacccgggactaaagatcgctaactttagtcccggattcgtagtcccggttggacaaccgggactaaaggggggttacgaaccgggactacaaacgatttctccaccagtgccagtacacgtccaccattgcaactgcctccatatgttttttctaaaaactaaaccaacaagagaactacctattatatttcaattaagcaggagtaaaaacctagatagggttacagaaaaagaaaaaaacaaccactcgatgagtagaacgctaagtccctcaaccgcggccggtacaaaccacatagcacacggagcaccacacaactctagccaaactaccacggcggaatccaaaggcgagcatcaacgtcaggatgctgaagaaacggcacacggctttgacatcacaaggcacatgtcatcattgccaagcttgccgcccagcgaccaagcagttccgacttcacggcgatcacaacatcattggaggtaccgccaaaacgagcaaaacaacaccaagctcacactttggacatcagccaaagcccctggggcgccaaaacctacactggcaacaccaacattccttgagagaaactgcaaatgttatcgttgccaagcattgtcgcaccctaacgacatagtagctccgactccatctgacagagacaaacgaagaagctggatgccaccaatacaagaaaggaacctaggagaaggcctcgccaaaacctaggcatctagtgcttcgagctgacgcgggagtccaccaacagcaatcaatgcaagggtaagtttctccaagacgatgcccccataaaggatatgacgtgaaacgctgccaccgcctgtacgggaaccggaacacagttttcacctggagaattggtagcgacgaagaaaaacgccatcacgacgcctccaagaagggaacgacgccaaagacgccgttgtcgtcacgctagccaagggctaagcaaggctttcgccagcgattttcatccattaccaccaccacccccacacaataaccgttgccgcaccaccacgtcatctcctcagccaccagctggcccagttcaccaccccacaggtcctccccgcacacactagccttgtgacgtcaccgccggtacgcggccctccacagaaacaggtaaccgtgcaactgtccaccatgagctccggggccacaaggggacaggcgaagg

SEQ ID NO: 58636 - DNA, 6844 bp, Oryza sativa
ccgtcgagcgcttccagggccaccggcactccacactccgcccggctcgccgcgctctgcccacctccctcacgctggaggggacgcgtcgccgcggtatggccccactgccgccatcccagctccccgccctgttgtccggcggcgaactccggcggcggcgaggtagagagaggggaggagggtgggtggcggcggcggctagggtttgcccccgagccaccgcacgcgtgagcgactcgtgggttgtccgagcatatacaagtaattaagtggctagttcagaaaccgcctccatatgtcgatcgtccctagaaagtgcaatagtaaagcttccacaatggctatgtgttaacaaccaaatttggtaatctaagtatcggaggtgaagactagatcgaagtggaatccaagttcgagatcgtatcggaaacagagcaaggatcggctggactccaaatcggctacaaccagatcggctgagtccgagtcagaaagggagagccgatgcagccgattccgacaatacgactcggtgtacatcgtcgaattgagttaatgtgcttcacggtgattgccgcgcaaggatggagtcctgagaaggcaattgtatctattaattaggatattttatgtaatttacctagagatatgtttggtcaaaagtctgccgtaaagacttatggtatcttagagtttgttagagataatagtcgtgtccggtatggacatatcttgtaattctcgggtataaatagaccccgagccttatgtaaaagaaaacacacgttcaatacaacttcggcgcattgccaccctttttacttgttatggcggtttgcgttctcgggattagtgcttccatctttatgacactctaatcttgtttgtgtaatccgtcgagttatcatatatcttacataatctttagcaatatcattatctaacctacaatcggctagtatctgtcggtggagtacagccgattcggttagatattgacgttgatttagattatataggatatccaccactctatgaaacttccagcggcttgattgtctagatattgttcttcttttcatacttaatgctgcatcagttgagtttgatttattaagtcgtgcttagaatatcaatctctagcctgccttctggttgccgattagggtagtatcggggtttcagccgatcttgcctgatttaactacttttattctatatgcttgattgatacgttaaatccgccctttatgttaagatctcattgcattcgagtatattaggcttctgtttgatatattttacttgctttaatatcttgatatagagtagtattggagtattagccgatacatgctagatctatttgatcggctatgctataaacatatatagccctgttattaatatatatttcaatctaagtgatttatactgtctcggcatggcgtccgatctatcccaatcacttgacttaagtatatatcgatatagggagtatatatcattaatatctacagccgatcaagtaggtttagtttcttcttatttattcatgactgccgatcgatgcctatatgacatcggctcaaagataaatgatatgtcatcggcacctagccaatcggctatcgtttataggattaatcgcggtttctttgtctttatttcttgttgattgcaggatcaaatcaactggcatgctcatacacccgaaggcgagttttggacctgcactggagttaagcagatctcccaggccgccgtgttcgatttttacgtcaacacgcttttggcacgcccagtgggaccgattagaagtcagaagacaatttccctcgtggctgagaagctgccaccttcaccatcctcggctagcccagggattgttaaggaaaagatccagaggcaaggcttgggggacatcaacgaaggaaacattgtgactgttgacccagaaaagttcacacctgatcaaaagaaggattttgaagcaatgatgcaacaagcgcgagaccaattcttaaactcattcatgcagactcgcaagggaacatttgttcagaaatacaaggtgaaagtagttcctgatgaacctgagaccagtacttctaaggaaggagaagggaagaaagtctcagaatcggctcaaccaagtgacaaaggtgctaccgacggctcggctcaagagaatcagggtgacaactctcagggggtacatggagttcaaggtgatggtgttcatgggctgcaaggaggaaatcttaatcaagacggcgagacaacacaggatttcttcaacaactttcaagatcgagtggattatgccgtgcacaatgctttgatcaatcagtctggagtattagttaacaccttgtcaaacatgatgaagtcaatagccgacggatcaatagccgagcatcaggctgtaggcccgatttatttacaaggaggtgtctttccaaactatcggcctttgatcaccggcgctcaaccgtctgtacaaccagttcctcctattgcaccttcagctcagccgacagcaccaccgttgactcctttacctgctccagcagcatcggcaccaggacagccgattaatcctcgactattgatgagggagcagccacagcatagtgggcaggcgacaaatcagctgacacaagacaaggttgctgctatgtttttacgtcctcaacctactattgatccagtccagcaacagctgattcaacagacgccgccaagacaccaggttacacagccgattcagcaaacaccaacaagacagcaaaccatccagccgattcactagcaaggcttgatgaatcaatcggctggacaatcggctggacatgccttgactcaggttgttgttccagagcatttggttcaccatatgcagccagatgttacggcaatgcctcagattgtacctgagcacttggtgcagaatattcaaccgaattaccagaattaccaaggaggcaatttgagttatcaatatcgacctccttctccacaagtccaatatcagcaagaggggctaaaccagccttagcttactccttagtataatcagttcgaaccgacgcagcaacaatcgcaaggagcagctcagcaacgaccatgggccgatgtgattgctgacgtgatgagggagcagtttgggcttaaaccgaaggatactggaaacttgtatcggcaaccttaccctgagtggtttgaaagagttcctcttcctaacctatttaaagttccagatttctccaagttttcgggacaagatggtgtatcaacttatgaacacattagacgattcttagctcaatgtggtgaggcatcggctgtggacgctctgagagttaggttgttccggttgtccttgtcttgttcggctttcacttggttttcttctttgccgtatgggtcaataaacagttgggtcgacttggagaaacaatttcacagctatttctacagcggagttcatgagatgaaattatccaatttgacagcgattaagcaaagacataatgaacctgtggatgagtatattcaaagattcagggagatgaggaataagtgcttcagcttgagtttgactgatgcccaattagccgatttagcctttcagggcatgattggtccgattaaggagaaattctcatctgaggactttgatagcttgtcacatcttatacagaaggtaacattgcatgaacagaggtttgcggaagctaggaagaactctaagaaggttaatcatgtgtgtcctttcatgtacggatcggatgatgatgatgatgactctgagatagctgcagccgaatgggtaaggagtaaaaaggatataccgtgccaatgggtgaagaattctgggaaagaagagaggtatgattttgatattaccaaggctgacaagatttttgatctactgcttcgagaaaagtagatccagcttcctcctggtcatacgattccatcggctgaggacttgggcaagaagagatattgcaaatggcataattctgggtctcattctactaacgattgcaaagtgttcaggcagcagattcaggtggccattgagggaggcaagatcaagtttgatgattccaagcgactgatgaaggttgatggtaatccttttccagttaacatggtgcacacagctggccgaacagccgatgctagacgtacgagaggttttcagatgaattcgaccagagttataaataagtatcagagaaaatacgacaagcagcaagagaggtgttatgaagaggatgatggtagtttcgatcctcattggggctgtgagttctttaggttctgctggaatgagggtatgaggttaccaactattgaggattgtcctggatgcggtgatgttgcggaaagttcgagccgatcatacaatagaaataatcggctgaagcaaacaagagtccctgttcatcaaaggttgggcccggtaaaccaacatagtttcttggaggatgacgaagataggaagattcagtggtgtccttctggtatttttacaaagaatcagaagagaagggtgcaaagcttgaggaacagggaacgctttcaggaggtcgagcaagaaattaatcatcggctaaggaaggcaaaaccgaagcaggagtggcgtgttaagggtcaagcttttggggccgatgatgtcgtagccgatgaggcagagatgttggcaaaagggaaaagtgtggtaacagcatcaattaacatggtttttaccttgccagtcgaatttgggatcgatcaggctgatgtcgatgaagtggaagaggaatcggctaagttggttctatcgtcagaacaggcagtctttgagaagcctaaagggacagagaatcggcaccttaaaccattgtatataaatggttatgtcaatgggaagccaatgtctaagataatggtcgatggtggggctgcggtaaatttgatgccttatactatgtttaggaagttgggtagaaataccgaggatctcatcaagacgaacatggtgctcaaggactttggtggcaattcatcagaaacaaagggtgttctaaacgtggaaatgaccatcggcagtaaaactattcctaccacattttttgtcatcgatgggaaaggttcttacagcttgttgcttggaagggattggattcatgccaattgttgtgttccttcgaccatgcaccaatgcttgattcaatggcaaggcgacaaagttgagattgtgccagccgacagctgattgaagatggaggacccaagctattactttgagggcgtcgtggagggtccaaacgtctacaacaaggacacagtagatgatctcgatgacaagcaaggtcaaggtttcatgtcggctgatgatttagaagaggtggatataggtccaggtgatcgaccaaggctgatattcattagcaagaagttatcttcggagtttaggaccaagctgatagagcttttgaaagagtttagagattgcttcgcttgggaatattatgagatgccaggactcagccgatcaatcgttgaacatcggctacctctcaaaccagggattaaaccacaccagcagcctccgaggagatgcaaagtcgatatgcttgaacctgtcaaggctgaaatcaaacgtttgtatgatgcgggttttattcgtccttgccaatatgctgaatgggtttctagtatagttcctgttgtcaagaaaaacggcaaggtgagtgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcgggcctgatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtccctttccccccctctccctcttgggccggtttggcccatctccttccccctccctctcctctccccgcgcgcgccgctgacgggagggcctgcccgccaccctcgctgacgggtggggcccacccgtcatccccttcctcccgccggtcccgccgacttccccgcgccctagcgccgccgccggccggaatcccggcgcctcccgccgttcccgtgcgcaataaagtggggggaattattccccgggatccccttcccctttccccccatttttccctccctctctcccttggattcgtttggaaacccctcccctaacctcgccggcgccattaatagcggccgggtctcccgcacccgtttccccctcttccggccgccctctctcactcctaaccctatataaaccctccccgagctccccccaccgtttccgccactcaccgccctctctcccgccggaatcgagctcgcgccgtcactctctctctccgccgtggccgccgagctccggtccgccgccgccatcgccccggaccacctcccacctcggcgccgcctccttcggcttcgccgcatcctcgccgacctcgtccacctctccgtttcggtcgccgaccgccggagcaccgtcgaccctgtccacccgagccgcccgccgccttcctccggtccggttgctg

SEQ ID NO: 58637 - DNA, 8532 bp, Oryza sativa
gggtgcacccggtccaccgtggaccgtggggctgccgcgtgggccccactcccgtggacccggtccgcgcgcccctatcctcggctgacgcaataaaccttttttttaattaaaatttaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgaacaaggcaagtcacatcatccttgaacatattgaatcctagtttataaaattattttgatttaaattattgcagtatcgctttatttaaattcctgcgttatcactgttttatctagccatgcctatttacctttgttatgaccctattattgttattgttattatttccttgttcaccctagaataaacaaaaccccaacttgaagaaatgtcacatggcttctaagcttaaatcaatggaaatggaaatctctaaaggttttcttgtccatttcattatgtcatctctgccccaggagttttctccatttacgatcaattataatgcaatgaagatcaagtggggcattgatgaattaatagctatgtatgtacaagaagaggaaaggcttaaggcagaaagagttgaccatgcaaatctatttaaacactccaagaagaaaaagtataagaaatttaagaaggagtatttgaagcctaagcctagtcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattgggtttatgagatggctcagtaagaaagatactgatgttatttcttttgttgatgaatccctaaatattgattatgccaccaattcttggtggattgactcaggagcgacaattcatgttgcaaattccttgcagggattcgctatgaggaggacactaagaagaggggaaagaagaattagagttgctaatggagaaagaatctccacccacggtgactgccaacgaggtcctctcgggtgagccagtgaggaagactgcagtgacctcccaagcagcgtggggctctgcatcgtcaccatcctgctccgggagctgcttgccctggtagtccactccatgcggataccccaggacaacgcacatgccccgtagctccaaaacaaagctagtcaggtccaggccacgacggttgatgctgccggccatctacaaacaaaaacaaaagagaaaagcaacattttaaagatcagattttgacgataaatgaagcagcaagacagagagagactagaggattttcacaaataagaaaggatttttatttcgaaaatattgctaaggcttgggatctaaagctcgtcctagggtcaagggggctctgataccaacttgtcacgaccggaaataacccaacgagcgttccttacgtgcgtgtattattccttgtcccaggaggcaaggtacaccaaaagttgatacatttcagagtttatcaagcggaagcataaataattaatttattacatgggcggcgagaggtggaaacggacgggagaagcacggggagggtttatatagggttggaagggggagaggccggccggaggggaaggaaaccggcgcggcgttctcgggctccatcaatggcgccggcgggattaggggagggtttccaaacgaatccaagggagagagggagggaaaaatgggaggaaagggagaggggatcacggggagtgattccccccactttattgcacgaggggacggcgggaggcggcgggattcgcggcggcggcggcgctagggcgcgcgggaggcggcgggataggcgggacgaaggggatgacgggtgggccccacccgtcagcgagggtggctggcgggcccgcccttcagcggcgcgcgcgcggggaggtgccgagtgggccgcggggagaggagagagaggggagggagatgggccgagccggcccaagagggggagggagggaattttaaggtttttctttttataaaacctttttaactttgtttatttcttcttaattattatttgtgctctgaaaattccactaaaatttatttacacattttaggcttttaggaaatatacaaaaatcctccaagccttctttgacttttaactttgcacattttaattgttggaggctttcacacggattttaattattctaggcataatttagaggatgtattttagagtcgttttgggacgtgacagtgaccgaccgggaaattcttcccgggtgcacacgagtgaggacaaagtgtgcaaaaaagacatgtgttggtttgtgagggcagtctatgacctatgaaagctatcagatgtaagcgggcctgtcctggggaaggcgggacattacagtattatagccctgccgttcctatagaaatccagggaatcccttttccctcggatttgattcttctggacaccaagaacttggatgtgatccttgggatgaattggttggctcaattccaaggagtagtggattgcgcaagacgcactgtcactctgtaccgagggctggaacaaccggttgttttctttgcacccccaacctctgtcggcagttccgaacttcatcagattggactgtcggaaacccccatcgtcagagagttcagagatgtgtttccggaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagcacttccccctagggtgctcccgtgatttttgtggaaaagaaggacaagacaaagaggatgtgtgttcactacagagctctcaatgaagttactatcaaaaacaagtaccctcttccccggatcgatgatctgttcgatcagcttaaaggagccactatcttttctaaaatcgatcttcgctccggatatcaccaattgcgtattcgtgaagaagatatcccaaagaccgcattcaccacgcgatacggactgtatgaattcacaatgatgtcgttcggtctgaccaatgctcctgccttcttcatgaacttaatgaacaaagtgttcatggaatacttggataagtttgttgtggttttcattgacgacattctggtgtactcacaatcagaggaagaccatcagcagcatctccgtctggtgttgggaaagttgcgggaacaccaactgtttgcaagctcagcaagtgtgagttctggttgtccgaagtcaagttcttagggcacgtgatatccactaaaggagttgctgtggaccccgaaacagtaaccgctgtcactgattggaagcaacccaagatagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactcttcatgaaaagctggtctcctcgccagtgttgatcttaccggatactcgcaaggactacctggtgtactgtgacgcttcgcgccaaggattggggtgcgtattaatgcaggaaggtcatgtggtagcctatgcctcacgccagctacggccccatgaaggcaactaccctacccatgatttggagttggccgctgtggttcatgctctaaagatctggcgacactatctcattgggaatcgctgtgaaatatatactgatcataagagtttgaaatacatcttcactcagtcggatctgaatcttcggcagaggagatggttagaactcatcaaggattatgatgtgggaattcgctatcatcctggtaaggcaaacgtggtcgctgacgctctaagtcgaaaaagccgttgcaacactcttggcgtccgtggcattccaccggaacttcatcaacagatggaagccctgaacctaagcatagttggtcgtggattcttggctatgctggaagccaagcctaccttgctcgatcaaatccgcgaggctcagaagaatgatccagatatgcatgggatcctcaagaatatgaaacagggtaaagccgctggtttcacagaggatgaacacggaaccctatggaacggaaatcgggtatgcgttccagacgacagggaacttaaacagctgatactttaggaagctcatgaaagtccttattccatccaccctggcagtacgaagatgtacttagacttgaaagggaaatactagtgggttagtatgaagcgggaaattgcagagttcgtggccctttgtgatgtgtgccagcgtgtcaaggcagagcaccaacgaccggccagacttctccaacctctccaagtaccagaatggaaatgggatgaaattgggatggatttcatcaccggacttccaaaaacccagggcggtcatgattctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgataggggaagccaattcacctctcacttctggaagaagctccaagaagagttgggtacccgattaaatttcagcaccgcgtatcacccgcagacagatggacagaccgagcgtctaaatcagatcctagaagatatgctccgtgcctgtgttctagattttgagaagacctgggataagagtctcccctatgccgagttctcctacaataacagctaccaagccagcatacaaatggcaccctatgaagcgttgtatggccgcaaatgccggacaccgctattgtgggaccaagttggggaaagccaagtgttcgggactgatatcctgagagaagctgaagcgaaggtcagaaccatttgggataatctaaaggtggcacagtcccgacagaagagctatgcagataaccgacgccgtaacctggaatttgcagtggatgactttgtgtaccttagggtcacgccattgcggggtgtagacaggttccagacaaaagggaagctcgcacctcggtttgtgggtcctttccgtatcattgctcgacgcggagaagttgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggagaggctagtgaaaatcctggacaccatggagcgcaggaccaggaaccgggtaatccgtttttgcaaggtccaatggagcaacaacgccgaggaagaagctacttgggagcgtgaaagcgagctgaaggcagcccatcccgatctcttcgccagttcttccgaatctcggggtcgagattccgtttaaggggggtaggtttgtcacgtcccaaaacgactctaaaatatatcctttaaattatgcctagaataattaaaatccgtgtgtgaaagactccaaaaattaaaatgtgcaaagtaaaagtcaaataaggcttggaggatttttgcatatttcctaaaagcctaaaatgtgtaaataaattttagtggaattttcagagcaaaaataataattaagaagaaataaacaaagttaaaaaggttttataaaaagaaaaaccctaaaagtcccccttccctcccttgggccggcccgacccatctctcctctccccccctctctctctctcctctccccgcggcccactcggcctctccccgcgcacgcgccgctgacgggcgggcccgcccgccaccctcgctgacgggtggggcccacccgtcatccccgacctcccgccgctcccgccgcctcccgccgaccgcgccggcttggccgccctcgggcgcgccgagtggctgccgcgtggggcccggccgtcagccgcccgcgccctcgggtgcggctgacgcgtggggcccacggcgccggccggtgcgagcccgggtgcgcccggtccaccgtggaccgtgaggctgccgcgtgggccccactcccggggacccggtccgcgcgcccctccccctcggctgacgcaatacacccctttttaaattaaaatttaaatgaagaaattcgcaaatattcatttaaagagcatataaacttcaaatggtcataacttggccatttgaactcggaattggaccgttcaagtctctaatttttccttaagaagtgaagaacccatttttgtgctttgttccatcttgttatatggagtttattagagtaaaagccttttcttttccgttggttgtgtagacgctgcagcttcggaagatccgctcttcgtggaggctgaagccgacatttcggaaagcgagcaaggcaagtcacattatccttgaacatattggatcccatcttataaaattattttgatttaaattattgcattatcgttttacttaaattcccgcgttatcactgttttatttagccatgcctatttacctttgttatgaccttattattattgttattgatattattaccttgttcaccctagattaaacaaaaccccaactagtggacactctactcatggtaccactagtatgaatttaggtagatgcttcgccgcttaattaggtaacattaggtggttttacaactctagactttgggaatattcatatcacctggacactatggaatggttggattattgaggaattggattcacacctccccctctattcaaaaccctcaaaatggttttaggctgggctcagggtgcatggttttgatagtagcacctcggccatataaggaccggtcttccggcctctgttgcaaagcactaccgtacttccacatgtctagtgggtaaggcttagtttgtggctcagtctggttataaacaaaagtacacgaatggagatggatgaagtcgggggtcgatggacatctctagggcaaatgaaggctacacgagctgcagcccggtagtcgagatgtcatggcacagggccggtgtcctactgctaggggctcagtcctgcctacctgtcccggaggttccggccgtaggtggggttggatcggtactcttgtctatggctaggatgggtaaagatgtacacctctgatcagagtataacctattcgaatagctgcgcccatggttatgggcaagccgagcaatgtacccaagttagtgttttaattcttaaatcctgctgaactactaaaatgtggaatggttggcctgggttggcttgggacgagctggaacccagggtcgggttgccagttcggtctgaatcatcgtaggccttgggttaaggcaggttcgtgtgggttcacggccttgattaataatattgtatagctctagaatggtgtttacaaaatagctttgagcaactaagtgtcttttaatgctgtttactgcaaaccctaaccctttatattataacccccttgtactcccttgcatttactctgcacttatgggtgtgtcttgttgagtacggtggttgtactcagtcttgctcaatttttcccaaacctagaagaggagcccctggatgatgaaggctttggtgtctagctcgtgcctgccgtcaagcgcctgtggtcatcgcagtcttccgctgtttcccgtttgtctttgtgtgtgctgggccttcgccgcccatgtaataaagtaactattcacgcttccgcttgataaactctgaaatgtatcaacttttggtgtaccttgcctcctgggacaaggaataatacacgcacgtaaggaacgcccgttgggttatttccggtcatgacaccaggtgacatcggctaccatattacttcttctaatcagcaatctcaatattcctcttttctaggttttagctgatatgttttcttttgacatcaggcaatttatggaagaagaagaagaagaagaaacaacaagtaaagtcttggtgcctctagccgatgatgtaaaagcaaccttgctagatatctcgaaacggcttgagggctccctagaaactctagtgactagctgtggatctatcagggatagatttcatgaaatccatgaccaaattccggatgagttagccgatgccatcacgccagcggcatacctcgagcagcatcgg

SEQ ID NO: 58638 - DNA, 76885 bp, Oryza sativa
atcttacaaggttctttgtgtctttatggaacacatgaccaaatcagtaaagtcctaatagtagctatacatgcttgaaatggaaatagatgaatactattcaagacatgttttaccatctcttctcttgtgcgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtatatgtaccttcgatttctcgttcatccaatgattgacaagagcaatccactggtcagaaagcacaccttctgggacattgttgcaattagcttccttagtctcattcacatcaaaatacaaatcttttagttttgctttatattgccgccatctttctccaattttttttaatatgaactcttccatccgaggagcataaaggaatctcatctacatatagcaacacagaaactcatatggccatatggggatatgcataacataatacaagaagttagcaaaaatgttgatctgaaaaggaattacctttacttgcttaagtatgtcctttttaacttttagttcatttgtatttttctctctctttcctattacatatctccagtctgtgtagcctaagctacacagactaccattcctagatatcattccaagaaatttacccaaaattccatcttcttcccctaccgcctgattgagatcattgcattgtaccacaattctaagccctttcggaaggttccaaacatctttcagttttgtcttgccacgtgtttcaggtgctccattttcaactgttcggtgttaaattgcgaagacaaaagtgatccttagtaatcagggatacgagtaataatgtcattatttgttaccattaggactattaaacttagcagttacctcgaacattaatatcaacatcagtatcttcattgccttcatcatcaatatcaacatcgtcattagtgtcttcattgccttctccatcattgatattaaaatcgtcatcagtgtcttcattgccttctccagaatcatcacatacagttttttgttcagatggtgtggcaagctgtggaagggtattttcttcttcagtctgttcctctgacaaatattcctcattgctctgaacaatacgcctttttctactccttgccatatctcttgcacccaaaaaaaacctatctgtcatttatggcatcgaaagtatatcattctcatttcagaagtaggactgtgctgtacatagtttcaaaaagaataatttcagaattgattataccctgagccattttggatttgtttttgaagaacaacagagtactgttgtcccaaaagtaatgctataatatggatctgtttgtcatactcactaattcatttgtccattttataggccaacaatttgaaacaagtaatgggtagaaataacaaaatttaattggctgcaaggtaaaactagatcacatatttattgcttacagttgtgtgaagcctagctgtacgtagaccaggctccttcagctatggacggtcagtgcatctgactccaaacctgaaaatacaacatatcaaattggtaagtattgtagtcctggaagggaattagcctccattgcaatttggcgactcagagaggtagtaagatgtgcagagggaggcagagattccggggcttggaaacattgccgccagccgcgcagcgtggagcagagcgaagtggacagccggtgtcgggaggtataacccgcatcaattgcagtgccccggtcacccggcacatcggctgggggcgtctccggcccgccgcatgccctacatcatccatggggcatgggggtcgcctgctcgtggctgttaatcggcaggaaggtgcggcagcagtgatggctggtacagcagccgacggagcggagcggtggaagatctaggagcgcctgcttggggcggtgggtcagtaaagcgcccggcatcttacctacagatcaacaccgatgaagacgaggaggagaaccgtagaacgacaggagagttcgtaggaaaggggaatcccacaacagaggaaagagatttactcagggagtcaggatagaggaaagagatttttaggggcagttggcttgcttttctcgatggggaaggtgggggcaaaaaaaaaagttggcggcaaaaaaaagaaaacagaaaaaaattgcgggagcaaaaaaaaaaggagggaaagagtggagggagaagaaaataattttcggagaggcataaattgctaaattcagatcgatttggggttgatttgtccgtcaaactagttatttaaattatattagcacaatcaaaaaatcacatgttatttcattgtcgatcttgtccggacagaccgcatgaaaaattatatataattaaataacagtgatttaatttttttagcacgaccaaaaaacaagtgttttttcattgtcggcccggtccggacagactggatgaaattcggacgtaacatattttggttagttatttaatttatctaagcacgactgaaaagacacgtgtttttccattgccaatccggtccggacagaccgcatgaaaaagacatgtaatatatttttgtcctaaaatatagttatttaaaaaatgttagcacgataaaaaacacgtgtttttcgttgtcgacccggtccggacagaccgcatgaatatatatatatatatataattaaataacagtgatttaatattttaggacaaaaataccacgtgttttttcgttgtcgacccggtccagacagaccatatgaaatctggacgtaaaatttgtgttaaaatagtagttagttaatttataacgaccaaaaaaaattgttgacccggtccgaacatacgggatgaaattcggaagtaacatatttttgtcttaaaatagtacttatttaatttatattagaatgaccgaaaagacacgtgtttttccgttgtcgacctggtccggatagactgcatgaaaaagtggcataatatattttaggtcttaaaatatagttaattaaaaatgttagcacgacaaaaaattcatgtgttatttcattgtcgacccggtccggacaaaccgcatggaaaagagatgcaatatatttttggtcttaaaatatagttatttaaaaaatgttagcacgaccaaaaaaatcacgtgttatttcattgtcgacccgttccggatagaccacatgaaaaatatatataattaaataacagtggtttaattttttaggacaacaaaaaccacgtgttttttcattgtcgacacgatccgacagaccgtatgaaatctgtacgtaaaatatttttttgtcttaaaatagtagttagttaatttatcatagcatgacaaaaacatgtgttttttcgttgtcgacccggtccggacagattggatgaaatccggatattcttaaaataagtttttgaatggtttatttttaaaattttaaaataaaaaagttcaaaaaattaaaaaatttctggggcaacagaatttttttcccgttcaaggagaggaaaaagtttttaggaattgacactagagaagaaatgaaacgattatgcatttgctagttctcgaactagagttgtcaatacagtagaagaagctaagtaccactaggctatgtccccctttatttattttttcacgttagctgcaattgagaatgtaaatagacttctcgaggtatttatataagatggaaatttaaattctgttagcacgaccgaaaaggcacatgctatttcgttgtcgacccagtgtggacagaccgcatgaaatttttcattgagacgtaaaatatttttggtcataaaataatagttatttaaattatgtttgcaaaactgataaaccacttgttttttcgttgtcgacctggtctggacaagccgtataaaatcatgatgtaaaataatttttctttaaataattgttatttaatttatgttagcacgaccgaaaaaccacatgttttttcgttgtcgtcttggtccatactgactgatcgcatgatcaaatccagacgtaacatattttgtcctaaaataatagttagtgtggccaaaaatatttatattgaaaaaataagttttcgatcagtttaattttaaaattaaaaataaaaagttcaaaaattctcattatctggccagctaagaaggatagggaaaaaaaattaggaatcgcccctagaaaaaaaataaaaaaaatctaggctggcatatttgttttcctcgttatctagccagctaaggagagggaaaaaattttaagaatcgccactggagaagaaatggaaaaaaaacgcatttgttaggatttgaactacagtcttcgatacggctgaagaagccatgtaccaccaggctatgtccacttcatgttggagttgtccgttcgacttacttattcacgttaggtgccattgacaacgtaaatagtttccattcacaacgtaaatagttttctccaggtatttatataggtggaaatggaataactgaacacaatagatgcaaagattataaacgcccattcctttttctcatcatataaacaatatgatatcctagatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggacagatagatagtgaaaaaccttcataacctcacctttaattagttaccatgttattgacagttgttccttctatatctcttcgaatccatgtctgaccatcatgtgcactgtcaaatagctccccaagattattgacatggtatggttcgcattccacatcattccattcttcgcccagttcaaatacatctctaggtttcatcttccttacaatagaccaccctggatttaaatggttttcaatgtaaaacacttggtcgacttgatttgcaaatacaaagggctcatgctcaatcttttcaccggtatgaatttatttgagaaattcacaagtgtgcagccaaacatatctattttcactccttttcctttagttacatcgacccattcacatttaaacaacacaactgagaaatttccgtagtagtctaactcaattatattaagtatccttccgtaatacatgatatcaccaaggacagggttagtatcactggcggacgtgtagctcgatgtttttgcagtcacaacaactccactgttttgagtcaccctgtcataacgctttgatatgaacctatacccacgggtattgaatgctctatgtcgttttgctacctcaattggtccacgtgccagccatctaatatcctcatcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctcaatgttttttggagttagccttttgcgtttcttcctttgcaaattagcagcatgttctctgcaaaacaaataaacataaatttgaagcaaaacacttacaacacataaaaaaaaggctatgttaggacaatacgtactttagatatggcactacagcatcacagttgtatagcacatatctatgtgcttgcaatttctctctatcagttaaggagtacgccgatggttttcccaatggttttcctactagaggaaacaaagtggattcttgcctactcatgggagtctcaaattgatctggtttgtcattattccttgatggtatgttatgcttggtagggaaaccttccaagtatcgcgaacaaaatgccatgcactcatctgccaaatatgattatgcaattgaaccttctggacgcgctttgttgcgaacatacgacttcaatttacctaggtacctgtaatatacatacaaggcacaaaactaataagttagtattgtatcatatgacatatgagaaatattataaattgtatgctaatatatttttagtacctttcaataaagtacatccatcgatagcaaactggcccaacaatcttacattcagtagctaaatggacgactaagtgaaccataacagtgaagaatctaggaggaaatatcatttccattctacacaatgtgattttaattgcttcttccaaacggtcaagctcatcaacatggagaacttttgaacatattcctcgaaagtaagcagataagtcaaacaagacagatgtgacttcattgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattgcatcacatcaagattatgctgaagaagattgacatcctagtaaggtagtgtgaataaactacttactgccttataagtttttgacttcttaaaatcaccgatagaatttatttcatccaataccggacgcccatagtaagtcataggctctgtactaatctctgtggttccatcaaaagaatttctatcaaaacgaaattcatgattaggtggcaaaaatcgacaatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctatcctcaaattaaaagtttcatttctaaatgcatcatatgtggaaatgccattggcaaatatgtctcttaaatcttctagaagcggctggaggaaaacatgaatgttatctccaggacttttgggcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaatcttttatcaaagttcttccatgccggagaatcagctggatgttgaagcacaccatcctctactaagcgctcttcatcatgccaacgtgggagcgatgctgtttctctacacatgaacaatcttttcagcctctcctttattggaaaatatcgtaagactttgcttggtgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagtagagataagtgtgatagttcacatccatcccataaaggcttctttgaatctttcaccaactcataaaatgcttgagcttctaaatttggtccatcagtgtgtgtgtatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggttataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaaatttgatatttcaggttcttgtagataataacaatgacaaggaattgtctcttatgatcatgatgtagcaaaaatagggcaattagaaaaataccagtataaaatcagtgtcagctaattttgtcacaacctaatagacctcctttatacactgaaacaaaagcttttactctgcaaaaatagagaagagttaaatcaatttacagaaaaaacatccagcaatctaatgtcaaagctgtcatctccaagttaaattccttactataaattacctctagttaatctacagatgatgactctagaagcacatgcgtttaaaacctatgttccaaatatccgttcggatgaacaagaaaaatctgcaggtgttattaaactcaatcagatagactcatgatgcaacaaacctgaataattaaaaaaaaagttgacattgacctggatctgacactgacctggatttggggccaaatggggaatcaacctatgagaagtggctaagaaaaggaccgtgcttgccgttgacccgctgtcgtcagcctcggcccgtcgccggcctgccgcggccgatcccctcgcgggctcaccgccgccgctgctgagaacgcgccgctggccgtcggtgtgcgccgtggcagtgatgtgcgagtgcgtgagaagaaaatgagatgcggtgtgggaacaagatggggcggcgctctcgtgcgtgttgggtgaggtgagagacacgagaggagaggagagaaagtgggagactaaggttgcctgctaaagtgctaatttcacagatcgtattttagttgttatgatataaacacctaaagaaatcatttaataagaaatgtgattagctcagttggttgggttgcgcacattctatccttgagacccaggttcgaatcctctgtttgcatctttgcccccctaatttattcctatcaggtatcagcagctcgctcaattattattattttttaaaaagcatgcttagtccaaaagttttaacaggaaaaaaaagcaactcacttgataatttcttttaaaaaacagttcgctagaggtccgaaatgaaaaataaatatctcactcgattattttaaaaaatacaataagttcgcttattccaaaagtttttacagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgactgtctccacggaagaactagatggctacctcagctctcccggcgtcgactcccgtcaaccaaccgagattctcgactatgacgacttcggctacaactatgacttcaacaacttcgacgaccttgatgaagactacgaagacaactacactcctctctttttggcgtctttatggccgacaacgagacagaagaacaacgtctggcacgcgaggccgatgagctgtgcacatgataggaagccaagcgccgccggttggaacaagagcggcaaacccaagagcaagcccgactgctgcatgagcagcaggagcccgagcgattgacatgggaagctgaggagcgacgacagcgtgctttggaatcagggcatcgagcgtgagctaatcagacaacaagacatcgaaggcacatcagtttttcgcaccccacagcagaatgcggttgcggcgattacaattttggataccctccttgtcgacgggtgatacccgtagaccggatatagagggtattggtgtacgctggtacaaggatccacatagtacgacatcgagcaatcaaaagacaagaattatattggttcaggccccttgacaggtaatagccctaatccagttgatgtgggattatatggtggaaaacacaggttacaaaggaaaggatggaacttgtcagatccgacgagattgtagtcgagctgattcgactagctcttgacgacttggctcctcgcaggctccgacttcgtaggctgtgtgggttatgttggcactgagattcgatgatctatgccctccccggggggtcccttttatatcgcaggtctggtgctctccgagtgggactcgaacataccagacctagcacgatacgtaggtgacccagttcttgtccgagaaggacttttcccatctattgatctcgtgaaaggtttccttagatcataaaggaaatatccgcgtgcgcgtgggtatgccatgtcaatacgtaacgtatatcgaagggtagggggtatgcctgacccgtaaccttgacagtagccccccgacttctgctcaaaaaatgaactcgtgcgaccattcgcgacttcgggtgtcgagaacgttatcattcctggtgcaagaaccgcggagatgatgtgtaatcgagcataccgtttgaaacccaacggtcacgagtgaattttgaactgaagtccaaaaactgccgcgcgtaatggacatataaatttccggcgggaatttctctcagttccttggaattcacaccatcgggggtgcgcctatttaaagggattttgggtgcgcattttgaaatccgccaactccgtcaaacacaccgcctgttagcactcctcgccttctccgctgccgtaaagaactctagcttcgccagctctaggtccatctccggcgatcttctagcaacgatggatctcggcaaatcggcttccaccagcgcaaacctgaagaagctccaggaggatggcgcccttcctggccgtgaaaaggcggagaggaaagcaggaggtactaatcctcagcccatcttaggtcgcatggttgcgatcaaagattatattgtctgcgggtttctccctccaccctccgaattccttctactggttttgaatttctatgggctttctcttctgcacttgaaccccaattccattgctttccttagcgtctttgtgcatctttgcgaggcctacattggggtagagccctttcttaatctgtttcgcttttattacgagttgcgctagatggaacccaatagggtatccggttgcgtcgggttccgacttcgtgatggcatgaagtcgcgttatgtccccttccagtgtccatcttctcgcagcaaatggcggaacaggtggttttaccttgaaatcaaggattcaaatcctgtcctcgttgttcccgaggaacaaccggacaagattccggtctggaccgccaagccccccttgaccccctctctccaatcatttatcgacatcatcgatgatctccaagaacggggcttatcgggatatgaagtcgttgcagacttcgtcggtaggcgaatccagccgctccaaagtcaggcccatccagcttataactattccaggccagacgacgcgacccgggtttctcctcggtgtatctttctcgcattcatttagacatgcttgtactcgcgttcctcttcgacttatcaaaaattgattcctttttgacaggtctgagcagcgaaaccgtggagcggcgtgttggtcaggtgatgatcagcggcccgaccacggtgagcaacatccccacgcccctttgtgaaaagggagcgacggagcgcgacgaagcgatcaatatgagttcattcgatagcgtcccgccttctctgctcgaaatcagcttacgacatgatttagcataggcccttcctttgactgatgtcgtcggaacgctcgcggatcatcaggtggcggcatctctgaaggagaaagtcgtcaaggaggcgtctgacgctgccaccaccagtggtggcgaagctccgaccaaggcgaggaagttctcgtctgtgctcagacatcgccgcaaagcagcgactccctcggtaatttcaccttgtcgctaggttatgtagcaaggaaggtttattctcatactacattggttgtcttgcaggcttccgacgcgtctcctccacctccgcgacgtcagagcattgtgacgatcggcgagaagttagtacacagacttttggattctcgtgtcttctgttcaaatggagttttgattcgtggtcgtttgtagggaggcgcgggcgaaggctgctcgggccaaatctgggggaacgtccagcgcatcccctaccacggtgtcgacagatgtcgtgcccgtggtcgggagtcaggaggtgacgccaagcggccctatcagcgatcccgctgggggtcctagtctgccagaggccgtcctcacctgggaggagctccaagtcgaaatgggccgccttctcaaagctggtgctcgtggcatcggccgcgagatctcagaggcgagggcggagacggcagcggcaaacgcgcttgccgagcggttggtgcgggaactagctgaggcccgcgaggacctcacgaagatgagggagcttgtggccgggaacgagcgccaaagcaaagggctcgaggaccgcatgtcggaacttggagacaatctctccgagatccgtggttcgctgcgggtcacctacaccggcctccaccagctcgccaaggagtgcggcgtcaagtccacgatcccggtgaacctcgatgagttctcgttgacttcttctcttgcggagctggcgacagcaatgggggaaatcccctccaagcatacgtccaggatcgcggaggagacgtccaacggtatctacaccggggtgtgtcacgtcctcgcgtgtgtaaggttgtcgcgccctgaactcgatctgcgtgagatcttggatcagggggcggcaagcgacacgcgtaaggaggtgatggaagaagtcagtgacctgggggagtctgtcctccccctttttgaagagtaggacttcttgtattttttataatttgtaaatcttgaactctggttgccttcgtgcatatatgattaccacccttgttcaatgttgatcttggaagtttttcttgtcgattgtagagatgctgatgacgaggatgtccagcagcgcgggcagcccgagtcactggcgataattccggtactcgaatttgaaccacacgtctcacacgacgtcgaggaccatactcttgatgtggaggtcgagatggcgacagccacctcaagtgagtagcctttttaactccgttgggttagtggtttccagcttgtcttagtggtcgttatgtttagcaggtctcaagaatgcccttgcaacccaagatcgtcgtatccaatattggaagactaaattttaagtggcggaactcgagagaaccatgctagccgtgaagaaagagcaagccgtggaaacgctccgaggccgcgaggtgtggtttgtgtcatatttaaagagttgctgtacctcaatggcctgggtatgcagggagcttcgagtagtccacagcgatcctgaagagtcggcggccgagtacatctcgtggctcaacggggcctgtgcccaactcgatggcatcggcaatcgcattgacgaagccttgaagcaagagtgtcgtcgaacgagccgatatgccggaggacatgtgctagcttgcctgcgagatcaccgcccgcgcctggatttcgaattcctccatgaagggtttgctcgttctcggaggacttcggcggagatagaccaccttgcgaggtcgatgtcgccgttagccgagaaggtattccagtctatgaactggcattggccctcttggtagtactcgtggcctgctacagatgtcttaggaaaaagtgtaatgtagtgggagatctatgtaaaaaacagtaagaattattatgtgaataaagaaatattccttaaacaaatgcatcttactctggatgttatgtgttagagtgtgttatcagttaacgacctcggccgtttgagtcgtacactctccctagcccctagccttgtcgtcggagaaattttctcggatgataaggctcttggacacttgatctgccttggttgaataagctctgatcctagcccccagccgtgaagttggaaagctcggtttccagttacacggcttggttaatacgcacggcgagaactcttacatgaccagatcttacatggtctttcgtctctgaaggatctgacaaggccttatcggctttgggcgtccccagccgaagatcccttaggttccttggaggccttgtcgagacggcgtaaagggtcctaaggataggtttcaacgctaggtattatcagagtaagggatcatcgggtgaaaacactttggtcgtggtatgaagcctagaaataggctttattgatactgtaagggtgcttacaggtacggcgttattgactcatacatagaatttacgtagttggtcaatgttccacaaatttgctaattcgcggccgtcgccgtctgcgattttgaatgcacctggccgcaagacttgtgtgattgtgtagggtccttcccattttggtgagagtttgtttcgtcctgcttggctttgaactcgtcggaggacatagtcgccgatcgaaagtatgcgtgctcggatgcgcttctcgtgataacggcagagggcttgttgataactagctgctcggacggcaactcgctcacgatgctcctcgagaaggtttacatcgatgtctcgctgttcctcctggttctcgtcgaaatgcttctgtactcgtgtactttgatgtcgtaactcgctagggagcatggcctcagagccatacacgaggaagaagggtgtttccttgttggatgttgtcggtgtggtgcgtacgacccatagtactgatgggagttcttcaacccattttttgtcatgtgacatgagtttgtcgtagacgcgggtttttatcccttgtagtactatgccgtttgccctttcgacttgtccattgctttgagggtgagagaccgaggcgaaacatattttgactcccaaaccgatgcagtaatcctggaagtcggcgctgatgaattgagagccgttgtcagttatgatgcggtgcggtagtccgtatctgcagaatatccctcttcgaacttaatggcgttgtcggccttgatttccccagtgggtagtgcttcgatccatttggtgaatttgtcgattgccacaaataggaatctatagccaccctgtcctcgtgggaatggcccaagtatatctagcccccagcacaagaacggccaagtcagagggattgtctggagcgcttgtgcaggtagctttgtgtgcttgctgtggaattgacaggcttcacatcgctggaccatatcgcatgcatctttaagggcggttggccagaaaaacccttgtcgaaaggccttgccgactaatgtccgactggcggcatgtgacccgcatatgccttcatgtatgtcgaggaggagttgtctgccgtcgtcggtagagacgtatttgagaagtatcccgtttggcgcttttttgtataaatcgttaccgaccatacagtagatctttgctttacgggttattttctcggtctctgtatcgtcctcgggcaattcctcgctgctgatgaatttgattaatggggtgcgccagtcgtctgtggtttcgatgtcagcaacggcgcgttctgcctcggtgtccttcgagctaatgtcgggggtgctcgggccagattcaccgttaacttctttcaccgatggcttcatcaggacgtcgagaaaggtgccggtgtcgagcggttctcgtctggatgcgcatcatgctaggtcgtctggctcgacgttgtccttgcggtagacgtgtcggacctcgatcccgtcgaacctcttctctagcttcctgacctctgcaagatacttggataactcggggttggagcatttgtagtcattgtgcacctggtttgcgactagctcagagtcccctttgacgattagtcgcttggccccaagtgcggctgcagctcgtatcccagcgagtagtccttcgtattctgctttattattggttgccctgaagttgaggtggattgcgtgcttgaattgatcttcggagggtgatgtcaagataaatcctgcccccgctccttggctgttgagtgcgccatcgaacgccattatccatgtctcattgtcgccttggttgtctgacttgttatctggcatggtccaatcggccatgaagtcggtgagtacatgagatttgatggctgttcgcggcacaaagtggatatcaaattggcttagctcgactacccatttcgcgatgcggccgacaacgtctttgtttctcacaacttcgccaagggggaaggaggggacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgctgtactttctctctctcgactacaatgacagtgctaacggaatatggcgtggcggcaatataaaggaataattcttcattaggttggggagcaacgagtacaggtgggtttgataggtagcgcttgagtgcaataaattcctcttcggcttcctgtgtccatacaaatttgtcttgtttcttcaacaaagagaagaaaggctgtcctcgttctccgatcctagcgacgaatctgcttaatgctgccatgcatccggttagcttttgtacctccttaagtcttgtgggcgacttcatgttctcgattgctttgatcttctcgggatttgcctctattcctctgccagaaacaaggaatccgagtagcttgcccgacggtactccgaatgtgcacttctctggattgagcatgaggcgatatcgtcggaggttgtcaaacgtttcccgcaggtcgtcaattaatgagtcgcttgtcttggtcttgacaatgatgtcgtcaacgtaagcctcgacattgttgccaagctggttgctaagtgcgccctggaccgtgcgctggaaagtattcccggcggttatcagtccgaaaggcatcttaacgtagcaaaataccccgaacggtgtgatgaacgctgtcttctcctcgtccttttttgccatgctgatttggtggtagccaaagtaagcattgaggaagcttaatagctcgcaaccggctgttgaatccaccaactgatcaattcgagggagaggaaagtgatccttggggcacgccttgttgaggtctgtgaagtcgacacacattctccattttccgttggccttccgcaccatgattgggttggctagccactctggatgaagtacttctctgatgaagccagctttgagaagtttgtcgagttcttctcgtatggcttattttcagtctggtgcaaatctccgcagtctttactttactggcttggcatcgtgtcgcaccatgagtttgtgctcaatcacctccctggggacccccggcatgtcggacgggcgccaagcaaacacgtcgacattatcgcggaggaaggtgatgagcgcgagttcctatttctcatctagtgtagccccgattttgatagtcttgtcggggttagcctgttgagcggaatgatcttgatggcgccgtccggcttcggcgtcttgtttggcttgctcactttcttgggtggctcagacgtggcgggtggggtgggcgtttgctcgaccatgtcgaggctccgcctgtcgcactgcaccgccagctttgcattcccctgaatagtgattgttcccttcggtcccggcatcttgagcacttgatatgcatagtgggatgcggccatgaacttcgcaagtgcagttctcccgatgatggcgttgtaagctgtatcgaattcagcgacatcgaaagtgatctgctctgttcggaagttgttggcttggtcgaaagtcacgggcaacgtaatcttgcccagaggtctggacgatgattggggagtaattccatggaagggttgatcggttggtgtcaactcactttgtggaattcccattgcatccagagtgctggcgaagaggagattgatcgagctgccaccgtcgatgagaactcgcgctaccttgacgttccgaatagtgggttcgaccacaatcggatatcgtcctgggataacagatgtcttggggtggtcttcttccgagaactctattctctgctcagaccacttcatcttgggtgcagcctcctaccacgtcgaacagacttcacgttccactttcttgtattcccgcttggaggagtatgttgtggagccgctgaagatgtgtgagacgtggaggtcggagcctgggtacgcaggatccgattcgtgaggaggtgtctcctcgttcttctcgacaacgcgtactcgcttgcttttttgaaacgccatgtgcttctcgagcgactttttgaaaacaaggcaatcctccagagaatgtctgtccgttttgtgtatggggcaccatgatttctttgtatcgctgccttgtgggtctgggcgcttgggagggttcgcgtattctgctgcgaggacttccgcttaagctttccttttcccgtttttgcgatttttcttcttattcgactcagatgcgtctgcggctggtttcttctctcccccagtcttcggcttgtcgttcttgcgtcttagcgcgtcatccacatgggcgcaccgctcaacgatctcgaataatcttcgggtagttgtgatgcgtcttgtcaccaactcctgggtagtgtagcgatctctgacaccggacttgacttgaaggcgcgagttacagaagcgtcggtaatttcgggaattgtgtttctgcactcgttgaagcgccgaacgtattccctcaatgattcccccgagttctgtgttaacgcgtgtaagtcgtcttcgatcgcgtggcgcttgtatgttccttggaaattggcgacgaactgttgccacaggtctgcccacgaagagattgagtaggggggaagatgcatcagccatgtacgtacagaacccttcaacgcagttggtaaatagttcgccaacgcgttgtcatctgctctggcagcataaaacactatcgagtagacttgaaggaattcttctgggtcggtgctcccatcatacttttcaatggccccgggtcggaatctctcaggccatcggacatcacgttgggaacgaccgaaagccctacacccagcactaggggcggtgggttgtcggcggtcgcatgaccttcgtggatgtctgtctgacgatgaagaggacgcggatgatgacgatgacgatgggtcgcttggctccggcgtacgattacgaggatgacgacctggatcccgggaatcttgtcgttgtctctcgctattatctcggcgccgatctccttcgtcgtcgtcgttgcgacgacggccatgaccagtattgtttggcccccgccgttcgcgatcgttgcattctgggtcctcgtttgggcggtttcctcgatcatggcgccgtgaagaaacatgacgccgagagcgatttgcgtcgtcccgtgtgcgccgtgcttctcggcggttgttaatttgatctcgaagatcgctagtgccacgaggtggaggggtagcctgtcgaggcaattccctccgctccggatcttcaccattggcgtcgccggttggtggctgatcttggtgtgctgcggtagcggcctcttcgaacgcattgctgaggttggtcaccgactcccgtaatcgttctgtccaacgctcgaggtcgtcgttcagaacaggatcgtaaggagtttccctcagtatagcttgaatagccctgatgtgctgggccggagtagtcgattgattcgccgcttctgcgttggcttgtgctgatgtgccaacgtcatcgataactaatacttcccatggcgcacttgttgttgatgacccgtagtcttcgaggagatgtaagaccgatggttcgtgaggatcgagatcgattaccccaacgaatcgatctgaggctggagtcgctccctgttccttgccgttatccctagcggggacgtatgacttaggagacagggttttcatggcgccgaggaggactttgcagctcgagagatcgtgattctttgtcttgtggataggacaatagacatcccgagttggagaaatacactgaattccacgttccttgtaggcgcgaatttcagcacggacgttgatgaatacccagcaatcttgaagggtatgtttcttggttttgtggataggacaccagaagtcatctttgtcggcccgtgatttatgtcggagggacaagatttggccgcatcagaatccgtctcgagtttggatgtagtcggtaatccgttctccgtttcaacgggtggatttttcgacatggagccgtcttggttcgtagccactacgttctcgttttcagtcattggaggaccggttgagatcggcgtcatggtgtaaaccgggaagacgatttcgccgacatgagtccataccagcattgttgaagttgagagtgcttggctggagctggtgttgatgttgttgtcgacgaagcttgatggcatagtagtagaaccttgagtaccaagtccccctacctggcgcgccactgtcgacgggtgatacccgtagaccggatatagagggtattggggtacgctggtacaaggatctacgtaatacgacatcgagcaatcaaaagacaagaattatactggtttaggccccttgacaggtaatagccctaatccaattgatgtgggattatacggtggaaaacataggttacaaaggaaaggatggaacttgtcagatccggcgagattgtagtcgagctcattcgactagctcttgacgacttggctcctcgcaggctctgacttcgtaggctgtgtgggttatgttggcactgagattcgatgatctatgccctccctggggggtcccttttatatcgcaggtctggtgctctccgagtgggactcgaacataccagacctagcacgatacgtaggtgacccagttcttgtccgagaaggacttttcccatctattgatctcgtgaaaggtttccttagatcataaaggaaatatccgcgtgcgcgtgggtatgccatgtcgatacgtaacgtatatcgaagggtagggggtatgcctaacccgtaaccctgacactccttaaagaggatgtgcccaatcacgttctcaacataatcaatcagacaaagacaatgatcgccgcatcagttccagtcaacctggaaagcattcgggtgccaactggcagtcgggttccatccctccaatctgaagattaccatcaaccaagtctcagcatcgcggggtcaagatccaatcacggggggtcatggtctgctcacgggggcagggatcatcatgaacatttagttcattcgccagccgataggcacagagagtgacgcgctgagcagcctcacttgccatgtcgctggcaacccattgacctacgtgacacacttaaccgctgctgtgcagaaagaggtgatcggcggcatcgaaccctggactgctacgaatatgatgaagatggagtcgcagctttcacaagcgacctgcgtcgagtggattggccggctggttttaagccgactggcatcgagaagtatgacgaaaaaatagatcctgaaccatggctcactgtctacggtctcacaatccgcgcagtaggagaagatagcaaggcaatgccaaattatttaccagtggccctagctgactctgctcgatcctggcttcatgggttaccacgaggcaccataggatcttgggcggagctccgagatcacttcatcgccaactttcaaggcaccttcgagcgtcccggcacatgttttgaactctataacgtggtccagaagcccggtgaaacccttcgggaatatattcgatgcttttctgaacaacgcaacaagatctctgatatcacagatgatgccatcatagccgcattcacaaaaggagttcgtaatgaccttctagtcggcaagtttggatgcaagcctcccaggatagtcaagcaaatgtttgagaaggccaatgagtatgcaaaggctgacgaagccgttcttgcttccaaccagtcgggcagccactagaaatccaagaaagatggaccaaccgtaggggcgagtggaagcggcactcataacaaagatcacaagcggaagcccgaggatctggtggcgactacaacacattcttcccgtcaacaatcgcgagtcaacaccttcgacaaaattatgaatgctcaatgttcgcatcacccaaattccaaccatgctgccaaagattgtttcatctataatcagtttgccgaacaatatgccaaacaagcgaagaagctgactgatggagagcaaagcacctcgaagaaaaaggacgacgatgacgatggcccacctggttttcaagattctcgtaaggagctcaatcacatcttggttgggccgcaagcctatgagtccaaacggaagcagaagctaactgataaggagatcaataccgttcagtcggacacacctcaataccttcgggtggtcggagatagcaattaagtttgactactcgaatcaccctgactgtcacaccctaaaaatcccaaatgtataaattgttgtttaattggaattattagaaataattttaaaagcctagaagagaagatctaattttaaataataaattccaatataaaagtgggccagataaaattttattaaatacttcacttgattctatagttcctagatttttctgggatttatttgagccaaggaagcatttttaataaatggaattgcatttcatgaataatttaaattgaaaaaggttttaaaagtctccttttggctttgggccgaaagtcggcccaaaagctctctctctctctctctctctctctttccccagcccagtcagcccacgcgcgtgcgccctcgcccgctgtaaggtggggccgacttgtcggactcgtcttcctcctcgcgccgccgtgccctagccacgccgcgcgtagccgccgccgcccttccaattcgatcgcgtctttccttctccggtgaaatcaatagaggggaaatgatcgccttgatctcctctatcttttctcttttggaatcatcggctaatttcttttggaaattggtggattcgagttcgattcggatcaatctctctctcccgaaccctaactttccatcgccgtcgcccgttgccgtggtccttcgtcgccgccctttagccgctataaaaggaccgccgagccctccgctacccaccgctaccttcgccttcgtctctcgtcgctggtagagccctagcgccgtgtagcttagcgccgccgtcgccgccgttcgtacagccgtgcgtcgccgccgctccggtcgtcgtcgtcgctcgggaaggccgccgtcgtgatcgccaagccgtcgcctacctcgtccacccctccgtcatcgccgtaggtcaccggagcaccgccgtcgtcgtcaagccgaaggtcgccgccacttcttcctcgccgccgtcgccgtctgttgatcttccgtcgctgctttggtccctggtgagttcgccgtgtcgtccgcaacccgtaggtgccgtccgttcgcgccgccgcgccgtcgttcaccggcgagcatgcgtcgtccgagccgtcgccggtgatgacgtcaccgctgacgtcattgtcgccgtgtctcgtgaaccgccgtagactagatcgatctcgaccgtccgatttggttagagtgatctcggccgttcgtttccgtagaccgccgccgtgcacccggtccaccgtgaaccctagccgctgacgcaataatcccctttttcttttcaaaaataattcattattgcgtcataattcaattgatatctatataaatggtttaatctgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgattttgcaggagaagactttgaagagttccaaggccagcaaggcaagtcacacagatcccaaacaaccctttgagcatgttgatcccgtttaaagctattgtttctattcaactattgcatttattttcgaatgtcattgggtggatataacctattgcctttgttatagcctttttatgttgattacctattctttgtcacctagttaataattggattagctagaacattatatggttttagctaaagtgattaggatgcttagccatgcttagagacactagctcatataaatgggataacttatgattcactattatttaatgatggcttaatgatagctcacgatggttgatcgtgattggttaattaattaatttgccaactaaaacttgataatggtgggttgtgagcacatggttttgatggtcgtgctcatgacaattaaggaccggttcacgattttcggttgtgaaacattaatcgtgcgaaccacaagccagcgtgggcaacggctttactttctgtatagtgtggttcattgtagagcaccagactgtgaagtggcggagataagcccacgggggtcgctggggagtccatgccttgtttataagggggtgattatgatccaggaacggtgcactgctttgaattgtgttatgcaggaggtattgtcacaatctctattcgggtacttgtcaagtatcgcgacgcatggttgacatgatgttgaggttgtgtcttgtgggtacagtggtacacctctgatcagagtttaaactattcgaatagccgtgcccgcggttatgggcgggtctaacaatgtctttcgtgattagtctcacacttctcactatattaaatgatgatgttaataacttgtttagctcctggtttggaatggtatattcctggtttggagatagaactgtgcagccgggattggttgttcagaatggttgggcctatgcaacacgggtgtattgtatagtgttgatttaatattgtttaattactcaactgttttactattctctcaattgcttattaaatgctgtttatgcaaatgagcccatattatgccatccttcgttatccattgcacttgcatatttgttgcgtggcttgctgagtatgtcatatactcaccttgcagtcattcatcagaggaggagttctacagtgatgctgatggtgtggatgattaggcgtagccctggtcaagctgcctgtggagaggagtcgcctgtgctgtttcttttattttccgctgcttagaactttgttgtttgagaggaactatctacctctgtaatgactttatattcgcttattaattagagtaataattgtactctattatcaatttgttattgtgtgcctcggctgatttctggacgagggtttacacacatgtaagcgtttggaattttggatagaaattccgggcgtgacactgaccgagtggtccacccagggtggtaccccctggtactagacctagtggttcgcaacatcaaacttcggttatccctcatcgatggtggcagtgcactcaatattctttttgccaagactctggacgagatgcaaatcccacgaaccgagttgaaaccgagtggtgcgcccttccatggagtcatcccggggttgtcttcaaccccactcggccagatcaccttgccagttacttttggcactcgggagaacttccgtacagagaacgtttgtttcgaagttgctgactttgagacagcgtaccatgctatacttggacgcccggcgttagccaaatttatggttgtcccacactacacctacttgatgatgaatatgccagggcctcgtggagtcatatctttgcgaagcgacatcaagaaagctgtcacctacgacaaggaaagctgcgagatggcccagactcatgagattacacttgcccatgaatcaatccgactggctgcatcaactacgaccgaaggagtagtgcctgcaactaacatgccaaagaccgaagaaggcgatgtcaaaactaagaagattcctcttgatccatccgatctctccaaaactactgtaatagacgcagagttagattgtaaataggaaagcacgctcatcacctttcttcaagctaataaagatatttttgcatggaaaccatctgatatgcctggtatcgctagagaggtgattgagcactccttaaatgttaaagatgacactatgcctatcaagcaacgactctgctgattttcttaggacaggaaggatgcaatcaacgaagaactgaccaagcttttagcagcatgcttcatcaaagaagtcttacatcccaactggctagcaaacccagtcttagttcggaagaaaacaggacaatgacgcatgtgtgttgactacacggatctcaacaaatcatttcctaaagatccttttgggtcagctttttggattgctactcgggatatcaccatatcaacctaaaggaatccgactgcttgaaggcctcatttattacaccgtttggagcttactgctatattactatgcccttcgggttgaagaatgctggagcaacttatcagcgtatgatccagagatgcttttcaacatagatcggtcgcaatgtagaagcctatgttgatgatgttgtagttaagactaagcagaaggctgatttgattgctgatttggaggaaaccttttgctagcattagtgcttttaggatgaaattgaaccctgaaaagtgcaccttcggagtactgtcagggaagctacttggctttatggtgtctcataggggcatacaagccaacccggagaagatcaatgccatcctcaacatgaaaccgcctagctcccagaaagatattcagaaactgactgggtgcatggcggcgcttagccggtttatttcaagatgtggcgagcgggggatgcctattttcaagctactcaagaagactgataatttctagtggggtcccgaaacccagcaagcccttgatgatttcaagagactcctcacgactccaccagtcctagcttcatcacatccgcaagaaccattgctattatatgtgtcagcaacatcgcaggtggtaagcatggttttggttgtcgagcgagaataggagggccatgttcaaaaagttcaacgaccaatttacttcgttagcaaggtcttggccgactccaaaacaagatatccctaggtagaaaagttattatatggtgttttaattaccgtcaggaaattgtcctattattttcaaagtcactcggtcacagtagtcacatcttttccactcggcgacatactccataatcgagaggcaactggacgtattgcgaagtgggctttggagttgatgtctttggatctatccttcaagccacgaacgtcaatcaagtatcaagccctggcagattttgttgccgagtggaccgagtgtcaggaagatacacttggggagaaattggagtattggactatgcattttgacgggtcaaaaagactctcgggcactggagcaagggttgttatgttttccccgactagagagaggttaagctacgtgctatggatacactttcaagcatctcacaatgtggcagaatatgaagcgctactccatgggctgaagattgttgtatctctagggattcagcgtctggtggtccgtggtgattctcagttggttatcaatcaagtcatgaaggattggtcctgtcttgatgacaatatggctgcatatcgacaagaagttcgtaaattgtaagacaagtttgatggtctggagttaactcacgtgcttaggcaccacaatgaagcagccgacaggctagctaatttcggatctaaacgggaagcatctccttctaatgtctttgttgaacatctctatgagccgacattatcaaagaaggataaaactgaagatgaagagaccaatgaagtagggatgattgatgtcgagtggagagagccaatcatcaaatttttaactcagcaagagttacctcaagacaagaatgaagcggaatggatttcttgatgtagtaagctttatgtcatggttgaagctgagttatacaaaaagagcccatctggaattctacagtgatgtgtttctcttgaggaaggcaggcaattgttgcatgatatccattatggaatttgtgggagtcacgcggcagcacaaaccatagttggcaaagcatatcggcagggttttttctggcccacaacggtgtctgatgctgagaaggttgtgtgaacgtgtgaaggttgtcaattttttaccaggctagttcatctgccagctcaagagttgcaaaccatccctctttcctggccttttgctatttgggggctcgatatggttggtcctttcaagagggctaccggaggatttactcacctttttgtggttgttgataagttccccaagtggattgaagcgaaaccagtcgttactattacagctgacgaagctcacgatttctttatcaacattgtgcatcggtttggagtacctaatcgaatcattacagataatagtacccaattcactggtggggtttttaaagatttctgtgaagactttggtattcagatttattatgcttccatagcgcatcctatgagcaatggtcaagttgattgcgccaatggtatggtacttcaaggaattaagacactggtttttgaccgacttcgtccctatgctggcaaatgggttgaacaattgtcgtcggtgctttggtctctgcgcactacgcctagtcgggctacgggccagtcgccgtttttcttggtttatggtgctgaagcaatgttgccgagtgaagtggagtttgaatccatgagatttcacaattttaaagaggagcgctatgagaaagaccgagtggatgatctcaaccaactagaagaagctagcgaggcagcattaatccagtcggcctgttatttacaaggacttcggcgttaccataatcgcaatgtcagatcacacgcatttttagtcagggatatggtgttgaggaagattcaaactatacgggatcggcataagttatctcctttatgggaagggccttttatcatctctgaagttactcggccgggttcttatcgactcaagcgtgaagatggttcggtcgtcgataattcttggaatattgagcatctttgtcgtttttatgcttaggcattatttttgtacattatgtttctcttgactgccaacatcaagtatttcttgagttaccagtcgggggctataataataataatggagtgtgatttttatcaattcaatttgcctacttgatttatcattgccctgtttgatttttagcttagtcaataaggactgaaagttttttgacgacttttgcgggttctaggctcagtaaagtttgacaaacacttttaagaaatcagaaactaagtttaaattttcaagcacaacataaatatatcagtactacacaattgaacctccattgtcagtattacatgatcactcgtcagagtcatcttctccatcatcagagttagcaggactaaggctagtgttctgaaacctatctagtacatcaacagcaattctttcagcagttttttgggcatcattaatcagatcatgtgcgtcttcttcacttgtgccagctgcaaagccatcaatagcatcgacattgattttggggtacagagacttggtcattgccaatgccatgcttgctcccatatttccagcctccttgatatttttgaagtacacatctagagcagtccttaacttatcaaaaatttctactgtgtccaaggagctcgtaccactattgctcaaatacatggcctagataattggggtagcagtgttggcaacttcgcctctagcttttttagcaacttcgactttgttgatcaagaagtcgaattgtgcctttgtcttccccttatgatctgcatacaacaccaatcaaggaatttagatgcaacagtattggctaaatttcatttatagttagtcagaagagttaccttcaaattctttgaccgccaaatctttctccttgggtagagcagcttcgtcttctaaggctttgattcgcttttccagttcggagattttggctgcttgaactgtagtgcacacaaaacttatacagttgctaagattaagtttgaacagttgagcaggaataatatttacctttcgaggaaccactcaattcaaagttggcatcctggagctcggcaatcctatccctaagttcatgttctgtattcctggcctcctccttggtttcatgcagtttggctctggtttcttccagagtaccaagatgagggaccagcttttcaagggtatcggtttttgcctcgttccgaagatggattctctgcgcaatactatgttcacctcaacaaattcaatggatgacgaaatatgactggggcagtatacttacgtttaaaagacgagtagcctggttgagagtccttgtcagcagagccacttcaccgtcctctttttgcttgtttatcacaataccctgtggctgcatctcgtcgtcccaccatttaaccaaaataggtggccgagaatcttcagttgatttaatccgaagaatttcttcttcgtcgccaatcattgggccttcaagtatataggcagcaatgaaataataagggaagtttttcttgacataagttcactggagaaagcattacctgtgataattgtcggtggtggccgagcaggtccctccaccttgtcaaaggtactagcttcaggtccagcatctgtatcttggttcagaggaggtctgctggtctgctcttccgtctcaggaatatttttttccccatctacattttgctgctggggattctctttatcctcacccggctggtttccagtcgggggctcctggctggtgctcgcctcggcagatgccgattggtttccagtcgggggctcgttgtcagcttcagtttcaccagttgccgactgactgctagtcggtggattttctttggaggtattagtcccggcaacagcagcagagctagtcttttcttcttcagccgctcccgagctagtagagggatcagagtttttaccagtcggatcaatgtccgatggtttcctaaggtacaagagggtattaccaattgatctcaacaaacacagatccgaatgttttgatgaactcatacctggaagatcttcggatttttggcattgggtgactggttgttttcttcttcggtggaatagccttttttggctgcttgccaactggcccatcgtcactatcgtcatcatcgcttacgatcatcttcctttttcgagaaaccgtttgactgggcggaatagcatctcttttgggccacgggttgaatctttggacccccggtagcttggccttggtgatgccacggagaacgacgttgagcggttggagggtcggatttcattagggcatttccctatggataagcaattttgagattattcccaagaatagcatgataaaagtccaagcatttagatatttaccgctggaggaggattgaaggcgttgtatggcacgatcggcagcaaatgtgagaagctgaccacaataccagatgagaagattttatacatcctctccttcatgatcttgaattcgagggagttggggtcttctcggttgggatcagtctttccgtcgtactcgaaggccgtgcgagatctctctttgattggagccagtcgacactttatgaagtgctgagtaatctgctcttcttgaaggccttgttcctttagcctcagcagtcggtccagcaactcaagagcttgagaagcttcatcgcccataggaagtgagttctagatgtcttgatatttcagagggcagcatgaatattcgtgtagcgcaggatctggcttttggatgtaaaaccagctagcatgccagcccttattggaggttttgaagggaagagtgaagtacttctggcatagggtgccacgaagctggaagccggatcccccaacgatgcagggcttgttcttattcggttggggtttcagaaaaaagattcggcaaaataaggcgaagtttggccaaatgcccaaaaaaacttcacaaagatggatgaaatttgctatatgaacaatggagtagaggttgaggtgatagatattgatcctataaaattcaaggattcccctaaagaatctggatgttggaagagcaaaaccaccatagaagaaatgggtgaagacgacaatctcgtgagtatcgggggtcggaaaagcctcaccaaatgctggatgccatccgatgttctccttggctggtaacaccccgtgcgccatcatctccttgagggtttcctctatgacgtcagaaggcacccattgactctcaaaattttctctctcttccgccatggatgaaaatggggtggagagatttagagcacgaagattgacagggaaattgggggcaggggttgtgcggaggaattttgccgaaggaagctgatttgaaggaggtggattgcggtacagttgcgaaccctagcttttggcggcgcaagcctgttactgtagcaaaaaatggggaacgcgcggctgttgtggcgaggaagacgatggggtttccttcggtgcgatttttatcgatgggtatcggaaaatgctaatgggcctaggcccaaacagtgttttcagctcaaatacactctcggtgtggctgattgtggtctcttgggacttaggcgtatttttgctcaggcaaaattgcccataataaataaagcccgataccattaaaatcctttttccgcagttagtaaatttcttggaattactacgatgcatacaaaaaggtgcccaacagttaaaaacgccatgttatttttgttgactttttctataaggtcacaaagctattagggtttaatcaggacgagtggtttttaaagctgttgttccttctgagcacttatatgcttcatttttctgatataggctcaagttacaacttaggttggttaaacttgtcggtcagtatttattcagcagttgataaatccttatgagtttttactcggattttttatcacaaatgatgtatttagctctgaaatagacgatagatctttagaatgcttttatcactcggatctttatatatcttctatgtttcatagtgagcttaatgatttaattaaatcagttggcaaactcttcgaatggagtcacatatgtttaatatttaattacttcggtaatattatttataaaaccactcggatggttatttgtttcaaccttcactatatgttcactatatgtttagtcggggtgcatctaatcaatgcacctaattttttattttttagctcttcacagcctttgattcaagcactcgggaggccaaggcggcaataattgaagcactcaggatttttgtttaatggctcgggagaagattatctcgtcgactgcgaaggtctcaggggctactgtggagattatggataccccatacccacacggcatgtatatccgactgggtataggggtaccatgtacatatagaataaatttagtaaaggacccggttgttatgttaacttgtgtatcaaggaaacatccgatagtcctagtcggttatgattgtaatttatctttacatgcctagtacgttaggaacatgggctgtatcttgtaattccggctcctccccctatataaggaggggtccggatgcctctaggggcataacttttctcgttgatcatatgatcaataatacactcggcggatcaatccctggataggagtagggtattaattctcatcaagaaggcctgaacctatataaacctcgtgtctcctaacctatccacttttccagcttgatagccactgtaagttcaagtgccttaatttggttttggtgattaatgacaaatctaattaaatgagactaacggttttatgagcttttctttgactagactcattttgatatgaaaataaaaatgatgagatgtatgtattatactttatatattctaacttggtctctcttgtggatccaaaatatagtgtaagctccctcattaatctcgattgattatgtgcatatgtgttcctttatatccatatatatgcacatcttgagggggagcttattctatattttgtttattataagatttctacctttgatttgaaatcatctttcatcttatctctctatattgtttatatcgggttattatctatcacagaagagagaaaagattgaaagatcttggattaaacaatttgtgtaattgttgctttggtgatagatgataaaccgatatttatgggattaacctctcttttacataagttgtcaactaggttatttcccgataatgagatgtggtagatagaccttaatcatgacaaggatgaaatgcatggagaaaaagcaatatgtatcacttcttatctcctactttttgataggttcatatatatgatttccatgttattgttatataagtgtgagactaatgtttacttgagcattatcttatttagtctcctttactttgagaacatggagatcataaaggtttgtgtttttgtttgtcttgtcattgctatatgcattctccatgtgtataggataaaccccattagttcttctttacttatacatatacacttgcctctcttgtatatgattccgaaaatgattgcgaaggcaaaagtggttctgtatattttcggacttgtccgaaacagatttttggattttccgaaaatcatcagtagagtcaatttcgcttcggtatattttcggacttgtccgaaagttattttcggacttttccgagaacatccagaacgatgttgttggtactggaaattttcggacttgtccaaaaagtttttggaatgtctgaaaaatccttcgttgaccaaactattggtgctgagctggaattttcggacatgtccgaaaatctttcggaatatccgaaaatctcaattattgtgcataacgggcagaatctgggctgtggctataaatagccccctcccctcacttgtgaggtctgctggttccattccaatcatttgtgcccttggcttgctctctctctctctagcacttttgagccttgctttcttgtttcccctctcacccgtgttcgatttggatttggtgtgtgtgtgagagttgtggattcgagtttgtatgagtgcttgttattgacttcgtgaagatttgtgagcacttgcatcatctccgggagttctttgcttcatttgttactcttggaggttgaggactcctaggcggctaggtgttgctcccgagccactgatctacttgtggttggccaggagaagtttgtgaaggtcggatctcacctccgaaagggaagagatacccttagtggaaggaggagtgcttagtgcaacctcttgaggaaaggattagctaagacccggctcttagtgagctcctcaacggagagtagaatccccttaaggattcgaacttcgggaacaacctcgtgagcttcatctttggtgactttacttcctccctctccactagctttgcttgttcgagctgcaataggtctagttgctgtttgtgctagcatattcttgttgtaggcagctagatctaggatttactttgctatttgtgctgactccaaaaatttttggttatatccgaaaatttcggaaatatccgaaaattactgcttccgcttttaattgatttttgaattagcgtattcacccccctctaggcctaattgacactttcaattggtatcagagcctaatctcctaattagacttaaccgcttggagagatcatgtcgggccaagcgggggatgggaacgatggtgataagggagctaagatcccttatgactatccctctacatctacatcttatgtgagtacctatagcggcaaagctccgtacttcaatggtacggactatgccgcttggaagcataagatgaagatgcatttgaagtctattaacccatctatttggagaatagtcaaaaaaggctatgttttgcagaatcccgaagatcccaccaaggaggacgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatctgtgatgttagatggtgagagcccaagcgacatgtacgaccggttgagcaagatcatcaatgagatcaagggacttggctccaaggacatgaccgatgaggttgtggtcaagaagatggttcgagcaatcactccaaggaactctaccttgagcgtccggactacaagactctcacacctcatgatttgctcggatgcatccttgcccttgacatgctcgtgcaagagtccaaggatgtcatccaatacatcaaccaaagctcaaccgcaagcatcaagaaggaagacttagctttgaaggcaaaggaagaagaagaagagaatcgcaagagcaagagcaaggcggagatcgatgatgaagagatggctcccttcgtcaagaagttcggcaagttcatgaggcgaagcggcttcttcaagggaggatcttccaagcactactccaacaagtcaagtggaagacactccgcaagagtgtgctacgtgtgcaaagagcccgggcacttcattgcggattgcccccacctcaaggatggttcccacatcaaggaagataagaagaaggatgagaagaaggagaagcacaagcatagcaagagggaacattatggccaagctcaccttgggatgatcttcggctccgactccgagtcaagctcaagtgatgaagaaggagtcgccacgtttgccgtcaagccctcatcaccaccgagactcttcgactactcaagtgatgaggatgctccggtttgtctcatggcaaaggagcctaaggtaccttctcttcttaagtcatttaatgttgatcttgttagtgatgaggaggatgaggttgaggatgaggttatagatgacgaattgttcaagtccataactaaggaatccctaccacacttgagtgagttgcttgagagaattgaggaccaatatgcaactcttgagaggcaagagactttgctcattcgtgagaaagagcggtctcatgaactcaagagtgagcttgctaaggagagagagaaaaatgaggcattggtacggctttacaagcaaatcaaagagtctcatgctaatcttgaggtggcgaacgctcaactttaagagagagtggatggcttggacaaagcatacctcactcttgaagagaacttcgtaaccttaaagaatagtgtctctctccctagcgagccatcttgttccaaaattgtcccaagcaatgaaccatgtgtgagatgcaatgatattgatattgaagcttgtgctactaactctatttccttgagtgctttgcaaaagaaaaatgagaagcttatgggactccttcacaatggcctacttaagtgccatatgggtagtaaggccctaaaggagtacctaggctatcaaaagggacaacttcaaccatgagggtcttgggtatgtttctccaccaaaaggaaaggtggacaagagtgtgatgatcaagaggccccaaggtcttagcaattttgttaaggccaaaagtatccttcctaatgattatgcttcatattgttcttttgatgtatcttatgttcttaggaagaatgctagtggtcgtgttgttgctaagtatgtaggcccaaggggcaagaatatttctatcaagagagtactttgggtgcctaaggcacttgttactaacatgagaggacccaagcaagtatgggtacctaaaattagaaattgatctcttgtaggaatatgtctccggtggaagaagttgggtaattgatagtggatgcacaaatcacatgaccagagaagaatcaatgttttcaactcttgatccaaatggcacttcacaagataacatagttttcggggacgatggaaagggaaaggttatgggattgggtaagattgcaatttctaatgatctttccattgccaacattctcttggtaaaatctctaaactacaatcttttgtccgtttctcaattatgttctatgggttataattgtctttttaccgatgttgatgtgaccgtctatagaaggaatgattcctcggtagtctttaagggtgtcctcaagggaaagctttaccttgtggatttttcctcaagtaaagccaaacatgagacatgcttagtggctaagtccaacacggggtggctttggcatcagaggctagcccatgttggtatgaggaatcttcacaagcttctaaagcacgatcacatccttggactaacaaatgttcaatttgagaaagatagggtgtgtagcgcatgtcaagccggcaaacaaattggagcacatcaccccgtcaagaatgtgatgaccactacaagaccattggtgcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagtgacaacagcaaggagtttaagaacacgtgcatcgagagtttccttgatgaagaaggcatcaagcacgagttctcggctgcatattcacctcaacaaaatggagtagctgagaggaagaataggactctcaatgagatggcgaggaccatgttggatgagtacaagacatcggacaatttttgggccgaagccgtcaacaccgcatgccataccatcaactgcctttatcttcaccgccttcttaagaagactccctatgagcttcttaccggtaataaaccaaatgtctcttactttcgtgttttcggtagtaagtgttacattcttaataagaaggctagatcctctaagttcgctcctaaagtggatgagggattcttgcttgggtatgggtcaaatgaatgcgcataccgcgttttcaacaaaacctctagtattgttgagattgcgcgtgatgtgacatttgacaaaattaatggctctcaagtatccgagcgaagcaatcaaaagattggctcttggggacgtacgtcctaggaagccccaacaaggagcctcttccttaacacaagtggagccacctacatcaacccaagccgacgatccctctatctcaagcttggatcaaggtgaagaaggcgagcaagtgccaccctcaccgatcaacttagctcgcccaagaatccaccaaagtatccaaagagatcatcctaccgacaacatcttaggagacatcaacaagggagtatccactcgttctcgtattgcaaatttttgtgagcattactcgtttgtgtcttctcttgaacctctaagggtggaagaagctcttaatgatccggattgggtgatagcgatgcaagaggagttgaacaatttcacccggaatgaagtgtggactttggtggagcgacctcggcaaaatgtgattggcacaaagtggatcttctgcaacaagcaagacgaggccggggtcgtaataaggaacaaggcgaggttagtggcgcaagggttcacccaaatcgaaggattagatttcggtcaaacttttgcgccggtggctagacttgagtcgattcgcatattgcttgcttttgctactaacctcaattttaagctatatcaaatggatgtcaaaagcgccttcctcaacgggcctatcaacgagttggtatacgtggagcaaccaccgggcttcgaggatccgaagtatcccaaccacgtgtacaagctccacaaggcactatacgggcttaagcaagcccctagagcttggtatgagtgtcttcgcaattttcttgtgaaaagaggctttaaaatcgggaaagccgattcaaccctttttactaaaagacataataatgatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaattaagcaactcaaggaaggaactttcatttgccaatcaaagtatttgaagaacatgcttaagaagtttgggatggagaacgccaagccaatccacactcccatgccatcaaatggccacctcgacctcaacgagcaaggtaaagacgtcgatcaaaaggtataccgttccatcattggctcacttctttacctttgtgcatctaagcctgatattatacttagtgtgtgcatgtgtgcaagatttcaagtcgctctgaaggagtgtcaccttgtggccgtgaagagaattcttagatatttagtgcacacacctaaccttggtctttggtatcctaagggagcgaggtttgatctcattggttatgccgatgaggattatgccgggtgcaaagtggataagaaaagcacattgggtacttgccaattcttgggtaggtcccttgtttcttggtcttccaagaagcaaaactccgtcgccctatccaccgccgaagcggaatatgtttcggtggggagttgttgtgctcaacttctttgaatgaagcaaaccttgagagactatggcctcaatgtatccaaaatcccactcctatgtgacaatgagagcgccattaagatagccaacaaccctgttcaacactcccgaaccaaacatatcgatattcgccaccatttcttgagagatcattccacaagaggcgacctagacatccaacatgtgagaaccgacaaacaattggcggatatctttaccaagcctctagatgaagctaggttttgtgagttcaggagtgaactaaatattttagattctcggaatgtggcttgatctattgcatgcgtgtttgcttagtagaataggtttgcataccactttgtgacaaaatggtcattcaattcatggatggacactagtcatttttttgtggagattttgaatctatgtgtatggggatctcatttttcaatgaattttggtcctagcacaacttcatagattcacacattccctctctcgagggtgaattatcttgtctcatggtaattccctctcttttgatcccttggatcgtccatttgacttgtggctattgttttgtgtgattgattgtgtgctagtcacaaattcaaatggagcctctagtgctcgaccatcccttccttcctaaatcctataaaaaatccttgtaaaaattgtttttgtcaaaattcccggtgcttgtcccttgcaaaattcctttaaaatgtttgaaaaataatttcatcaaaattcccagcgaaatctcattgcaaaactgtgttttccaggaattttcggacattccgaaaatctctgtcctgtccctctttcaattgctgcaatcccaggatttttcggacttttcgaaaaattttcagacatatccgaaaaacatcagaaccgtgcgcaactcttctgtatcctttcggacatatccgaaaattttcggaaatatccgaaaatctcggggtccttatatatcaccccgtggactcccttctctctcctttccacttcttttccctacgggttgactccctcctccctccccattggacctctccgcattcatacccccgagagggatccggcggtgattcgccaagtgtatgattggcggtgcaagtctgaggttgttgctcctcgtcgggatgagaatccgcgctcccttcgctgcaccgccacggatccgcgtttttggaccctctttcagcaagacttttatgagtctgtgattaagtccaaagctcatcccactgttcccatgcaatagatcaattgggaggagttgcaggcacacaacgatccggtgattgactctatgattgccaattgtgatctcatgggtatccgctccttcatgacgttgcagcaaaattggtgcaacgaggtcattgctcagttttatgccaccgtctactttgatcgttatcgtgccatgcactgcatgactcaggggtcctggtattctgtttcttatcagcagttggctgagatctggggcttccgtcttcgttctttgctcaaccttgatgaccttcataatcttcaaattcctgccaacacagaattgcttcccctttacactccaaatgatccaaatgtggtgttgggcaaggtcgacggcctcaagccgtactttgcctacttgaaccggatgtttcgccggtcttttgtgtctatggatagtgatgctaacagcattaaccacctctctaggaccgtgcttctccgttttgatccccctcctcatcgcttccatgtctatcactttgtgtgggaggagatccgcatggcttcaattcagtacaagaaggggttggtctatgcccttcacattatgcggatgatcgagactgtgactcagctccagtttcgccatgatgtgactcattctcagcttcacttgcgccttcttaaggccccccgctcctcggctgcttgggacataccctcctcttccactctgccgcctcctgctcctgagcgccctgcctctgtggctcgtcgtgagccgtctcccttattccacaatttacggagtctttttggtctttgctccacggaggccaaaaagaaccgccgattgcggaattcggcgaagaaaacggctcgtgatgtcaagttcctcaaggcaaggtattatgaggaccaccacattgatatccctccttctcctccgggtttcgaggccgagcccgatgagccacaggatgaagcgattgaggatccttttgctgggttgccttacgacttcgacttctttggatatggccatggctatggctatcctcctccaccacctccagaggatccttctcaggcgcccttcgcttgagtcgtcatctcatcgtcctctctttttcgtgtcttgatgccaaagggggagactatctatcatggctttagattatctatcttgtccttagagtcgagcacagttggtttttatctgtatgagactattgtgattttttatgttaggtttaaagctttgtaagactattgtttaattatgaatgcttgtgatgtaatagatctttttatcttttaatgtggtgcaatgccttatcctctttatatggtgcttgtgatgagatgtaattattcctttgcatgcgatgtgttggatgtaatgagcatatgtgatatatttgttctcttgtgagcttcaatgtggatgcaataatttagggggagctctccacttgcttttatgcacactcttagggggagcttccactaaaattttgcacaaaaaaaccttaaattatattcattctcttgtgttctaatcgtattgtcatcaatcaccaaaaagggggagattgaaagtgcatctaggcccctaatgattttggtgattaattacaatgtgattagagaggactaacatttttatttaagcaaatgtgaaggttgttatgtcctcaataagttagcgtaatgcatatcccgccgaatacgttgatgtgatgtgatgcggcaaatgagcaaatggtattttgtacgttttcgtttccttgagttaataggaaagccgcactattaagagggatgatgcattgacatacgaggagtgatcaaagtgctcaaaatctattttcaaaaaaagggtttctcctcagtttggtgtgttctggattttttcggagttttccgaaactcattttcggactttccgaaaacacacagaaccagattttcgcttctggaaatttttggatttatccgaaagtgattttcggactttccgaaaatgactgcgaaggcaaaagtggttctgtatattttcggacttgtccgaaactgattatcggatttttctgaaaaatatcagtagagtcaatttcgcttcggtatattttcggacttttccgagaacatctagaacgatgttgttggtactggaaattttcggacttgtccgaatagttttcggaatgtccgaaaaatccttccatgaccaaactgttggtgctgagctagaatttttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctctctagcacttttgagccttgctttcttgtttcccctctcacccgtgttcgatatggatttggtgtgtgtgtgagagttgtggattcgagtttgtgtgagtgcctgttgttgacttcgtgaagatttgtgagcacttgcatcatctccgggagttctttgcttcatttgttactcttggaggttgaggactcctaggcggctaggtgtcgctcccgagccactgatctacttgtggttggccaggagaagtttgtgaaggtcggatctcacctccgaaagggaagagatacccttagtggaaggaggagtgcttagtgcaacctcttgaggaaaggattagctaagacccggctcttagtgagctcctcaacggagagtagaatccccttaaggattcgaacttcgggaacaacctcgtgagcttcatctttggtgactttactttctccctctccactagctttgcttgttcgagccgctataggtctagttgctgtttgtgctagcatattcttgttgtaggcagctagatctaggatttactctgctatttgtgctgactccgaaaattttcggatatatccgaaaattttggaaatatccgaaaattacatcttccgcttttaattgatttttgaattagcctattcaccccccctctaggcctaattgacactttcaaggttccaccgtaatgaggctaatggatgcatgacaccatgtgttgacggtcaccaagccaaggacatcgccatgttgaaaagaatgaagtcaagcttgtgatgagaagaaagtcttgacaaaggatggttaagacctcggcataaatatggttgaatcgaatggtcacaagtgttgatctcggctcaagcttgatcccaagttggatggtgcaaggcaaaggtataatgtagctaagaatgttttcttagtcttttcctggtcttggtgtttggcgtagaccggatttgctagataggcgccgtactatcaagaggggtctatgaagcgagcatgtggatgatcttgcaccatattagttcatatgcatgtaggtgtatttggtgggcttgtctagccaagtgtggtgagttttctcaagtcccaaacaaagagagaagtgagcacatcctataggtttgggtagcctcatatggttttgtctggtggagtatcttttggagtgtgagccctttttccctaagcaaagttgtgtttcttggatggattgttcatgggttggatagccctttgaataagctttccatagagtccaagaacgtcaaattccgagactcaagtcaagagatatcaccgttttactaatggccgattgagctgaaaagtgccctgtggtctgaccgcagcccttatggaggtctgaccgaagtatgtcgtccggtctgaccgcagatcacatggcggtttgaccgcacatcctgattttgaaggaggtctcgtcttggcaatccagagccactagagccgcagccggtcaaaccgagcccctggcaatctgaccgagctgtggacggtctgaccggccactacactgcgatcagaccggccaggttgactgggctcaatgattgccatgtaatggctagttttctagccgttaagtagtccggtcttaccggccacactatggcgttctgaccgacagagcacagagttggggattttgactccaacggctagtttttgtggttgggggtatatatacccactccccaacagcaagggtaaggttttggcactccattgcattatcttgaacccttgcaagagctctcacacccttgtgcacttagtttatctagtgaggtgttggagagtgagttaagccaatccaagtgcattgattcattgttagagctagtgtggtacttgatcatcctcggcaagcatcctagacttgttactcttggaggttgccgcctcctagacggctttgtggaggtgttgccggtgacctctccgaagagattgtggagaagacccggcgccggttgagagtggtttggagttaaccaccttcggagagaagtaagaactatccctagtgatcgaggcttgtgtaatcctctctgtgggccggcccccaccttgcccaccccttgacgaagggggcgtgcggtggcttcgtggttgagcggtggagttggcctcgcctcaacagagattaggaaaccggcgagtttccgaacctcggtgaaaaattccttgtctcttgtctcatttatttgttgcatttacatttgagcaagtttacatactaagcttatttgtgctattatcaccctaagcttgcaaaccttaacataggctagcttttttgtgcacttacttgagactagttgatttaggttttgaattgtgcaaaaccattttgatttacgcttccgcatacaaaattcggttttagccaaaagttttaaaaccgcctattcaccccccccccctctagtcggcctccttgatcctacagccaccccttttagttttgccgaaatattgtttcaacaagaactacgaggaagccgagataatgtttcgacaagaactacgaggaagttaagtttccaacaggtccacatctgataataaagagactctcaaggtttgctacctcaacttcttatctcttgaaggttattgatactgaagtgctagctgatagaatgttctatatccaaacacttgctaataccattgtggcttcggttcttttggaggctatcctagctaagctcagctcatttgcaatggacatgaccctatatttttcttgcatgttcatctaccaaagtagttggcagcatggtctcttcatctcttcaaacaagtgcaaatcaggtgaacaagaaatctattttgcttcccttcaatatcccaattattttcttctatcatggataatttgtattcttccacctctagggtaccagccaaaaccagctaaataaaactagtgtatatatataatatgtattcatccttcttgaaagaaaatcacataaatatcatgcatgtactattgtgatgtgttttttccatgccactacggcgcagcagaggctatgtgtgttcagatgatgagtagagctgtcacttggaataaaactgacaaatcaattactacatttcaacaaaaaatctggaggcatattgaggtttggtaaatttctagtgacatatatataaggaattttcctatagcatactatagttctcctgttcagttatgggcctgatgcacttcacatcagggattccaattttgttttggaaaaaaaataatcagaactgaaaaaaattaatgaccatatataattgtttgaactcgatttatgaacgtaaaattgtgataaaaaaattcgaagcctaggtaccttggtttacacagataataatatctttcgagtttcacaccaaagagatgttgaaaccacaatagcttacattttcttctctctctctccatgaacttggcgtgcttaggctcgaatgagtcatttataacaatgattcatgtcatactccatccgttcacaaacataagagattctatattgtttagcaaagttaagattgaggttcaaattactttgatgtctgtcacgcccagaaatttagcccaaaatttcatactattttgtgtattaaatccttgttcaggaattagccagggtacacaaaacgacaaattaatatacaagtacaaacgtaaataaagcgtaaaatacttacagaagaggcacttagttctcacaccaaaaccgaagcagcagcaacggaaaaaggcgatcatagcgaggcttcagctccactccacaggcaaaactcaactggggtctgagccttggtcctctaacttcgtcttcagctcagaagcactacacttctgaaaagggggaataatagcaaggttgagtacaaccaccgtactcaccaagccacaccaatgatgcactcatgcaacgggagacaaagagaggtttgtggctatttgcataaaggtagttgcaaaacattttattgagcaaaatagtaaaactgttgattaattaaggtagtactaaatcttcactgatcaacgctacaccacgttgatcaggcctaaccatcccacctgaactaaaccagttcattaagccaatttattaagggtgagactaatcacggtgaatctggtcgatcgcccattaccacgggcacggttatttgaatagttttactctggccagaggtgcacaactgtacccacaagacacaatccaccggcatgtcaccgtgcccggctggacacgtcaccatgtcgagtgattgtggcaagacccttcatataactccctctgaccaatcgatgccacacctcaggtttcacccctcccccagcaggcagcaggcagtcccccctcgtgccacggtgaatccggaagcagcataggccgtcgcagggcccatccatactcgatcacacccaccctagcctgggtacgtcagccaaaggaaagctatactacaagtcaagcaattacccattcctgcttgtggtacgcgcggtaagtcttccagtgcatccagcgaaccagtccttaatttgctatgggcgcaactagaaaaaccatgcacccacaaaccaccattaagtcatgttttagttggataattacaaccaatgaaacatggctagatgtctcgagcacgcagctcgtcaagatatatactaggtgtctaatgatgtaattatcccattatgtgaactagtggtaattaagtatggataagcatataattctagctaggtcaacataagtaacacaaaatagtcgaattatcacctaagtttgacaaaggacgaacatcaagtaatatggcacaagcgaagaagtagataaaaccctgatcccatgtaattagcatgacatgcaattttatttgcaaacgataaaacatttataaattaggatcaacatgctcaaggggaatgtgtgacttgccctgcttcttcaaaagaatcctctgaactctttcctcgtaatcgcgagcttccgaaacagcggaatctacgcgctggcacgcaaaacaaggaaaaactctaataaaaaccaagtaaacagtatatgaaaagtaaacaaacatgtagagctcaagtttagatgaattttgcaagttgaatggcccaatttggagttcttatgaattagctatgaattttagaagttttgagccatttaaatgaatttctataattattactcgaaatattgcgcaattaaagctatttatggtgtcaaccgaggggattaggtggagccgacaagcaggccccacctgtcggtgactcaaggagccttggcctaccgtggaccgagtccacggaggcacgggctagtgcaccacgtggcgcactcgtggcgccgatggggcaccgacgtgctggccacctatgcggacacacgggcggctcagatggaggccggggccgatccgacggcccagatcggccgcgcgacaggggtggcggcaactggctgcccggcgaggacgcggcgcgcggcggcagcgacccgaccggacggccactagcggcagcggcgcgtcgcgagctggcccaggatgcgaccgacgaagcggagaaagagggagagggaggggagcgctcatcggggaacgacactgtagggaggcggccggcgaagctcgaggcggaggggggcggcggagctccagtgacgagcgacgctcaggaaggggtgtacgagctcggtcgcgacctggggatggggtttaaaggggttagggaagcgcggggtggccggaacagcgaggaaggatggccgaaggcgatgagggtggcggagctcaccggcgagcgagggagatggagctccggcgaggttttcgacggtgtgggcgggtgcccgtggtacggcacagtgcaacgacgctggggtgaccatcgtggctcgggatggcgggtaacagtgggaaaacggcgaccggaggcggtgaatgtggcggctgcctcgggtgtgtggtgggaaggtcgttccggcggcgttttggggaaagggaggggacgccaagatgtagcttggcacggtggtggcggtgcagtgcggcggtgacccaagcggtggtggtgggcggctgaacgacactggtgagcggctgaggttggtggcgcggtggggcggcttttcgatggtggtgggggaaaacggagtggcggcctggcttgcccttgcggcggcgaagctggcgatgacggcggagtagagcggtgaagactagagtggtggtggcgcgcggccaaagctcaccggagggtggcggaaatggcggacggcgtgggcagcacgggaggggttgaagggagctcgggcaaatggggaaaaagggagagggaggtgcgggcatcctttttgtgggctcgggtcaatgggatcgtggccgattaggggcggcaacctgcgaggaagtggcatggcgacatggggaggatggtggctggatttggtgggaaggagtggggaaaatgggcgcaggacggacgcgaggtggaggagaggggtggcatctgggcccacgcgagagagaagcgcggggaggcatgaaaaaggtggcagcgtgggactgtttcggcagccatggagccggcccgaggagaaagaggaagatgacacgtggggcctcgggtcccacctgtcggggagagagaggggaaattggcaaggggaggttaaatagacttcatgggcaagcggaccgagggagagaggccggcccaagagaaaggagggaaggagggaggggaaaatgggccaaggagagagagggagagctttggaatagaaggggtcgaaagtgaaggagggggaaataatttgttttccatttaatttaaatgggtttaatgaactttatgctatttaaattatttcttgagctcggaaaattcgcaggaaaagttcagagagtattttagggcacagagaatattacaaaattatttgtagccatgatttttaaaggaaattttaattccctccttatttcacttgattaaattgctttaatttttaatataatttctagaaatgatttatttaatgatttttaatctcgaacgaaaattggggcgctacaatgtctgtgtgtgtttgaattaggaaagatcacgcctatcaatgagaataaatgtagaggttggatggattgggaaagtagtgctgtaaaatctcctatattcgtgaataaatttaaaccccaaatcccttatttttgtagagagagaaataagtatacgctgttaacgaccaaatttggtaaattctatcactattggcatcggaggtgaagatcagattgaagtgggatccaaaatgaagatcattgcggaaatagagtaagagtcggctgcagtccaaatcggctaaggtcaggtcggcagagttcgagtcggatggggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgtatcgccaccctttttgctttacttttatttcgacgagttcgtactctcgggttgagctgcatcggtttcgatcttcaacaagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattgttcttcttttcatacttaatgctgcatcaattgagtttgatctattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcacatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgatttaagtatatatcgatataaggattatatatcattaatatctacagccgattgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaatcaactagcacgctcatacatccgaacgcgagttttggacctgcactggagttaagcagatctcccaggcctcgtgttttctgtcaacacgcttttggcacgcccggtgggacgaattagaagtcagaaatcaatcttcctcatggccgagaagctgccaccttcgccatcctcggctagcccgggtactgttaaagagaaaatccaaagaccaggattgagcgaagtcaatgaagggaatattgtggctattgatccggaaaagctcacacctgaccagaagaaggacttcgaagcaatgatgcaacaagcacgagaacagttcttcaaatcattcacacagactcgcaagggaaaatttgtttaaaagtacaaggtaaaggtggttcccgatgagcctgagaccagtacctttaaggagggagaagggaaaagagttttagatggctcggctcaagagaatcagggtgacgactctcagggggcacatgcagttcaaggtgatggtgctcacgagccacaacgaggaaatcttaatcagaatggtgagacagcacaagatttcttcaacaatttccaagatcgagtggactacgccgtacacaatgctttgatcaatcaatctggagtgttagtcaacaccttgtctaacatgatgaagacgatagccgatggatcaatagttgagcatcaagctgcaggcccggtttacttgccgggaggtgtttttccgaattatcgatctttgatcactgatgttcagccgcttgctcaggcagttcttccgagtgcaccatcggctcagccgatggcaccgccattgacttctttgcctgctccatcagcgtcgacaccaggccagccgattaatcctcggctattgatgagggagcagccacagcatagcggacagacggtaaatcggccagcacaggatcaggtggctgctatgtttctacccctccaatctactgtcaattcgattcagcagacgccaccaaggcaacaggttgtgcagccgattcaacagactccaccaaggcagcaggttgtgtagccagttcagccaacacttccgggacaacaaactatacagccgattccgcagcaagctttgatgaatcaatcggctgagcaatcagctggacacgccctgaatcaggttgttccagaacatttggttcaccatatacaaccagatggtacgacgatgcctcagattgtgccagagcacttggtgcaaagtattcagccaaattaacagaatttattcagccaaattaacagaattaccaatgaggcaatataatcagtttgaaccaatacagcaacagtcgcaaggagcaggtcaacaacgaccatgggctgatgtaattgccgatgtgatgagagaacaatttgggcttaagccgaaagatactggaaaattgtatcggcaaccttaccctaaatggtttgagaaagttcctcttcccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaggaaagcaaagccaaggaaggagtggcgtgttaagaatcaagttcttggagccgatgatattgcagccgatgaagcaaagaggttggcaaaagggaaaagtattgtaacggcgccaattaacatggtctttactttgccagccgaattcgggattgaccaagccgatgttgacgaactggaagaggaattggctaagttggttctatcaccagaacgagcagtttttgaaaagcctgaagggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatcaagacaaacatggtgcttaaagactttggtggcaaccaatcggaaacaaagggtgttctgaatgtagaattgacagtcggcagtaaaactatccctaccacattttttgtcatcgatgggaaaggttcttacagcttgttgcttggaagggattggattcatgccaattgttgtattccttcgaccatgcaccaatgcttgattcaatggcaaggcgacaaggttgagattgtaccagccgacaggtcagttaatgttgctagtgccgatctagctctttgggagatggatggccttgattgtttatccaggaagatttgggttggagattttctaaaagtgtccgattctgatatacagccgattgaagatgaagaacccaagctattattttgagggcgtcgtggagggttcaagcgtctacgccaaggacacggtagatgatctcgatgacaagcaaggttagggttttatgtcggccgatgatttagaagaagtggatataggtctgggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaagccagggattagaccacaccagcagcctccgagaagatgcaaagccgatatgcttgaacctgtcaaggctgaaatcaaacgtttgtatgatgctggttttattcgtccttaccgatatgctgaatgggtttctggtatagttcctgttatcaagaaaaatggtaaggtgagggtttgcattgatttcagggatttgaataaagctaccccaaaggatgaatatccgatgccagtggccgatcagttggttgatgctgcttcaggacataagatactaagttttatggatgggaacgcaggatataatcaaatctttatggccgaagaagatatccataagacagccttcaggtgtcctggtgcgatcggcttgtttgaatgggttgtaatgactttcggcttaaagagcgctggagctacgtactagagggctatgaattatatatatcatgatctgatcggatggttggttgaggtctacattgatgatgtggttgttaaatctagagaaatagaggaccacatagccgatttgagaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttggccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagttgattctggggatgctatacagttcgttcaagagcatataatctatcaatttggtatccctcaaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatggtcatgaggctgttctgccatgggaagttcgaatcggctcgaggagaacagagttgcaaaatactttaacagccgatgagtattataaccttatggccgatgaaagggaagatctggttcaatcacggctatgagctcttgcaaaggttactagggataaggagcgtgttgtccggcattataataagagagtagtacccaaggacttttcggagggtgaacttgtatggaagttgattctgccgattgggactcgggatagcaaatttggcaagtggtcgccaaattgggaaggaccgttccaaatttataaggtggtatctaagggagcatacatgttgcaaggactcgatggagaagtttatggccgagctctaaatagcaaatacttgaagaaatattatcccagtgtttgggttaatgcatgatcgactagtgttgccgatacatgatagccgatgtgtttgcatcgcctggagatggccgatattgttatatcgcccttagttgcttttcactattgtaatcggttgtggtttgccgatctacaaatggccgatattgttatatcgcccttagtcgtttctataattttgtcaatgttttcaacattgtaaaattaggggggcacatacatagagaattgcaaagaaaaatgagagaattgaaatttttgaacaagccggcacaaggatggcagcaaagtaattagggtgtcttagccgattacaacagttttctacaaactattacatggaaatcactgagacaagtatcgctggatagccgatatagccctttgcctaatttgatctatttcttcgatagcttgggcgtcttgagcatcggttccaggaatgactttcaaggatttagtcatctcagcaatgttcttgatagctgattttagccttgccttctgttcttcgacagcttgcatgagatcggttaacttcttgtgctctagatccagtttagcattgcattcttgaagttgtgccaagagttcaatcttgtgagcttcaagccgatcaacattagatttgatcgggccttcagataactgatcaagcttggctttctcttcatgaacacgctgccgattggtttggattgtagcctcgatgtccttgcgctcccggcgatcggataacctctgcctggctttctccagtttgaattgatgctgctcgaggtagacagctggagtaagagcatcggctaattcgtccgaaagaaaggcttggatatctgcaaatcttgcccggattgagccacagttggtcaccaggttatctagtgatgctcctaaccgatgggagatgtcttcgagtgttttcttcatatcatcagacaggagagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccgataactttgctcctgcatcggctggtgtagatgcatattctccgtatgacatacatctgcgatgggtgtgttcttctccatcatcttccacaatcggctccaaacttggaaattcagcttctgtcacagatggccgattgacaactttcatgactaccaggttcagctaggattgcaagagccaccatggtccacctgttccaaccactgagccgataattatcttggccgatgcgttgtttaatatctggtatagatagccgagaaggattttgcctaagggaaattgtttcttcgttactagggcctcggctaagaattgccagttggttgtaggaccgcagcttgatccgcagaaaaggaatttttccaaccacatcagcaaaaaagctacgtgctctctaggagtgactggccctttgcccatatatgctgtgatatatcctgaccaacccccaatgctcttagttttgaactcaaaagtgttcttggtgttcaggttcatagggttagctgatgaggttacatctaggccagtgagcatgataatatccagcagcgttggggtcatcggcccttggttgaaaagaaaagcattgagagtgttggaccagaaataagttgcagcagccattaggggttcatctttggccgaatttgctattgtgagggctagggcttggctgattccgatctcatcccaatgggcttgtttgctagccgatatccgcttataccatacaggccagcttttctccaaagaaggccaggatttgaaggtgtttttccaatggcttgtgtttggattggccgacctaaaaggggttctgttggtttcggctatgataaactcagtggggtctagattgccgattggaccgagaaagtattgttggtcatgaaacagactgggaaccgcaacaagattggaaagatgctacaagaatagagaagaagaaaacaagataaggtgagcgaaaaccggtctgatgaacggaaaagggggtctagccgatggggacttacctcagcgtattcggctgatgatgcggcggtcggattggtggaggtcgacatcgtcacgggtgaagatctggccgggagtggaatcgcctagaaatcgccatgcgtgttgaggaggtcgccggagagagaaaggacgggatctgtttaagcggtgaaaacggaaatcacgacgtgaagattctttggggcaacggttagtatttaaagtagagcgataacggacaggaaaacagcaagtgcgagtttctctcagagtcggtatatggcaaatccgaaacattatccaatattccggacttggggggcatgtgttaacgaccaaatttggtaaattctatcactattggcatcggaggtgaagatcagattgaagtgggatccaaaatgaagatcgttgcggaaacagagtaagagtcggctgcagtccaaatcggctaaggtcaagtcggaagagttcgagtcggacgaggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagagatatgtttgggcaaaagtctgccgtaaagacttatggtatcttagagtttgttagagataatagtcatgtccgttgtggacgtatcttgtaattctcgggtataaatagacccgagccctatgtaaaaaagggacgacatccaatacaatctcggcgcatcgccaccctttttgctttacttttatttcgatgagttcgtactctcgggttgagctgcatcggtttcgatcttcaataagaggtaaaacttgtcatgacgacttatgttctcaggattagtgcttccatctttattatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattatttttcttttcatacttaatgctgcatcagttgagtttgatatattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcgcatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgattcaagtatatatcgatataaggattatatatcattaatatctacagccgatcgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaattaactggtacgctcatacatccgaaggcgagttttggacctgcactggagttaagcagatctcccaggcctcgtgttttctgtcaacatacgcatactcagtaaaacataatcgttccaacgctgtctatgactgtccacagattgttatggtatgttttttaagattcaagccatcgtcatcattcttcaagaatgatagctagatcacaaaagagtaggatatgatatggcacattaaccacaaattgaatactaccttgaggggatcgatcgtttgctctaatttgtatagtatatggagttaaataactggtttcgaaatacaaggtaaaatggtcttaatttttttttccttatgaatcatatttttagaatcgctaccttgagggaatcgatcgtttgctataatttgtatagtatatggagttaaataactggttttgaaatacaaggtaaaatggtcttaattttttccttatgaatcatatttttagaatcgtagagcatataatacgtggaaataattcagtaaataagcagaaaagaacggggctaataatcaaattaagaatcactccagcgcaatcatattttccaaacctatgccccttccattgattagtttcatcaactgaaagtttgatgcagtacttgtggggcagaacatgcagaccaatcaacatatatcaacaggtaaaattatacagttgaatattatgaggttataatttctcagccaaagcttcattctcaaatgaatatatcaaatctggttactcacactataaggaatttgattttttatgactgcaaaacatatttatgagtagacagtcatacatcattaaagagtggctaatctactgcgttcatcaaccaaattaaatcttgtatcaaattgatatgtaatttgtgttcatcaaccaaattaaatcttgtgtcaaattgatatataatttagcacatgttttacatgttattatttctcaatcgaatcattctttgtcttcctatctttaaccatcatctctagttttccttctcaaatcaacaggctcaaataaaaaatttgtgcctcattcaatatatatagtatacattcatctataacattgatttctctgtcttcctatctttaaccatcatctctagttttccttctcaaataaacaggctcaaataaaaaatttgtgcctcattcaatatatagtatacattcatctataacattgatttgtaagccacatgactattgataagaaacagatttaacagtttagtaagcaaccctcttgtttttctccaatattttatcacatttaataatgatcttttgcggtataactaacccatattatttcaatcatgcctaaaactagcactcctatatatcactggtacgacataaacacatcatgtgtgcaaagttagctgtatgatgccactatatactatcactgtcatttaattgctatggcatcatgtttatgttccttgcccacttatttgcttcataaatcacatacgcatgaacgctagctactcccgcatgaatcattagctagcttactttattgaaatgcagaacgatcatgcatgtaacatgtttcaatttttatgttttttttagcgcgccaattgatctctacccttctctgccctttttgttttttctaaaggtatcccaccctcgtactatctttggttgattggatggaccgacgagatgaatggagaactatccagttcatgctttcttgacatcctactgtttggatgcataaacgggattatatgtgtttggagacagcaagatattacctccgttatcacatagatgacattatagaatgcgtctagtcaaaccttgatatattaaattaagcatacataagtattagaatttaatacacaaaaatggtattgatagatttatcatgaaaaaaatattcacatggttatatgttcgttatttttataaatatactgttataaaaaaataatggcaaaacacatgcatttgagacggtgtcaatgtccaaaatgctcaattaaaaagaacagatgcatatatgtttcactaatattctcataactccaaagatgtgtatagttccgttccatataaataatatggttttggagcgtggttctttggcaagtaacaatatatgctggagacgcaatatatgtgaagatatattatttaattgacaaaacaaaacaatgaatgagatgcacctacacaaggttggcccaatccggtagaaatggaaacaaaaccaatagaaacaaataaaaacaagataataaaaaagagaaaataaaatatgaacaagaagataaggacatgcaatgaaatattatcgaggaagattatgatttacttacgtaccaacatctctatgaaaattagaaataacataaattttacccaaccattctgggtcatcttttacaatattatcaaccaaataaattgatcaatcgaaccgtagatttgatcaaacaatcaataagtgtagttattctatcctaacccccatccaacacattgtcctattccattcaacaacatccctccaacaaaacatagaatataatacatcaaatgaaatacaccttagtcataacaaatgagataaacatagaatataatccatcaaatgaaatacaccttagtcataacaaatgagatgtgtttttttacacatatcatagtatacgtgtatactcaattacattgtccattaaattttattcaatcagaacccaaccaatattgaggataaatagaattggacataatatgctcacaatttgtaggttatgcggacaatgaagataatatttgtttgagtatatcatcctccgatgaaattacaattatgagacataaaaagttacaacttatagtactatttaatatttaaaacctaaagcccactacttaaaacactaaaaatgatataattgggtcggtttaaataataaaaaaatcacaccaatcatttaaatactatatataattttcctccctgtacagagagatttcttcttaatgaaaaatgtagatatattatttctcccccatacagagcgattgcttcttaatgaaaatatggagtgatcgaatgtttttttataaaactgtcatatgaaccatatcagaaaattctatcataactatcccactcgcaggtttgttaaaccataacaaaattgacatgaatatctgttcaatctatcttcacatattttcttcaaaatctggtgggtaagaaacccctcttgctttcctccaatattccatcatgaattaatgtttctttttcagtggataaatatgtattctcatcaatactatctaatacgagccaaagctaataacctagccaaagcatgtattcatcactgatatttatatatggcaatgtattcatcactcgctggaagaaaatccaatagatcatgcgtgcagtgtttgcatgcaactgtatgttcttcatgtcacttaattacttgctgtacatgacacactattcatgtttctttactgttaatctcttccatgtagtttaagaaggttttgcatgcaactagtcgcacgttcgcgcgactataaccttcctatctattagctgctattacaattaacaataaattttccaccattcagctaaatcaataattaatgtatagactcagggtttatattcatcttattcgtgttgtttcctgctttacttgatttaatattcgaaaaaagtatttggtcggaagtgcatgttcaatacaaatactatgttgttttgatatgtaataaatacatattgtaatgaaaataaacaatttactataattacgctaaacttgtgatattattgtaagaatcaaaattaaatttcactactacctcggattccaaatatcctgggtctacatttaagtaaaattgcacatcataattgtaactatgttataagatttgtttgagatgttaactttttttttctatatctttgttttgattgttgctgactgatttaaagtgttatatgtagaataatttttccctcttatgaaattatttaattggttatctagtctaaggaccgtttgggttgattggccaggctaagccagccctaggcctatttgggaggccaacatgagataaccaataagaggtaatgagtggctcaaactcttccttctctctatattttactacttctagaagattcctcatttcaatggctaggattcttccttgctattttgtcattttgtgaatccaactgctattttttgacaaatcatgtggctaattctggttgctttttgagttttacttttcaattaggtagatgtctatgcattgcaatgcaatggaatttagagtagggataagtctatttaacacccttcaactttttgctttgttaaaaacacaccctcgaactataaaattggtttctaacacactcaaactatcaaaaccagacatttacatcctttagaggttttaggatggttttggtatagctggacatcactttggatgccacattttaaaaagatccacatcagcaaagggaagtgtcccattagtcagttccattccacccctcttcttcttccttcccctctaactcgctctcccctctcttcgtggagcagttaaagttgacagcgagctccatccgtggagagacccccaccctctcggcttggagctccacgctatttcgccgccgttggcagtaacactgctcaacaagctcgagttggaggtgaagatggcgcgggcgacgacaaactcttggtggtggaggccctgcggcatcgactcctccgtcgagttcatcttgggatcaaggccgtgctgccggcacccgtctctttaacctcggcaaggagggggagggggtgggggtgctgggtctagggtggtagtggcgcttggataggaagccatctacgagctccctgagcttgacgaggagagtgccgacggcggtagtggtggagcttgggtaggaggggacggcaaaggcttcatggaggagagaattgaagaaccacaccttggtctcgtactctcgtcgacatcggggaggagagatacctccaaatttcaactagccgtagccagatcaagatacagttgggtcgatccgcatccatcaaccctcaccagagcttgccaataaccccgtcttctatgtgcttggcgaaccctcttcttcgagcttgctaacagccccttcaccaatcacggccaagggagcaggctccgcgtcaagcttgtcaccaacctccctcttcccttgagcatggccaagggggtgggcaccgcatcaatctcactgtcaacctcgtcatggccaccgccaacctccctcttctctcgagcatggcgagatctctatggccgactcaagctcggtgagggagggagtcaaaagagtgagccatggcggcctcaagctcggtgaggggtgagcgagtcgaaagagagagggaggaggaagaaaccactctaactagtagggccagctgatatggcaataccaaaaatgccacataaaatcacaactttcacggagaaaggagaacaactgtattttaaagtagtagagaagtgcatatctcaaagaccaaatatgccacataataatacagctttcgcaatacacatttgctttattaaccactaatgcatgaaagccaacttgagcatgaatcgtttagcttagtttgctggagcctggagacgcaaaatatgatcatgcaaacgttcagaattttatatactgtttgaaggtatgcagttcgtctccacccttgccttctccccttgataatcaaaattccccatttcccctatgaagcacatcttgaccttctccccttgaatcatcaaaatgagatgcagtttccgggctacttttcagagtttacttaattatatgctcaattacattgtgttcatatgtgatgaattagtcgttctgtagagacaaatgggaaggcggggtgagctgcaaaagagcggatgagaaacgctttgcatttttctttcatattccatttgtcatccacactgtctatgtaccctcaaagagaatatatatgcactgtattagctacctacaagctatatcatccacaagtgtcaacctcattcttgaagcaccaaaacaacgcttcagtagatcttaacaaagtacaaactcattatctacctggaggctggagggaatctcccttgtgccactgggaatatgcccttgaattttgtttctcccatttatggtactatttccaaatcttatgccaaaacatgctgtggacattggccatgctgtactgaggaacgcaatgatgatttatgcccccatcctgtattagacaaacttaacgacatactctgttcttcactcatgatggtggtagctcatctgaaatcattagagacaagaagtcaagaacataaaaagaacaatttatgctatgggccaaacggagacatgagacacaagtactgtgtatttagaaaaagggtaattaccatattataaaaagggtaatttcctcgaaaatacgataaccaaggaaacggttggtaaaacaacaaaatcatttccatttctgtttctatttttagagtaaagtccatcaccggtccctaaacttgtaccgctgtgtcatcccggtccttaaactcgcaaatcgaccgttcaggtcctcaaacttattcgactatgtcatcctggtccctaaacttgcagatcactcgtttaggtcctccaacttgctcagttatgtcacctcggtccctaaacaggacggtctaaaaactttatatcaaaaaataattcataactttttcatgtgaactctaatgaagacaaactttatatcaaaattgtagccctcgacgtgacctacaactttttagttgaaaagtttttgaattaaaaccatttagggtctcaaaatattgttgcatgtttatagattttgaaattttaatttcacaattacattttgggacaaaaaatgacttaaaataaaaaaaaatcaactacaaagttgtagatcacgtcgagggctacaagtttgatataaagtttgtcttcattagaattcacatgaaaaatttatgaattatttttaaatataaagtctttagaccgtcctatttgatccagatgatattcaaatccaagtttagggaccggggtgacacaactgaacaagttggagaacctaaatgagtgatctgcaagtttaggaaccgagatgacacagtcgaacaagtttgaggatttgaacggtcgatttgcgagtttaaggaccgggatgacacagcggtacaagtttagggaccggtgatggattttactctttttttttaccatttccatttttgtgtctgtcagtaaccatttccatttctatcagtaacaaatcatgaacgattaccgttcggtcggtaacaaatcatgaactatagccagtcggtcaggaattaccaggggcactgtttttcacaacttcacccgtaactgaccacggagtggaaacagcgccaggacaccttgtgcatgctcactcctgttatgcactcgtgacagcaatgaggaggcaccaagcccatagtataggcttgtggaccagaactgcaacagccacactgggatgtacgcagtggaggtgaggctgcacaggcattacccaacctacatggaggtggcaagaaatgcaaagttttcccagaatgatgcatatcaattatcaaagcagtggctcgaccaccccagatgagcatatcagaggtgcggttacgcactcgttgcccatcctatgttgaggtggcaagaaatgcaaacttttgccagattgatggatatcaaaccttaaccagcgacacgatcacccagatgagcattagaggtggagagatgcaatcctcatactgccctgttctaggtgcttccctttggatgtgtgaatgccaccttgccatcctttataagaaatgggatgtgtcaattacggatgtagagtttccttctttctttgggtttatgtgtaatcagatggagagtagaggtgccacttggaataaaaatgacaagtagtacgtttgggccaaactgtgttaccgcccgatgcatattccggcataggttcacaaaggagtgccatatatgggagaagcaaaaatctggtggcatccttttcctttgggttctagttcgggaaccgccagttttctcaaaacatggatttggtttcaggatctggaaatttctagtgacacgtaaggaattttccaacaatttcagttatgggcctaatggacttcaaaccagggattcccagtttcattttggaaatagattctgggcgataaccagaaatttcagaaaaaataacacctagaattgtttgaactttgatttaagaatagaaaagcgaaaaagaaagaaaaagaagaaggcaaagagagaaaaacagaacagttctcataccataaatttctttttgtcagcacatatgtgttaccactgaaggaggcaggcgtttctgtgttggaagacctgtgtttaaagccgaggtatttcctgcttaacatcagagagatgtaaacatcgagagctcacgtttgcttgtctctcaatgaacctggtgtgattaagctcaaatgagtcatccataacaatgattcatgtaggtcccatcggttgcccatattccctaataagccaaaacggcttattagagaataaaaactaacttataggtaaaacttttatatatgtgttcttaacaacttaaaagccaatactaaaaaagaactacgttgaaaatattttaaaatcaacttcaaaattaagtttgaaaattcaaattttggctttggcttattagggcaaccgatggggctcgtaatatatgcaagctcatcaaaacagaaacaaaataagagataccaaaatattccctccatttcatattataagtcgtttgactttttttcttaatcaaagttccttaagtttgatcaagtttatagaaaaatatcctaacattttcaatacaaaacaaacatattatcaaaatatattcaatgttaaatttaatgaaactaatttggtgttataaatgttgctaatcttttctataaacttggtcaaacttaagaaactttgactaaggaaaaagtcaaacgacttataatatgaaacggagggattatattattgcatgataaattcatagtcttcttgaaatgataattagagtaggacgtatcatacttattttttcttgcatagtagcagcaaaatccatgccattttctctccagatatagggaaggacattttgaaacatatatagtgttggatgaactccagagtcctccatccactgcaaaacctacaggcacaaaaaataaagctcaaataaatatcaggttttgacctattactcttgaatctagcttgttgcaagcggtattctgagatgatcagatgatgtaaaaatgagaaggggccttgttacctcaatatactttctccatttcccaacaactaggagatttctaagaacaaccgcataagtagaaagacccacagtagaacatgaagtcaccatcttgtaaaacagctgcataagagaatcaaataattaatgtagggaaacagaactgtaaatgcagatcattatttctcttacaagtgtagtggcatgtttgtgattccatggcttcctcaagtatcaatgtgtattgatgtgagaaggtgatgaactgatgatttaaaactagtcaagataaaattgttcttattgctaaatccatttttattttggacaaggagcagcaggaaaatataggtggtacatggaagtatggaattactggtagtacattgatacttgaaccttcagacattcaagaaaaacaattcactgccaaataagtaagagtagatgaaatcataaaatatttgtcaactcctctgaaaaggagaatcctataaatctatttgattatgctgaggacaaacatattaaatgattatatgtttgggagaaatatattgtattgtgtcagtgtggcaaggccgttagttccatatctaaccaaatatggacttcacttttatagaaatgaacagatcgatagtttttttcccccctgaacatgtaggagaactgcatccctttgcattaaaaagaaagatatccactaaaactaaaaaccataccacaccaaaaacagagtaatgaagcatgtatatccattgcactgcagaagttggatatctttctttgggtcttagaaagatatccactaaaattactggaatgacaactatgttcttagaaagatatccactaaaactataaactaccacaccaaaaacagagtaatgaagcatgttctgaaatgacaactatgttctgaaggccaactataccttcatcatgttctctgtcttcccacattttccaagaaaatttaaaacatggtttagtgttccaacagaaatggatgagagcgaagaatccaaatattcaatcatctcacttgctgttttccagtcacgtatcctgttatgaggaagcagaacaaaatagaatattgagttattcaatgcatcgcacg

SEQ ID NO: 58639 - DNA, 96071 bp, Oryza sativa
  unsure (1)..(96071): unsure at all n locations
cagtgacccgagtactatattagcaagctgatcacataactgctacatgcatgatgatactacatacatgcactgattaacacatactagtaacctttgagataatttatttttatttatttgattgtcattttgattatatggttgtattcgttataattaaatctttacaacaagatctcagaaggttatattttgattgaaaaattatatatgttttaatcgttaagatttaatgtttcacgtgttagaaataaatgttccatctagaatttgattatgttgcacattttaagttttttatctgatagatgttgttttactgttgcacacgggatcaataaatatattatgatgtttcattacttatttgtggatgttgcacatcgtattatttgaatgtttcatcaagtatattgtgtgcaacagttacaaaaaattagtgaaacataagaaaatatctattaaaacatctaaataatactgtgatcgacattttgttgcaacggtaaacttaaaatttgtaatacaaagtgaaattccatttgaaacgtttatttctcacacatgaaaatctaattgcacatgctgaaaaacacacacacacacacattatttttttcatcggatcatgtgagatcttattacggtgatcttcctataacatagaaaaacaccacatgcaatattacaaataagtatctgaaacatcaaccaatatttattgaaacattccaataacaccgtgtgcaacactaaaaaggtcatcagaatacaatgatgtgggatattgttccgaagatttgattataatgaatccaactacataatttattcatagtttggataaataggtggaggaaagaaacatttgaattctccaccattatgaacagttttactaaatctgagtgcatgcacggatgcacctacaccaattgatgtgtacgttcgatttcttccttccacctggatggctgatgtgaagcatttttccgattttgttaacacagtaagtaggagtactccattggaacatgacgcataatactactctacttaatccgtaatatgcggaccatatatatacatatgcctatactatactccctccgttaaaaaaaagccaacctctctcgtaggttagcttttgtttttttacggaggaagtgcatatgtagagtgggtatgcaacagggtttatgttaccgtcggtaaccgcgcggttaccgcttttaccatgggggtatggtaatagaaaataccgcggtaatctcctttaattcaaataaatttaaaaaataatttaaatttttaataaattttacacggttatcacgtgctgcgcggtaaccctagcccggcggtttggaaaacctggtatgaacaagccgtgacgacgtgagtgaagcgtggcgtggattggataagggaggagaaacaataactccctcctcctcctcctcctgctcctagtactagtagagcagcggcggcaatggcggcgcctcctctgctgagcctgagccagcggctactcttcctctccctctccctccccaagccacagctcgcccccaacccctcctctttctcccccacgcgcgccgcctccaccgccccgccacctccggaaggggcgggccccgccgcgccatcccgcggggaccgcttcctcggcacccagctcgcggccgaggccgccgcccgcgtcctcgctccggaggacgccgagaggcgccgccgccgccgggagaagcgcaaggccctcgcgcggaagccctccgccgccgcctgctacggctgcggcgcgccgctgcagacggccgacgaggccgcgcccggctacgtccaccccgccacctacgacctggtagtactattaattcttccttctccacccacccatgacatgattactactcctacgtagtaagtaataatatgcatatgaatgcatgcgatgcgagcagaagaagagacaccatcagctgagaaccgtgctatgtgggagatgcaagctcttgtctcatggccacatgatcactgctgttggtggccatggcggctatcctggagggaagcagttcgtttccgcggaccaactcagggacaagctctcctaccttcgtcatgagaaagctttgattatcaagctggtaaatcacaacatgccctgccctgccctctaatgtaatcaaacgcaatggctgatgcaaatccttcacatcttctatgcgtctgcctcttgccgctcattctcgctgtttacatgcaggttgacatagttgacttcaatgggagcttcctggcgcgtgtgcgcgattttgctggtgctaatcctattatactagtcatcacaaaggtgattcttctacatactgcatgcatattcgtgtttcaggattaaaagctcattcttttgtaattgtaggttgatctccttcctagagatacagatttgaattgcattggcgactgggttgttgaggcagttgtcaagaagaagctcaagtaaaacttcttcgcccctctttctgttccagtaactattgcatcaggttttccatttcattaattggaaattaagcgtgcttcttggcatctgtagcgtacttagtgtccatttgacaagctcaaagtcactcgttggcgtcactggggttatatcagagattcagcaggaaaagaaggtcagcatgcaatctgtatttgttttcccagttatattgtgctaacctgtccccctgtaagccttttccaacacttgccttgcacaattgaatggtagtttttattgtgtcatatgtacacttatttcttcacttccttggctgttatacatttcataatactgatcataatgttgttcttcctttcttgttagggccgagatgtatatatactggtaagcaataagcactctccatctccttttttcaattatttatgaactcttgtgctacagattttacaggcataccattgtatttttgtatggcaaaacactaagcttgctgccatttgtacaaacctaacaagctgcattcatatatcaacaaatgttgatagcttgatgcttataatgttctattgatacctgatcattatgttagtaatattatggaaagattcagaattggatgttacccactaactaacatacatagacccatcttcaggttctctccttcatttttcattatttacacagaatgattgaaccttgcaattcataatgcttcaaataacatgagtaatttatttatgcctaatgaatctagtacaccattacagggttcagcaaatgttgggaaatctgcatttataagtgctatgctaagtatgttcttaccattcttgactactattgctgtctccctttttcaacctattacttgttttgttcgctcattctgttctttgttacactaatagttagagaccataatttgtagggacgatggcatataaggatccagtggcagctgcagctcaaaaatacaagccgatacaatctgctgttcctggaacgacccttggtcctattcaaattgaagcatttttaggaggcggggtacggttccatcttttactctgtacactttagttttaagatatataatatgccaaattttcttgttgacctgctgtaccaactttatctatgtagctagagaatgaacttaaatgttgtcttatatattgctaacatgcccaaccaattattatacttctctgacacatgaaggactataataatcttgaatacatgcagaaattatatgatacacctggagtccatcttcaccaccggcaagcagcagttatccatgctgatgatctgccttctcttgcaccacaaagtcgtctaagggcacggtgttttcctgtatgtatttgtattcagtggcacacatgtttctttctcaaaacatgcacactaatcttttcttcagaatataatgttgtgttcaggctaatgatacagatgttggattgagtgggaattcattattctggggtggactagtccgtattgatgttgtcaaggtgcctagttgagcccaatttcaattccaaaaattttctaccacttctatttttttccattctgtagtacttaccactgattattaatcaatcaatcaatcaatctaggctcttccacgcacacgactgacgttctatggacccaagaagctaaagattaatatggtcccaaccacagaagcagatgaattttatgaggtacacctgtgtttgctaatcagacaacagtatgcagctaatcatttgttgctaggttgagctacttagaaagcatcaagctactggcatactgttttgttctcaaagttctatcaaatttagattagtatttgcaacccacatacatacctcttcctttaaatatatatgctcatataacttccatgccttccacaccgatgctcacttgaaatctctatggatggtataataactgcatctatttgccatagttcatgctttctatatttctgttcatctaagaaaactgaagaccataacatgtaaaatagccgctaattaaaccagcttctgttctatgtgctatgtgaatcaggtaaataataatagtatgtgttctgctgatcagggtggggttcgaaatggcttttttatttaacgagttgtctatttcacctttccagagagaagttggagttacattgactcccccagctggcaaagagaaggctgaaggatgggttggtctgcagggtgttcgtgagttgcagataaaatacgaagagtctgataggtaactccttgcaagatgcaagatggcttcaattattcatctagcatgcagtaccagggggctttaggatcagacaattagtggttgagtaattcagatctcatgtttcatgaagaatatggtgtgtgttctctccaagcatctgctttcatatgttactgacatttgaggatatgtttgttgtgcagacctgcttgtgacattgcaatttctggtctcgggtgggttgcggttgagccacttggtgtgccatcaagcaacccagatgagagtgctgaggaagaagacaatgagagtggtgaactgcatttgagagtacatgttcccaagcctgttgagatctttgtccgacctccattgcctgttggtaaagcagcatcgcaatggtacagataccaggagttgaccgaggaagaagaggagttgagacctaaatggcattactgatgcttatagctattttagttacgatgacagcatcgtgtagtccaaatagagcacgtaattatatatgttctcagatgatgtgatagggatgacagttttagcatcagctgattaaaattactccaataatgattcaggaaggaattttggataaagacatcgacaagtgaagctcttgcgggtactctctgtttctaagatcttcgtcctagcacatataccatcacatcatttttcctttgcaacactatgtgtgacgcactgacgcttaaagcgaatgccgtaatgaatacttgaatatagttaagaggcaacaattttttttttcagatctgaatctaaaaccaaccaaacacttttcaacgggtctccaactccaacgagagctatcttccaccagagttaaagtttggagccctaccaaacgggccttcatattcggccaatgccttctatatatgttctagcttagcattcgcaacgtgtatactcaactgtcaactttgtggagctatatatagaatttatttagcaaaagaaaagaaaaaggaagaaaaaagccctacccagaaaacgtgtatccaaaatacgttttcaaagttagaaagcgcattaaaagcactacgcaaaagttcttggtagattttggttcggcccattggatcttccgactcacacgcaccaccatgaccgacgggccctcgaccaccggcgattcgccgccgccgccgccgccggagagcggcggctccatctcctccatggttgcctcctctgccgcctccgctgcggccgcggccgcggatttcactcgccgtggcgaggccttcggcgccgatatggcctccgcagctagggctgccatggacaccgccatcgcccactctcagtcaaccgccatcgccgccgcagaagctgcctcctcggccaaggccgacgccctcgccgccttccccagcctcacgctcaacgcaaaggtgccaccttcttgccccccattccccactcgctccgatctcagcaaatttgctaaagctcgatttcttttggccttttcccccctctaatctctaatgttaggaggagttcgaatggttaaagaaggagtacacggttcacgagcaggtggtgttcggcaagatcaaaggtgcattttcctgttacttccgtaactcaaaatccagaaatttacagattgatttgtattgttggcctgttttattatgtataacaattgaatttcgattgcttatagatcgtgttgtctaacatggttctgttcttttgatgttcgatcaattattgactttcagttaccgtgtttgcagagggtgccatcatggccatcgagcatccgggaattgctgcaggctccacagcaattgctggaattgtgctcttcaaaagtaaataccatctcctgaaagtcatttctttggtggcttacttcttgtttgttacattcacaaaagaatacctgcttctgtaatgctttacacatgatacactttagatgatatgaagagggtacctgtcagtaccatatgttaaaaatacattgaatccttttatgtaacacaagttagaatgttggagcaaagtgttccttaatattttttgtaacaacaaagatacgctattggaagtgatttcttatcatgctacttatagttgactgaaatgtactgagaccttcttgagctaattaattagatccaacttagaaatcacaagcagattcagttcaacctgtcttattataatcatcacattattctgattaattggatttcattaattctataagagtgttgtgaaattcactttcaaattatcagcctgtacatgcagagctagttgcctagcatctgatgagacaaggatgttgatgcaagtttggtctgtgattgtttcaagaatctaaaatgttcggccttttcttatatatcactaactttagtgtgactaaattcgttgcagggccaaggagctacctgatccaacgggtgcgacgcatatttgtaagcaaggaggtacgcactgactgcctgtctagctataacatttctatgaattcttgacattgctacttgctacctgcctacctccatgtctcgaaagttgcatacaccatcttgtttacagattgtcacctccttactacttgctgactagcttcacagttcgaacctatcagatgtaatgctttagtgctcattattactgtcatggacatgttgtgatacaattctttgttctgaaacagagcgaaacacaaattcgtctaaaactagcatacatttttttaatgaaattcatgcatgctacctacattcatgaaaaaaaaatacagggttgattttctttagaatgaatacaacctatgttgattgtatttcataagtttccaaattgcagaccctactttctggcatccaagctggcgtgaatcacatgagacaaactgtcaatcttgtgtccaatgaaagccaaaagttgctggtatatttctttattttgttgaaaactgaaccatctgttgtcaaattggccatttaagttcaaacattcttcatgtctgattttgtgtatgcattccaggatagagcagcaactgctgaaaaaagatttcagaaaggatggaacacactcaggcaagcctattttttaaagccttttaccatttatttttgtcttcccttctctaatacagcattggatttgctgtctacttgtttcagggaagaagggcgtgccattcaaagtgagctgaaccaaataagtgatattgagaagcaagcagtaggtgtgtaataatttcttgcgctattgccttttcctatgtcaatttgaattttagagcggaaattgcctcatcttgaatttgacatataatgagttgtgtcctataggtctcaagagcattctcaatcagcttcccagagcacatgcatctgagtttcaatcagaggtcagtatattttctggtatctgaacactatgatgtttactgaaacgattaggtgatgttgaagctgtcactgcaatttgtttttttcccatgttgtgcaaatctgttggctaatttctttgccaaaaggagagggtatagaagttttattcagtcaatgtcggcatcgattttataagtagtgtgcagaaattatttttcatggtttcatatctcataattgcagcattacattattttatcacaaaccagttttacactaaagataagatagtattttgaagatgggagttctgtaatgttaatttatagcaagcttatttttttaattgcagatatctggcctagcctctcaggtgaagaaggagaagagagtacttaacaacaccctcacgaagattgcgaactatggtgtccctatctgactgtcgaaacgcagcttcatttgctgtagtttttatcaatgaagagattctgaagacatgggtgaatcttttactttatactacttgtccgcggaggggaaaggaaataatacgttttatcagtcttggcgagatgtaaatttgccgctggtgctgcagcagcaacataacatttttgtagtgttttgcatcatatgggcattctctgttgcattgtccatgaagtgaaatggacatactgcgtcgaccttccctgcaattaatcaaattatgttttttttttaagtgtgatgggtgcgagactttatgtgcttcagagcgttaaagtggattcaagaaaactttttttctttatcaaatctgatgaagtggttacaattcttcagtactgtataacggatatgcttatgatactattatggctggaaatagaggattgatagggaagatcgccctcaagtcgccggcttctccggaagacggaggctctgatctgattgacttagtgggcaaggcccttaatatctttattgcttagtccttaatacaatagcaggccccctttatatactaggtgccaatctaatatttaggaaatctaagacaaactaggaataggaaacataatcctaaaccaactagaattagatatatctactgattattcctattcctattcctatacctatggtatttgattccataacgccggtctataacatttccctcctcctcatgaaacagctcgtcctcgagctggaaactgggataagcttcgcgaaaatggtccagcgtttcccagctagcctcctctggagatgaacctacccattgtatgataacttcttgaattccttgattccacctagctttgatagcagcagctggtgcagggataacctggccatgaacaatgtcaggaacctgaacaatatctgttggggccacaccttcaattttttttagtaaagccacatgaaaaacattgtgaataagagctcgaggaggaagcttgaggcgataagcagcatgaccaattctctcctcaattaaacaagggccataaaatcttggggcaagtttagagtgtgcttggtctgtaataccagctgccatgcgatggtgtaaccgtagccatgcctattcaccaacctcaaattcaatgtcgcgatgagatttatcataccaactcttcatatagtcctgagcttgaagaagtctctctcgaatttcaaccaaaaatccatttcgactcctcatctatttgtccacagccacaacacaggaagaccctggctggtaagcagaaatagtaggaggatctcgaccatacacaaccttgaaaggtgtctcacgaagggaagtttgataggaagagttatagcaaaactcagcccatggaagccactgtaaccaattctttggatgatctcccgaaaggcaacgaagatacatagtgatgatgcgattaaccacctcagattgaccatcagtttgcggatggaaggctgtgctcatatttaactttgtattagtgaagcgaaatagttccttccaaaatgtgctagtaaaaactagatctctatcactcacaatagaacaagaaataccgtgcaagcggacgatatcatcataaaatgcctttgcgactgagagagccgtgtatggatgtcctaaagcaataaagtgggcatacttagaaaaacaatcaaccaccgtcaaaatgactgacttccctcgaacacgaggaagaccctcaatgaaatccattgaaatatcctcccaaacagcagaaggaactactaaaggttgcagtaagcctgcaggatgtcgatgttcagtcttgttttgttgacataccgagtagctcttaacataatccttcactaatgaactggcatgaggattgtaaaatgatgcacgtaggcgatggagagtcttctgaattccctcatgtcccatcccgtgcgcatcagccaagagcaagggccaacatgcagaagctgtaggaacataaatcttgccctcaaaggtgaccaaaccatccactaaagaccaacctgtcgtaagtaaaccagcctgaatctgatcccttttggtaatgagttctagcagtgtgttggtctcttgtcgcaataaatcaaatatttcaaaagatgggccagaaatagcgtgtaattctgctgattcttcacgacgagataaagcatcagcagctccattgtgttttcctggccggaactcaacttcaaagtcatacccgaataacttactgacccaagtatgctgtggaatagtagacagccgctgatcaagaagaaatttcaagctataatgatctgtacgaatcgtaaaggatcgtccccaaacataaggtcgccaatgacgaacagcttttacaagtccaatcaattctctctcataagctgcaagcttcgcatgatgaggagccactgcacgactaaagaaagcaattggtcctgctccctggtgtaaaacagcaccaaaacccacaccagaggcatcacaatcaataataaatcgtttagtaaaatccagaagttgtagcaaggaagcagatactaaggccttctttagcgctagaaaagcaccatgggcctcagaggaccatgtgaacccttccttcttcagaagcttggtaagaggagatgctatggcaccatagccatcaatgaactttcggtagtaaccagtgaggcctaagaatccacgaagagcgcgcacagtgcgaggttgaggccactccgcaacagcctctaccttgctaggatccatggccaccccacttgcagaaacaatgtgtccgagataagtcaccttttcttcaccaaagagacacttggatcatttaagcaccatttggtgttcttgtaacaccaacaaaactgctctaacatgttgaagatgttctgcccaagaagaactatatatcaaaatgtcatcaaaaaatacaaggacaaaccgtcgtaggaagggagccaatatgtcattcattaaggcctgaaacgttgctggagcgttagttaatccaaaggccatcaccaagaattcataatggccatggtgggttcggaaagccgtttttttgacgtcatcaggatgcatgcgaacttgatgataaccactacgcaaatccagtttggtgaagaagcgagcccctttgagctcatcaagaagatcatccaccaccggaattggatatttgttctttatcgttttgctattaagggctcggtaatccacacaaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaaccttgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactccctccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttattattgtacctgctctatgtgtggaccttgaacatcaaacaatcagatctcgataggctattatacttaaatatagatataatattgagccgtacatttcgatgcctatgtatatgctactatcttcgtcccaaaatataacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagttggtttttaagttcgttttattttgaaaatacatatccgtatttgagtcagtttttaggtccattcgctttcgaaaatatagaatgagttgtataagaaatctcttaaaaaaactcgcatactaacttgaggcgatcggaatcctaaattcataattgaagctcatgattttctaaaaaagggcttgtttggtacagctccaactcctaaatataactccaggagttgagtctggagtggagttgtggagctgccaaaacccagctcctcaactctagtacattttgtgagagagctccacccaactccactcccaattttggtggaactgaaactgattggctgagctccagctccaggaggggtgaagctggagctagagctgtgccaaacagacccaaagtatatatccaaacaaatttctacagtgaattttatcttaactaaactgtataacaataataagattaaagtaactttcacccgtttgcaacgcacgggcatttttagtggaaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacaacaaaagaagaagaagagaaaaggatggcgatggcgatgcgacgtcgggtgtcgtcgtgagcgcagccctccctcgcgatccacctaccccgccgccggtaagcctccacctccgccattcctccccccacccaaaccctagatccacaccctcctctccgcccccgagatctcctcgatcccgtccgcgattccacgccgacatggctgaccccttcgtcgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttcgactccacagatcccaagtatttggagagcatttatcctgggtggaaatacgacgaggcgacacagcagtggtaccaagttgacaattctgatacgcacggtaacgccacccaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaacaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagagccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatggagagcatgtacggaagccataatcaagctcatacaaacccccaagtgcctttgtcaaacagttatctcagtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgctggacaacctgcagatgtttttaatgcagacaacaacatcagtagcaattatggttctcaacagcctatggaggtaatacataattatttttcactttctagatgcgcgatactttggtcgtaggattattctgtagttagatgtaatagtaataattgttcttaacttttcatagcacttgcctgtcccatattgttgtacaataatggcttttcatttctttgttactgcagtgtcatggtgctttggttttttttttcttgaagaaaatgttttgcttcattgataatgcattctactgttctaccacctcgttgttggctttctgtttaaatagtggctcactttataattcattgttttgtcacacagcctagtcctaatggcatgttggatgactgggaggagaatttggctatcataactgcaaataggacaaaaggtgacgacctagttattacccatcttggagattgcctttggaaagagaaaaatgaggtctgtatgatatgtatttgcagaattaaaccctttcttttttgtggtcaagtaccttatatgccttttgatacaggttgcagctgctcattcgtgctatttagttgctgagttaaatattgacccttactctgaaagtgcaaggttatgtctccttggtgcagaccaccttaagtgccctcgaacttttgccagccctgaagccattcaggtatattactgctagccattaacccattacctgtaaatatattgaatcttagtgcaattttccctcgaagctctatcttttgctttttaatgattagttaatgcaagcatactgtctcagtgttttataagcaattattgcatagatacatagactggaaatgcaagattgtgtgtaaccgctaacctgttgcttcatctttttttactctgctgtccactgttctgaactaatattttgaaatgcgataacagaggacagagatttatgaatatgcgaaggtgcttggtaattctcaatatatcctgctaccctttcagccatataagctgatatatgcatacatgcttgcggaagtgggaagggttgctgattctttgaggtatgttgttgatttgtgcatggccagcaaatgatttcaatgctatacctaaactcctgctttcacattatgacccatttgaatctccttaaaggtactgtcaagcatctatgaaggtgctgaaagcctctggccgtgccccagaattggaagcatggaagcaattattttccaccctggaggacaggatacgcactcaccagcaggtaaatccttacagcttgttttgcaatgtagctgagttcctccctctccctattaatgcacttgtgttgattgctattgtttagggtggatatggcacaaaccttgcccctgcaaaattagttggaaagattttcacctcactcgataaatctatatcgcgcatgatgggtacaccttctgctccacttccgccattgccacagggtgctgttagtgatagggagagttacactgcacctggggctacaaagtttgcaaatagccaatcagtaatgaccatgtcatcgttaatgccatctgcatcagtgcagtctatgagtgagatgtcagatagtggcaggaagattgcacacaacagaagtgtttctgaaccggacttcggcagaaccccgaaacaggtaattatgccctcggctgaggtagacacttataaagacagcaggttctgattagtgaatgccgagtgataaaattctaattcttccgtttgtttgaaaaataacagggtgctggatcggacagcacacagagtactgctccaggatctggtagttcacgctttggttggttaggctccacactacagaagacaatgggatttgtttcaaaatcccaccggcaggtactttaactgagctattgaattggagccactccacttttgttcagtttctcttccatatagtaaagctaatactgagatccttcctatgtcttgaaggctaaattagggcaacaaaacaagttttactatgacgaaaagctaaagcgatgggtggaggaaggtgctgagattcctgccgaggagcctcctctccctccacctccatcaaaaccctcattccagaatggtgtggtagactataaattaaatggccccatgagtgcaagtcatactcccaatggattcatggaagggaaatcttcaacttcttcagagcatggttcgggaatgccaccaattccgccaagccagaaccagttttctgcccgtggacggatgggtgtccggtccaggtaatctaataattctgccacttgctcatgtctttctctatattctataaaatattgaccagaggaaagttatgtttatttttagatatgtggacacattcaacaagggtggaggaggaggagcagtcccatcctataacaagccagctgttgcatctgtgacaccacccagtggtgccaaattctttgtgcccactgcggctgttgttgctgcagagcagatgcctaaccaaacagcggaaacacatggtgaaaccttccgtccagatgagcgttcatccccagctgaaacgtcattttcttcacccccaccagcaacacaattttcagcaccactgatggtgcctaccattcagcggtatccgagcatggataacatcactaccccgaacaatggatccggattatcatcgggaagtaacagcagctcattctcaagatcacgagcagcatcgtggagtggaacttactctgaacaaattaatgctgtggcaggtgctagatctcctgaccagcagaccatgccatcgcccctcatgcctgggaagcagtcacatagtcgttccaacagcaactcatctgttcagttcaacagtttgacagaggatcttcatgaggttgagctctgatatgctgcgactgctcagtatgacccatgattttatagaaacaacctgggtaaaataccttgatcctctcagcaaaccccctagaggagggagggagggagggagggaaaaagagaggaaatgttttacagtaaatgaagggaatgccacaagtgaaatggatatctcctgtcttgcacaaagttgtgggatggggaagtaaagcaaggtgtgcccgccctgtactcgtacaaacagttgtttttttgggagattttgtaggtattgttggttattatgggtttagagaaggggataaagagtcggatgtccttttttacatgtgagaagcagagagcatgtggacaccattgtacagataatccaccccagcccagccccagccctgcccccatattataattcattgaagacgcagagaattgggaattcatccgccccacatccttttttgtcattgtattattatcattttttttcttcataattttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccagagggtttttttttataggaggaggacgcttgtaaatctgcttgataagatagaaaaatctaggccacccttataccagtattttgggggttttttttataggaggaggacacttgtaaatctgcttgataagatagaaaaatctagaccacccttataccagtattttgcgggtagcctttcctcagtaaaaataataatatattttcaaagggcaaaagggctccgtctgacatgaacaccctcttttttaggctgctattagacggagccaacagtcatctgccagataaaaaaaaaagtcctctcaaagtgcatgaggcgtctagatctgtaaatttacaaaacgaatttttaaaatattaaatgaaagaaattaaaaattagaaaaaaaatggtgaggtgaggaggtaggcaagtcaagtcgaaaaacatgatgatgacgactgctaattcggcccaacaagtagtcccctcccctccctcgacgagagaagacaagacaagtcgcgacctgacgacccgaccttcctcttctctcccgctgccctccgccgccgacccgcaggggatcgtggggacgatcgatcgaggaggagagacccaaaccctagccacccaggcgccactcccattgcccccttcgccagccagccatgtctgcggcgcacctcctccgccactcccgcaaggttccttcctctccctctcccctctcctccatctcttgtttaattctccgcagcattctctcatcccaacaccgaacgcatcttgttccgatctgtcgtgcttatgccattccaggtcgatcggaacatcaccagattcccttcagattcccaatctaatattcctactgcagatggctcacattccaatctacggctctcacttttgtactgcagctgcggactctacgtgatgctctagattatgatcggtctgctcttgtacgctacttctccgctgcttctgcatcctttcccacaaagggaggtgctgctgctggtatgtgctgtactagtagcctttttctctttttctcaattgatttactggagtatatgcatgcaatctgtttgtttgtttgtttgtttgttcaaccaatctggagatgccctttcacattactaattttctgtgctcattatttatttctcttgtttaattgtatcttctgtttgtaatctatgtaattctgctgcggctgtggtcactgcttataagtcctgcattgtcatcatcgttcaaactgatgtggtgctttgcactctcacttcaatttaatcagaatacaacttttgtatcttgtatcagttatcctggatcctccagaggtgcttcttcttttgcacctacatattatcagtttcacaagaatatggggcattcatcaattatgtattctggactgtaatctaattaatataggcaaattatcaattgtttacactaaaatctgtacaaacaaactattttaacacaagcacaatgctttctcatcttttttacctctccactccgttattttccgtaccttcgaccaaacatgttttggcttcctgagccaatatcatcatttttatttattaaggtgtcatttgccgttgacttagtttaactacgctcatatcctccagtgcagacagcagctatttttgtcacgtggcagcttatttttacagagagaagtttctgttgttcattgtcacccgtgcttttggtttctgcaggtgttgagaaaagaattggtggcgccagattccctcagtgcaagcagcctgggaaagagcttgagaccttcaaggttatgttcatgaaaaataatccgcattctgagatccctattgtcatatcctgattgtctagtttgtcattttatcttttcaggtgtcactaggaggactaaatggaagatatgcttgtagaagagcacctaacaattgtatcccaaccactattaccggtctcaacggttcattgtcatggtatgttttgttttctgctatgctattgttagcttatatggctgtgtaggaatatattgaattagagaaccacccttgaaacaagagaatatgaactagtaatacttgaacattgagctaagacaaaccataaaaaaattattgacatcttctgtaaggcccctgagatatgcctctctgctctttagtgctcttttaccagaagaaatgaccccatgacagttctaatttccattgcatcttggtaatattcctcttttcctgtttcttttcccagtggacaggtgtcttcagcaagatctttctcaagcagtgcaggtacttatcccagcagttagttagtcttaagtgggtttattggttgggcctcacttatgtgtgatgctttttgggaagtgttcttggtgggaggggttccttgaccctttctttataaatatttctctcttcttaatgaaatgaagcgcagttctcctgcgttttttgggggaaaaaaacaggatatcgcatagcagctcctcagttttttattgatcttttttgcacttatctacaatgttgtttttttgccatccttctttttgttctattatttgcttcactttatcccgtcttcccatgtaccaattgtttcatgcatgtgatcctctattctgctacttttttttggatatttttctccacatctgtatctccgttgaattttcaaaactttttttttgtatgtgttatataagcatttaggttatttgctacaaaataagtatatcccaatctcacaccacatctccccattgttttggttactatgttaaaattttctatgtaactccaatcaatggttccttacagagcatgtaaagtaaggtcctctgttagctctcttaattcttgacgcaatttgcttattccagacctgccaccacatcaggaaattgggatgccatcactctctcctacaatgactgaggtatctgttacgcaaaaaaaaaaaaaaaaaaaaaaaaaaaaaaccgttgctccttatctgtatttcttgaattgcatccatcggtgttacacctttaacaccagaagtattacaccttacacttgtattgtctgtaggggaacattgcaaggtggctgaagaaggaaggagataaggtctcacctggtgaagttctctgtgaggtggagacggtaagttttctaatatgtaaggctacatgccatatattgtttagatttatttttagttatgcagttagccagttacttctattaagctgcagtagaagctaaatatcctttgaatgcattcctgctgactaggataaagccactgtagagatggagtgcatggaagagggctatctcgctaagatcattcatggagatggtgccaaagagatcaaagttggtgaggtaaaaatttactgatcaaagaacaaccaatttatgactctcattttactaatatgattattacagttgcctctgcctataaatttttctgacgtaatcttggttgatttatggccccactgttccttttagatcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgtagtttttttttcgtgttacctatctaggctattaattggtagattttattgaatcatacttaataaacacaaaacaggttccactgtcaagcgtaatgggaactggtcctgatgggcgaattttgaaggcggacattgaagattacttgggtatgccctttctcttgtcccctccaccccccttctctctctctttctcctcccttaatgatgaaatctgcgtggaaaaatgcaattaactagttttatatatttaccaatgactatagattaatttattttcaactatatcacttcctagtttttttagagaaaccgctggggaagccctcattttgtagctagtcatgtgtgctcctggacatctcatgctaattctgaatggtggactcataatgtcgaattttattggggtgtcctccccttgccagctgtcttcttgttcaatctttaaggctcaatcacaagaaaacaagctgtatcactcaatatctttgtggttggctatcatatccattctaagataaccatattcagatactatttgatcacttaattcaatatccactggaccagtatatcaagttttcagaagaaaaaagaggctatttatctgactcagttttgcacttatgcttatttgtgtacactgtgttagtagcagcactagtttgattcaaagtaatattaatgtaatttgcttgagcttgccaaggttcaagttaaatgtgtggctgtcactagcctgttatgtatgtcagatttgctgtgcttttattctgtatgagaattcaatcagcatctaactatcattttttattaacaaagcttctgtagcaaagggtggcaaaagggaagctcttgcggctccagggttaagttacactgatgttcctaatactcagataagaaaggtaaatttcaatgatacagaatcttgttaggttgattttagccgatgctattggtctgatagtgtattatcttctattcttcacaggttactgcaaaccgcctgctaagctctaaacaaactattcctcattattacttgacagttgacgcccgtgttgataatcttatcaagtatgttgaagcctagctttgtaatttaaagcaatcctatattacataggaaacctatgtaatgattcaattccatactgctggttttgtagctttttaaaatagttctttatttcaatctaatccaggttgcgaggggaactgaatccgttgcaagagtcatctggcggtaagaagatatctattaacgatcttgttataaaggtaattgccgttttcttgtttcttatgtctaccaaccattgagttgtcgcagattgggtgtatgatgtatatcagttcacagactgttaattttctcctgacctccagatctgaattgatcttaatttgatgtgcaggctgcagctctggctcttcgaaaggtccctcagtgtaatagctcgtggatgagtgattttatccgccagtaagttgtcatggagcatgtatcctgggattagaattatgttgacaagaaggtgattatggtaaatttatttctcgtgcagataccacaacgtgaacatcaatgttgctgtacagactgagcatgggttgtttgttccagtaattagggttagtaatctgaacttgtctatttatatgaaaaaaaaaaaacattggtttctagcttgtacctgtgtttcaggatgcagacaagaagggacttggtacaattgctgaggaggtgaagcaggtggctcaaagagcaagggataacagcttaaaacctgaagattatgaggtatatggatcgcatggtagctaatataagcatgagacaacatcatttttccttgaaaattctggtgcttttcagggaggcacattcaccatatcaaacctaggaggtcctttcggaatcaaacaattctgtgccatcataaatcctcctcagtcagcaatcttggccattggtactggtaagtcatgctaatatgtttgtgtaataataacggtagcatcctgtattatctgcatttctttctagtatcttttgagaagcatattatctttgttgccccatcctattatttttaagtcgggcttctactcagaaatttggcatgatgttacagagtgccaactgcttagtagcatttagccttttataaacagggcttaagcatagaattcaaggtgtagtagagtagtatcctttcgcttctgtattctacgtttctacattctagataaacttctgctaagaaggtccattcacgttgcagtgttcttgtgatgattacatagggtgtcattatttacttaatggccttttttttgtttggacagctgagaagagggtgatacctggcagcgtagacggccagtatgagtttggttccttcatgtcggcaacaatgagctgtgatcacagggttattgatggtatactcttaagccttatctgaatacatgatagttctacggaccataggctagaaaataactttgttcatgtgtgctttctctaggtgctatcggcgcagaatttctgaaagcattcaagggctatatcgagaatccaaactcaatgttactgtgaagttaaagatcagcaaaactattcttctcatgtgctcgaataacgcagagtggtgctatctcattttgtataataccggcacggtgttctgtcaaggaggacccgaaaaccaagagcacataaccatagacagaatgacctggtttttggattaaaagctttttctgtttatcttttttttttttgtttgtttgtttcgttccagttatagtgggaattaggaggatcaacttacaagcatttttagcacctttttgtgggtttaccctcggcaagtgtgataactggagagagtaaattcccgggaaacaatgcagtatagcctgtatacgatttgtcccttttctttttccccttcatagtgcaaaaccaagaggcgcagaaggatctttcggaataaattggcaatcttggggagtatggcttatactgtttcttaagcttttgtgtagagaagtagattattggtcataataaatcatgcatttgcttatttcacatacatgtttgatgtgctggtttaattttgggcctttaatggagtacaataaaacaaaaggaagcttgttaagaaagaatatgcctgtgtgttcttctcctccaagtcactgattttcttttttggctgcccatgggaagtttgatcgtgtattgtctgcttggtcggtgcattgttattttcttccacgtgagttggcacaagtgcgtctcatatttcttgacctactcctatgtgcgttgattggttgtcattctttgaagctgcaggaccgagaaggtaagacgaatcttgtccctcgcagtatgcatttcagcgttcttatggaagaagcttctaatcaaaaggaaatgaatcgctctagtaatcccaaatccaacacgcaattctgaacgtcaaatggaacggaatgctagaaagcgaagggagactagaaggtcaaaaacttggaaaaaggaggagatgaaaaatggaaccgatttcataaggagctgagcttttcatagctccgcttttgataatttcgatagcatagcataattatcctccaagaaacgccggaagcaagagcaaaaccagcaaacggccaccggttccaggacagggttgcttccgggaaagatgcatgatgcacagttttccatcaacatccgtaccaaattaagtgtttctttgacagcgtgccagatttggatcggtcattcgttgcggaaagtagtaccaatgacttactgctactattaatctactactgtttcgcttaagtataggtaaaggaaatgtaaccctatttcgagaaaatatattagtggtagataggatagctaggagatccaaagagcagaatggtatactgcattagatatatccaatgtgccacgatgagtggtttttctttatctgtttgtactaatttgcgcacttttgaccgataagcgggccggcatctttttaaatagagaaacacgcgatatgatgataggcagtgagatttcttcacaaatactgtacagaacagtagagcagtagtagtagggcacaaattgatggaatcaacttagcaacctttgtagaccgtcgtcaattttacaagggagagatatagtagaatgcgggtacaacagttcatgctgtgttgagttatatattgtttttgggtttgtgattaaacagtgtaacaacacggaaaggttcaagacgagcaaacacgtcagcatgtacaaacgcagtgtatgagttaattaattatatggttagcgtgtatcgacattctcgataccagtttaaaatatgtgatgatattattagaccttgcacccctataaattagggccggtgaacaaaaccatcaacgccttagtttttgattttgaagaagaaattgttgtcagcatcattagatcttgtgtgagtatatttgagagtcaaatcagcatgagcggtttggaaaaccgccgtctgtagtgtagcggttttgtctccagagcgacctcttctctataaagaggaggagaacttccatggaatgagccacaaaaccaccatcgatcatttccatttccattttcaggagagatccacatcgccgttggcctttcatccagtgagtgagggagggagatctcgatctcggtctcgcgacatgaagaaggcttcgtctctgtcggagctggggttcgacgcggagggcgcgtcgtcggggttcttccgtccggtggcggacggcgggtcgacgccgacgtcgcaccggcgtcggctgacgaagatatcggtgatcggcgcgggcaacgtggggatggcgatcgcgcagaccatcctgacccgggacatggcggacgagatcgcgctggtggacgcggtgccggacaagctgcgcggggagatgctggacctgcagcacgcggcggcgttcctcccccgcgtccgcctcgtctccgacaccgacctggccgtcacgcgcggctccgacctggccatcgtcacggccggcgcgcgccagatccccggggagagccgcctgaacctgctgcagcggaacgtggcgctgttccggaagatcgtgccggcgctggcggagcactcgccggaggcgctgctgctgatcgtctccaaccccgtcgacgtgctgacgtacgtggcgtggaagctgtcggggttcccggcgagccgcgtcatcggctccggcaccaacctcgactcctccaggttccgcttcctcctcgccgagcacctccaggtcaacgcccaggatgtccaggtcaacaccttacccctctctctctctcctccactgccattgccattgcccattgtccattggccattgttgctgtctctctctctctctctgcgacaaagtgacatgtggtgtggggcctagctaaagcatatggttggctgagtggtggtgtcactgcccacccacatgtgatgacatggcagcctttagcctttatcctatttccatggatgactagcttcctgcacacatgtgacaagagcgaacacatgcttctgacaacttgataaaagcccaaagatgcttagttagtgctgatatgatattattaagattcaactgaatagaatcgaatgccttgggttgatgctcctagctactactatatgtggaataatacaacttaggatccgcatacgggagaacgttttggctaaaatttccaacaagacaaagttattatcatttgactaatcgaatattagtaactacaaattttaaaattagttttttatatataaaatcaaattgcgcgcctagcatcattatattttctatcatataatagcatatatgttttctcactatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacttgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttctattatttcataattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacgaacaagtctaatgttcagatcgttgagatcgacgacaacactgccggatgcgtcgccatcaacaaggtcacatcttctcctctacatttatttcattatttatttattcaattggacttggtcctagatttttcctattcagagtttcagatctaggagtagcagcttgttatctcaagcttgcgacgtgaggtttgcgcaccgatttgcacaaatccgtcatgtttctgatatgcaaagatctaatatacggagtacttaactactactccctccgtcgttttgactttaagattatggacaaacataataatatttacagtactaagttagttccatcaaaccaataattaaatatattttcataataattttgttttgggttaaaaatgttactacctttttctataaacttgatcaaatttaaatagtttgacttttaccaaagtcaaaacaacttataaactgaaacggaggtgtatttccgatggcattttgtaagggaagccatacccataaatgtgattagcaattgctagtaacagatagtagatcgtcaattttcgtgtgcgctgtactgacaacacaacactggttttctcaaggcgtttgcaagcagctacgccaagggcaagagaaagcagctgtccccgcaggatgctgcattgttgatccagatgaactaccgggctcacctagcccaccgctcgcaagtgctgcgctgcctccgtcatctggcggtggccaaggccaagctcaaggacattaggtccttgttctacaacatctcttaccgccgccgcatttcgcatgactctgaagagcgtcagaggtttgccgacaaaatcattgccctgctcgccactgttgatgcccttgaggtattaagctcatcaccctttctgatcatgccgtttttcattaacaagtggcccccatcaaaattttgcattccagacaatttcttcttgttatatagttatttttatttattactatgggtgacgattggtaaccatgccaatgcatgtgttgttatttacgcgtttatcagcaatgttgtttactaccaaacgttatttgattgatgaaatcatcagtgtagacatgacagtaaaccacacccaattttcttccgatagtctagtttagggtcctgactgaatttatggatatcaatacctgcaacaacatggctctcatacagtacttccatgtaagataatctaggtgtaagtgaagaaggatgaaaacaccagaaaaatattttctagctttcttcttcccccaattcttcatcagaataaactctaaacaataacacatttgttgatagctacgtgagggtagtttcttaaaaagaaaagaaaaagcatctaacagccataaaaaaacaaagaatactgtacatatatattgttttatcatgggctctataaattggaagattaagtgccatgaaatgctttgatcttttgccatgtgtgaatgttttgtgcttacagggaccagactatatggttcgcaatgcaaagaggtctatgctggaggagctggaggggatgctagagatcgtaggtcctcagtcactagggaagccaaggactctgagccgcagaaagtttgagaaccatatctaatgatatgaggactggtgtcaagggcaagtgaaaggcaccatcggttctatttcgtagtgcggcgtatgaagatgcttgatgggggacctacctttctgaatgtgtttacggtttagacagaatgttgtgtctgtaactctagttgtatgatctatcttctgcttgaactagtacttatgtgttgctagactagttagagcttctttataacctcttgttgtttgaggaagcttcttgtagaaactgtttcataatttgtcatgaaatgatgtgcggcatgtgccccctaataaataagaccattaccatatggtatgcatattggcatggtgcttttcaaccgatgcatctaaccgtgcggcgtgttgccaagcctccgcgttaccggccacatccaatacggataactgcaaaaaaaaaaaaatgctaaccgattgggagaggcaatgatggaattttttggtattccgggtcgttgttgtgttcaatatgtgaagcatcccgttcctctcaggcaaagaaagttccaattcaactggcaagcactgcaggtgactgctgaaacccccatatgttggtgtgtgccgtgctcatggttatcttgtgccgctttaagtttctgtagaaggtttgcgtgatgtcattgcatgcactgggggctgtacttatactgatctaattgtaagtttgtatattataccatattcatcaggctatgttcaagtttgtaccacttagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaatttttttgcaaaaaacgcaccgtttagtagtttgggaagcgtgcgcgcggaaaacgaggtgttttctctctcaatctccctcaatgtcctccaaacgaacgctgccttaggttgtatttctcattgatcagtatattgacatcgaagtatgattctttgtattttggtaaccctgtgcacatgttaacgagcgcggcgtgcttatacttcttgtaatataaatgcttgactccgcccgccccaatcgatcccgagctcgagcaccttggtcacccatcccgttgtttccccactctgttccaagctggtccttccggagcttcgagtctctgccttggcttgggccaccactccataatttttttttagataatggaatgaaacattcctacctttgctcattagagctaaagccaaccacttcctccctacattccattttccacatttatttaactggccgattgcaccatccccatccacccccacgtctcttctacatctccctcccggacccaaccaccttccttcctattccttccacccccaagacccatggcctcctccccgccgtgacgtttaactatttattactcctagtctatgatatgtggatggatgatcttatggttaacatatactatcatctatttaaatgcatattacaactaagataagttaagacatcttccgccttcccgcagcagaggagcatcatccaaaggcaagggaatgacagcgcgtgcaaggctccacaagagtcagggttgttataggtgaaactttatcctcgatgtaccttcgtacagcaatggcagctcttgcggattccttgagcacagcgttgctaacaggccagcaaatcttcccattactttccccacaacacctatcatcaccacctctaagtgtgtccaacacaagacgctcaagtgagactgcggccttgacgatgccacatgttagctcaaccaagctctttgcggagttgaaccctaagatcttcacgctcttgaggcagtcatggctgagctcgggcagctgcctcaaatgtggggaagaactttcaataatcgattcatgtgccatatcgtcctgacaaacctggaggtgataaaaaggaagattatatatgaatgaatcaatggtccatccgacagatatctttctttgcaggatggaataatggatgaacagcacagccttacatccaagtataaagtctccaaggaaggagatgcatcgacgaaagaaaccagaaagaaataatcataggatggggaaaaggtccctcccgcaatctgaattgttaggtgcttgaggtagaggaatttggtaggcaacattggtatattaaccgcctgcacaacaaatgcattgtcacatgcagaatatttctactgtcatatgcatatgtatagctactatatatgcagggtcttagaacatacctcagagtccgaacctaattccatagtctcaaggagggcgataggcaactagttttgtaaatttttcaaatagaaaattatttcttgttaacaaccaaatttggtaacatctgtgtcaggaaagaagattggatcaaagcgaagtcggaggcgaagatcgagttcggaaacagagtaggaatcggctggagtccagatcggctatgattaggatcggctgggtctgagtcgggctaggtaagccgatacagccgattccgacaatacgacttgtgtacgacatcgggttcaagttaatgtgcttcaagatgattgccacgcatggatagagtcctgggaaggcaattgtatctattaattaagatattttatgtagattccttatagataaatgtgggcaaaagtctgccgcaaagacttatggtatcttagagtttgtaagagataatagtcatgtccggtatgggcatatcttgtaattctcgggtataaatagaccctgagccctatgtaattgataacacacacgttcaatacaatttcggcgcatcgccaccctttttgctttagttttgtttcgacgagttcttgcttttgggttgagctgcatcggtttcgatcttcaacaagaggtaaaacttgttatgatgacttgtattctcgggattagtgcttccatctttatgatactctaatcttatttatataattcgtcgagttatcatatatcttacataatctctagcaatatcgccatctaacctactatcggttaacatctgttagcagagggcaaccgattaggttagattttgacgttgatctagattatataagatatctaccactctatgaaacttctagcggcttgattgtctagatatcgttcttcatttcatacttaatgttgtatcagttaagtttgatctgttaagtcgtgcttagaatatcgatctctagcctgccttctagttgccgattagaatagcatcggagtttcagccgatcttatccgatttaactatatttgttatatatgctttattgacatgttaaatctgctctttatatcaagatattgttgtatctaagtatgttaggcctttgtttgatatattatacatgctttaatatcctgatatagagtagtatcagagtattagccgatacatgttagatctatttgatcggctacgctataaacatatatagtcctgttattgatatatatttcaatctaagtgatttatactgtctcggcatggtgactgatctatcccaatcatttgatttaagtatatatcgatataaggagtatatatcgttaatatctacagccgatcgagtagatttagttcttctttacttattcatgtctgccgatcgatacacagatgacatcggctcaaaggtaaatgatatgtcatcggcatctagccgatcggctatcatttatagatttaaccacggtttctttgcttctatttcttgttgattacaggatcaaatcaactggcacgctaacacacctgaaggtgagctttggacctgcactggagttaagcagatctcccgggccacgtgttttctgtcaacacttttgtaaatatttcaataaataaaattaaaaattaaaaaaaaaatcacaactagtgcaccaactgcatgtggacaggagggagtatgtagtatacatgtagattgtgaatggcggttggaccgcccggctcaccggtcggacaagtggaccgctgaaacgagagttcgtccgggtcatccatcggtccggctttttttactaaggtttaaagggcgaaaatccgattcgttgtaaaattaagggatctcagatgaacttataccatttcttgaaatccggggcgggctggcgtggattctacccggcctgctcccttacttcggccccatatactaccagcccacgaggcccatgcatccactcttccagaaacttccggacttccagagtcttcgacacggatagcgcctcctcccagtcccatcgcacaacgaccgttggattgttgagccacggatcgcgcgttgatccgagcaatctgaactgttgctgcgccacggattcgttcgctgtctcaaattcattttcagatttcccgctccccggttcaaaatattcagcccaatttctagtataaatacccggcacaagtagggaatcaatcgcccccaattcgatcgagagagagagaaatggctctccagctgagcggtctcgccgaagtcgtgcgcgaggtcggcgtcgccccgggcccccgccgcgtcgtcatcatctccgacatccaggcaggcgacgctgctgtcatcgacgagttaatggcgatccagctcggtgtcgatgcgtcctgggaattcgtcaacagggagcggctcaggaggatggggcgcacctacaacctgctcaagatggtggaagcggttctcccaggcctcatcgacgacccctaccacgcctccgacttcctccgcgacatggagcataaaatcaggacccgcgctactttctccggtgtctccttccgcgtcctcgccgtcgagttctgcaacctcctgcgcgactacaacgaccgcatcatcgctgatcctcccgtctctacccgcgaggagctccaggaccacatcaacgagctcatcgcccaactcgatgaccttctgcaccagacctgcacgctgcgccaagatgacccggttccatgaaggcaagcggaaagttcatgtgaggaggtcccgatcgtacctagttgttcatctgatctgatggtagttacagtagcagtagtagtcaagtagtcgaatcagcatgttaatcctgtttgaaggagcaagtagcagcgagtaatgtcactagtagtacagcacagcacagcaacacaagtatatgaggatgtacccgcacaaccacagtatagacaagtgtgaaatatatggaaccaccataagttggtttgaatttgttctcaatcgtgttgcctgcttggtttcagttcgttggtggcaagtcatctctcttctgaatcttcttgtgaagttgttttctgaatcttgctgtgaaattgttttttctgaatcctggtggtggcaaatcgtccgtcttctgaatcttcttttcccctagcttctgttctgtccggtttgtgtacacagatctggttcgcgtcttttcacccaaatttttagatgtttctgtctgtgtatagaatcgtccggtcgattgtgtttcagtttcttgcaggattagtctgctggccaccgtgctctctgctagcttgtggtagtaaatcctttctcctaccttgatggttttttttctcgcacacatcgattctgatttcctccggttttttgctcgttcctccgatgtaggcgtcccccgccctcttcctggcaggggctttggagcggtagagatgcagttccaagtccttccccggcaacccgatctgccatgtgccacaacacctagtaagtggaatatgttttgattgccttgtgccagattataatgagaatgagaaaggtgacaattacttctgctgtttgcctccctcctgattcacagtttcatactagtatttagcaagtttttctctgtgttttacttaatgagattgctgtttgggttgtggactttagtattgtttctgctagttaatacatatcctgcagtcttcagtctaaccacctacttcatttgcttgcttgtctggaagggaaacacttggttgcattactgtgtagattatgtcagatggttctctagctgcagttactatagtaaaattgatcatcctctgaatcattgcaggtgggaggtggcatgaatatcaaatctgattgtgacgaaccatccccgtatgctgctattcttgcttctcaatactatgttgtactgttgtttcaagatttgtatgcaggcattgttcttgcgtaggacaaacggacatatcttgggttacctatttttggaattctgttgagtttgaactaacatattgccttgctgtacgttgagaacaatttgttttgctcatatacaagtttcaccactagtatgtcttgattgccgtatgttttgattataatgaggatgaaaaggtgacaattacttctgctgtttgaagagagctctaaacacatgatagatgtgccttttgattcacggtttcatgtttagcacgctctcgatcgatgatgtaggaaggtttatttgtgtttacttgatgaggagcaggaacatttcttacattttgctggttgggatgtggattggtaacgtgttcagttttcctactgggcagttgcatgggatgttttggcatgaaattgattttgacacaacttgtaattgttgtgtactctctccgtcccaaaaaaaacccaatcctgggtttgaactccaggttcaaacctaggattgggttccaggttcaaacctaggattgggttttttttgggacggagggagtagtagctatagtcagtttttcctcacttaatagctatagtaaaatactcaagaggaagtccagggagcccaaggtggggaatgatactcttcgacccactgaccgtgaaggagagtactatactacgtgcatgtttggagttgctcatatcttcgcatccttcaaatgacacattcattttaactactgttttggccagctactagtactaattcctgcagtctccagtctaaccacctattcactgacttgtcaggatggcattactgtgtacttctagattattttggttggttctctagctgaaattgatcatcctctgaattattgcaggtgggaggtggcatgaagatcaaagctgattgtgatgagtcatccccatatgcagctatgcttgtttctcaagatgttgcactgtgttgcaaggtttgtatgcagacattgttcttgcgtggagtataggacaaatggacagatcttgggtgactgttttctggaattctgtctcattatgctctgtgcggctggaggcaacaagacaaacacacctggacctgatgctcaatctgctctcagggctcttgctcttgctcggtctgggatgaatattggtcgcattggtaagctcagagtttcaaatactagttgatgctgacacaatcgaaggatacggaaatgttgttgatgctgtgcacaatacttgcagaaagggaggtagtagtagggaggaggctgtgtcgtaggccatttatcgccatggacatggagagtatctcctctttggatagtcgctccaaagcttcccgaagagagagtttcgctcattgtcctgaatttctgactgtcacttaatttggccactctgttttggttaaggaaatatcaagttttcatgcttaacaagacccaatctagtataccttggtggttccatataatatggttggattgttttatgagtttgtgccatctactgtatgagtttgtgtcagtttatcttttgtgagcataatataagtgtgatcttgttggctgcatgatttctggggtacagcttagaagttactcctatttactgtacttagatggatggttggttgtgctgttgaatcacttgtggagtagtagtacttaaattttaacatgttgcatttgcatggagttttgtcagggttcagttgcatttgaagagaatgtacgggtgatcatgttgcatttgtcagggtccagatcacaacttttgctggtgtgctgtcctgatctggtttcatgtgatttgttgaatgatgatggacctgtgtgttgaatacgtagtaggagtaagtactactccttgctgcaattttacaccattgtcgaatttatgatgatgcttgactgaaatttcagacgtctcaaggagggataggcaggggcgcagggccttttaccattgaggttacttgggccatggcaactagtaccactatgggcagtgtggctacaacatgtatcttcagattttttgtgttggccttatcatagcatgctgctctgctctgctctgacgttaaacaagggctacgagcaggcttccctgaaagaccagagaatttgagttcattggtatattcgacaagggaacaatttattggtatattcgaccaacaaattcatttattcatattgttctatcagtgtaaaagtcgaagaatattgttctactagtgtctgtcaaaagcctagccgagcttgagcttggatcaagaagctaagctcattgctactccatccgttctaaaatgtaagagattttagttgaataagacacattctaacgtccatcctaaaatgtaagagattttagttgaatgagacacattctaagttcctgtgtagaatcataatattaggatatatatcatccaatcaaaatcataatattatgatatatctcatacaatcaaaagcctttctattttaggacggaggaagtagctctcaaatgtatatatgaagatgcgtcttggccctatataaattttatgcacataaaactaagcaagaaaacattgcactgcaaccatgacatacggagtatatagtaaaagcagttcccacttgcgatttaagaacgcaccaacgacgacatgactcccaactgggagctggaaacttaaactgaaaactcagttttcaattcctcagcaaacgaacaggtccaaataatccaagaaacaaagcatggtttatctataatttgattaaagcgacaacattgtgcatttcagatagcttatcgcatagtcttaagaaaataataagggatagttaaagatgaaactacaaagatcttatgactaacatatactatcatttattgaaatacatatcacaactaagataagttatgacatcttccaccttccagcagcatagggatcatccaaaggcaagggaatgacagcgtgtgcaagtccccacaagagtcagagttgttgtaggtgcaactttatcctcgatgtaccttcgtacagcaatggcagctcttgcggattccttgagcacagcgttgctaacaggccagcaaatcttcccattactttccccagaacacctatcaccacctctaagtgtgtccaacacaagacgctcaagtgaggcagcggctttgacaatgcaacatgttagctcaaccaagctcttcgcggagttgaaccctatgatctccacactcttcaggcattcatggctgagctcgggcagctgcctcaaatgtgcggaagaatcttcaacaatcgattcatgcctcatatcttcctgaaaaacctggaggtgaacaattaaagaatatgaatcaatggcccagcagatatatatatgcaggatgttgaacagggtggcccttacatccaagtataaagtctccaaggaaggagacgcgtgaaggaaagaaaccagaaagaaataatcataggatggggaaaaggtccctcgcgcaatctgaatggtcaggtgcttgaggcagaggaatttggtaggcagcattggtatattgactgcctgcacaagaaatacattgtcacgtgcagattatttctactgtcatctatagctactatgcagcacataaaatcttagaacatacctcagagtctgaacttaataccatactctcaagatttggcataatggatggaagctgagcacgagcatagcacacgacattcggtcggatcatggacaagaccttcattgtcagtgtttctccaagtgagaacttgatccctccactaagggaaatactggacaaattcggagcttcacacacaatcacttgcatcctgcggcatgccataacactcaggcagctgagatgctgcagcacacacggtatcttcaggaaacttatcttgttgcatacattaagtctcaactgctccaaaacaagggagttcaaaagaagggactctaactcgtcacctgtaatatgcacaccacacagatgcagttttgttaggcttctcaaggggccaagttcagccatgggatggaaggcacagaaggtaagctgaagacatcgaattgagtctcgaacaccatcagataaaagtgagcatgcaaagatgtactttttatgtagcgtaagagtgagctcttcaatccctggtgtaacagcaacctcaagccatctatcaatgtaaggatatgtactgtcctcatcagctacattaagcttcaatatcttcgcagtgcccaagtggtttctcagaatgctgtcaattttgcacttgaaatttcccctagatgtcctcgggcaaagtgttttgaaattcaagctgaggttgggatgaaatctccaggaattcagaaaggaatgagaaaggcaagcagcacgagcagcagcactcatcggcattaaggaatgtatgtgacgccagatgtcctgcatccataagcatgggataaaatctcaaattaaggccaaatggaattacaacaagagaaaaaaaaagaacaggagaaccacatggagtatctctgccccaggttgctctctatatgattgcacaaggtgcaggatggtgcaattgattgtagtccatgatataagtttatgtgcatttgttcaaccaaaatgcacatcgatgattagtttattgtgcaatagcatattataaatagatcagtatagcaaagaaacataaatttgtaacttcagcacagggtgtaagcagaatctcgtgaaactagaagtcttgacatgtttattgtaagatagacataaaccttgctaaatgcaatgaaaaatataacatattgaaaaaaccatataaaaggacatcatgaaagcagttcaacctgtcatttcgtatggatttaggtagcaaaataaaaacatcaatgcctagcatgaatagtgaagccaaaagaaatagggatcactatttttatagactgaatatgtcaattaatgcttgtaagaacttggatacagcaacatttcagtatcatcactgcagtaaagcatcatatgcctatgtaagtaatcaaaactggatatttttcatattcgtcttaaatgaatatgcatgattgacatgattaggcctgctcaaacttataatgaaatcattcatacttaggcatggctcccaattgcttatatcaggagggagcacatgttacagttgttggacttaagaggaaaatgcaactactgatgcatgccacgccttatggccattgcccaacattaaaaaaaaaaaaaacaaagcaactacgcatcttattaggctgggccttctaagagagctagaaatagtcctaaatgtatggtaagtgcagcgatacagaggtagctgacaatattttgacatattctgtggttaaagatgtgtttaaagacatactgatgggaaaagatgaaagccgtttcaatatgtttaagaacaagcgttatattatattactgcttcctgaaagacttagacacagctgctacaataatggttcatctgcaaaggctagtaacatcagtcaaatagacagcccacaagtgagagatcctagggtgtatgattatactatatatttttatcaggagtaccatgaaagaatcaacagtcatgtctcattatcagtagatatgctcaggctctggcctggaggactagtgagaaaagaatggaatgcatacggataataagaacgcaatgaagatattgccagcctttgaacaatgaccataaataataattcactaggagtttaggacaatgttcgattgcatatatattttgtgactataaataataatcaactagcgcagtggggtgaattaggatgattaaagcagttaaagcttacaatctaagcttgcgtcagaattttacagtgctgttagcatacctcaggaaggtacgggagtgaataaatcagtgaatcgccatggccaacttgttcagagggggagttattagtgctacccactgtacaattcgatttatctgcagctgaaccagcacgattataattataatagcccatcagactgacaagaacacattagagagagagagagagacaaacaacgtagggggctaccgaccaatggtttattgggataaaaagatcaagaatttttcaacgaataaatgcagatattatggggttaaaaggagctgaatcggtgacctaacctagcaaagcagcaacagttgaatgttgtgcaaattataattcggtatccatctaacattagtcaacatgaaccgattagcgaacaagaactgatccaggtgagacgaaccagagacagggctgggaggcaaagggagttgaggcttactcatgggcagggctggggctagggctaggttttgccaccgctgctcgcgttgcacggccacggaggacatggcagatggcattcaggacgacgataactctctctccccccttggcccttggatctcagactctcctacctatctatatagctcttctagtatgagagttctgtttctggtttcctctccaactcgttttttattcgattggagctggactttactatatgtcaaaacggattattagtaataaaaaacaattttatgagtctcaaatagaaactactgctacagcagagtccttaacgacttaaaaaaacaaatattcaaatagaaactactactacagcacgatggattgggcacgattaattaggttcagcccgacgggcgtcgtaggacagcccgcaatgtgcagacattcgtttaattaggttcgtcaaccagcaacaagactggattatttcacgtgaaaatatttacacaagcacatgagtactccctgtcccaaatcaaactaggaacaagagagggaaacctaccaagagagggaagaaaatacaaaattgcaaaaacaaaaaaaaaacaagagagcagtgaataggaaacagattgaaagctactagctcaagaacatgcaagagaactcatagattcagcagagccacaagcactaatattgctaaatgacatgtcaagtgattaacaacatcaaacagctacaatctttcttgaaaactacatcaaacagctacaatcctaacacagatcgacattgctcaactttgtgtaatatcatgattagaaaattctcaatctcactcttcgtagtatggtttaaattcgattccctgcgctgaagtataaattgatcggtcaatacacagcatatttgattgcacacatcaaacaaatcgcaggagtagagtggcacatcaaacaaatcttgaacacgaaccgaagaagaaggaggaaaaagaactgaccggccgtcgtcgctgctgcacaaggtgtggccggccaattggaactgcaactctcttccatggcagatctgccaatggagctcgaagtagttgcctgctcccacgccgatggagcccttagagctggaggcggcagcatgggcagcatcgcagcgatggacggcgttcgctgctggatggatgggcgacgagtaagtcggcgtcggtgacgagagtagcggcggctgcgttgccgtctcgctgcccagcgacgtctccccgtctagtgcaatcgtgccctaatgggccaaaaaattttgcaattcgcgggcatttttgtgggggcgggactgcgggccgcaaaaaaagcccgccccacttgcacccctagacacgatgcagaatcgctagagatggtaccatgacttcacggagacaaacagcatgctactccatccatcctcaatggcgaacaactgacacccagtaattaagctcgagtatacgagcttcgaatagagactaacagaacaatgatgcaacgggcaaacagaacagaagcaacgcgactatgaacaaaaaggccataggctgaatgctcaaaaccataccatctcagcaacaggcaaagacaatttggtttggaggttcttaaaaggcgccttaaataaggtaaacagtcgcattacagctagcagcaaacatgagttcgcgaattgatcaacataacattaggcaaaagagctcaaaaaaggatagtctggggcagatagttctatatccttgcaaacaactcgctatagcaaaactccaggcagacgcagcagcagattttaagcgttggcagcagcctgggcggcagcatcccgcttcctttgctcctcgatgatgctgagcttgatgcccttgcccttgggcaggctcacccaaggcttgttgcccttgccaatggtgaacacattgcccagacgggtggcgaattggtggcccagggcatcctcaacgtggatggtctcgaagctgcctttatgcttctccctgttcttgatcacaccaacacggcctgtgttccttcctccagtcaccatgacaacattgccaacatcaaacttgatgaagtcgacaatcttgttggtctccagatcgatcttgattgtgtcgtttgccttgatgatcgggtcagggtagcggatggtgcgaccatcataggtgttcaggtaggggattcccttctggccaaactgcacagaccgaaccttgcaaagcttgaactgtgcacagaaaaattagaatcagccagcattctaacttgaattaatacactcaaaagtaacggaatgcacaatgctacaatcagttcttctctagaggtaaactaaagaagcaattctcaataacagttcaatcaaagcaaaatatctttctcagcacaacataaatttcattatttcaaacagaataccttcatataacaagagtgtgttcagcaagaacagtaccaaaaattaatatgtcctaaccttagcatcctcatccttgacagactgaaggcggaaacgtcccttggtgtcgtacagaagcctgtagttctcaccagtcttggggatggaaatgacatctgccaaaaaagaatatgtttagcacaaagcaccaagtgtttttacatcatacactgaagcatatattgattgcaataacgattgagcatacccatgaaaccagctgggtaggtcttgtcagtcctgaccttgccatcaaccaagacatggcgctgcatgaggatagaaataacctcacggtatgtcagagcatacttgagcctgttcctgataatgaggatcagaggcaggcactccctggacttgtgaggaccagaagatggcttgggggcctatggtaaaaggtaattagaaatataagctatcaggtaacagaaaaaaaaaagataagcttcaagcatgtgtagttaagtgtaaacaagaatgacaaacttacaaaagctccaccaagcttgtcgagcatccaatgcttgggcgcattgagcctcttcagatgcttcttcaaaccccttgcctggtattacggtaagggaaaaggaaatgatcagcacaaataacaacataactgcagagtagcacgacatgaatacaatgacacaatgaaatcacaaggttatgaacagccctaacatcgctcatggcaatggtgcggcatggtttctaagtaatctttgttaattcttaacaaaaaaggaatctagacaccagaacctataatccttgaagccaggcagatatacaagttgaaccttggcacgtaacagaaatgtagaggaacaataacgcagcaaacagcacgagctaaaccctcaaactagcattgacagtacaattatacaaagcatactgaaaataacgagctgtctaagatcccacaaatgggcgacagccaaggatgcaatgtccaatcctagactctactactagaagcccaacattgtgcatagctgttcattctcgcgcaacgctgaaacataaccactaggaactgatccacaatctgaagccagccagcgagtacaaattcaacataacatgcgtttaaatcctaacaggctgtagcgtggtacaaagctatctactcaacatacgaatcctacacatcacaaagaaatctcatggaccaagagcaaaataaccaagccgactactaagctactacatcctagcaggccacgcgccgcacacgaactcccactcagggagagcggggaatggaactaatcccaccgaagctacgaacgagaaggatgccacagatcagccagatccgcagacgcgagagagcgcgcgggggggagaagcataggacggaggagagggggtagggggctcaccatggttgcgaggtcgggctaggtcgccgtgctctgccgccgccgcctgctgcttcgtcctcctctgctccgcgccgcgccgccgccgagatgacaagagtgggagagcgagggttggagaggctatatatactagttggtgtagggttttagttcaccggatttacgagtttgccctcccgctcccctcatgggcttccacgatttattccagaaattacggcccgttttaagaccctcatggctgaattcatggcccaagtagttagatcgggcctagtttggtcccgggttgcttggatcatttgcttctcggcccattagactcttacatggctgtgatgcatcgtgggctgtattcttgcagcttaggtgaagtgacagattttatccaataaatgggcccatgtaacacaattaagagcatgggccgaagtgcagggttgcagcttgttctttcggtgtactttttccttaagataagattacaagcctgaattttacagagcagcacaaaggcccagacctcaaccaaagagagcagaaactgaaatctctcaactctccaaagtagttgttgtctcttctacaaatacatcacacttttgattttaatttttgaaaggagctacatgccgtcgtgagttgtgagtataacaaactcacactttgacttgtataacaaagtcgtttttcatgccatctgaaaatgacattgcaacctgcatatctctagttatttacaacagttggttcacctttgattcaggcggttcaactaggtaggtccgtataggttttgttataactttttttttttgcggggaaacaaggatatattactcagaataggagttctcacaaagcaaatgtgagatagcaatacaagagtcatccggccagaagtaagttaaggattcacttcggcctttatttgctaagaaatgattaatgctattctgagtcctgtgcactttattaagtgcaatcacccttgttccagccatcggggaagattaaggggggaagaaggggcggacgctgggacgtgccacgtcggatttttgctacagtcctacagtaccggggctggtctttttgcgaaaaataagttcaatcacctcgttgactacgcacgcatcagcagacaataccttattcactgacttgatcagctggattgcttcttggcaatcggattcaacgacgatgggcagcagagtccattggagggccagggctattccatctctgcaagctagcagctctgtttctaaagctgatctgcagcgactaatgtggccacagcccaaaatttcctggtggccctcttaacagctggggcaacactcttgtcagctcaaaattcagtgcaatttctggagctgattttgagcaactacagactggcagtaggggttgcgttgaaggatattgagccgaaagacattgttcttggtcgatttcttgccctccaggtcacaacacgactgcatgtgccctgaaaatcgagacgttggtgttccttgttgttttctgcaatcattgcatgttatgttattgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactgtattttatatgtatctgcatattccgttagggatatagattgtcttttgtaacacggactcctccccatatataaggggggtccgggtgcctctaggggcatatgttgtttttccccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaatgggttccatctccggcatcgacgacctcgtcttcccacccgggcagacgtttcggttcggcagcctcgacttcgtcaccaacaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcatcttcaccaacgtcaccagatcaagatgatggggcttacccaccgatcctgatgaagctccccgacgatttggcggccgtctccatcacgacagcgtctctttcccgtaggcctaggcggaagtcggcttcaacaccgatttcgcctagcttcagggaagttggcgtcatcctccaaccactcggcacggtttcgacggatcagctagatggcgactacagctctcctaccgtcgactcgcgccccaccgacatcgtggagtacgacgagtttagctctcgctaccacgacccggatctcgacgacttcgacggaagcctagatgacaactacacccctctctattttggcgtcttcatggccaataacgagacggaggagcaacgccaagcccgggagaccgaagcgcgtcgcgagactgaacgccgccgactggaagaggagcatcaagcacaagaacaagaacggttacggcatgagcagcaggagcgtgagcggaccgcgaaggaggctgaggatcgacggcagcgagctttggaagcaggacgccgggcgcgtgatctcatcggccagcaagatgttgaagggacgccgatttttcgcacccctcaacagaatgcggttgccgcgatcaccctcctcgacaccctactcagggaaagcgagctcaatcaatccgatcacgtcgtcaacatcttgaaccagacgaagactatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggccacgacgagcggtctgttcactcacctcccgaccaccatagggagcgccgagtggaacggcctcgctcaccacctcgtcgccgccccgtcgatcttcgcgacacaatcatacagcgccgcgcagctcgaggctatcatcactcgccggaccgccacgacgatgaccttgacggagtagcagccttcaccgacgacctgcgtcgagtggactggccagccggcttcaagccgactggaatagagaagtacgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcagaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagcttcgaagtcgccgatttcgagacagcataccatgccatactcggacgcccggcattagccaagttcatggccgtcccgcactacacttacatgatgatgaagatgcctggtccccgaggagtcttatccctacggagtgacatcaagcaagccgtcacatgcgacaaggagagttgcgacatggcccaaacccgcgagatagcgtctgctcgagaggatatccgactggctgcagccacggcggacgaaggagaagtgcccgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctggcaaacccagttctagttcggaagaaaacagggcaatggcgcatgtgtgttgattacactgacctcaacaaatcctgccctaaagatccttttgggttgcctcgcattgaccaggtagttgactcgaccgccggctgtgagcttctcagttttttggattgctactcggggtatcaccagatccgactgaaggaatccgactgcttgaagacttcattcatcacgcccttcggggcatactgctacgtcaccatgccatttggactcaaaaacgcaggagcaacttatcaacgtatgatccagagatgcttctcaacgcagattggccgcaacgttgaagcctatgtggatgatgtagtcgtcaagaccaagcaaaaggatgatttgatctcggatctggaagaaaccttcgcgagcatccgtgctttcaggatgaaattaaaccctgaaaagtgcaccttcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagatgatttccagtggggacctgaagcacagaaggccttcgaagatttcaagaaactcctcaccgagccaccggtcctagcctcaccacacccgcaggagccgttgttgctgtatgtatctgccacctcccaggttgtgagcactgtcttggtcgttgagcgtgagaaagaaggccatgtccagaaagtccagcgaccgatttattttgtcagcgaggtcctagccgactccaaaacgaggtaccctcaggttcagaagttgtcatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagttccaagaggatacccccgcggagaagatggagcactggaccatgcattttgacgggtcaaaaagactttccggcactggagcaggagtggttctaatttcaccaactggagaaagattaagctatgtactttggatacatttttcggcgtcccacaacgttgccgagtatgaggccctccttcatgggctgcggattgcaatttccctagggataaagcgtctaatagttagaggcgattcacagctggttgtcaaccaggttatgaaagagtggtcctgccttgatgacaatatgatggcatatcgacaagaggtacgcaaattggaagacaagttcgatggactcgagctaagtcatgttcttcgacataataatgaagccgccgacagacttgccaattttggatccaagcgcgaggtggcgccttccgatgttttcgtcgaacacctttatacgccgacggtacctcacaaagatactgctcaaattgcgggcactcatgacgtagctatgattgaagccgactggcgagatcccctcatacgatttttgacttctcaagaactcccttaagacaaagatgaagccgagcgggtttcaaggcggagcaaactttatgttatgcatgaagctgagttatacaagaaaagcccttcaggaattctgcaacgctgcgtatctttagaggaagggagacaattgctgaaagacatacattctgggatatgcggaaatcacgctgctgcacgcaccattgtcggcaaagcttaccggcagggttttttctggcctactgcagtgtccgacgccgacaaaattgtgcgcacgtgcgaaggttgccaattttttgccagacaaattcatttaccagctcaagagttgcaaactatcccgctgtcttggccgtttgcggtttgggggctcgacatggttggtccgtttaaaaaggcagtcggtggttacacgcatctctttgtggccattgataaattttccaagtggattgaagctaaaccggttgtcacaatcacagcagataatgctcgagacttcttcatcaatattgtgcatagatttggagtgcccaatcggattatcactgataatggcacacaagtcactggcggagtttttaaagacttttgtgaggactttggaattaagatttgctatgcctcagtggcacaccccatgagcaatggacaggtggagcgagccaatggcatgatacttcaagggattaaaacgcgtgtctttgaccggctaaaaccctatgccggcaaatgggtgcaacagctgccatcggtgctttggtctttgcgaactacacccagtagggccacaggccagtcaccttttttccttgtctatggggcagaagcaatgttgccgagtgaagttgaattcgaatctttgcgctttcgaaatttccgtgaagaacgctacgaagaggacagagtggatgacttgcaccggttggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattatcataataatggagtgtgattttttatcaattcaatttgcttacttggtttatcattgccttgttcgatttttctacttagtctgcgaggactgaaagtttttaatagcttctttgggttttaggctcaacaaagcttgataaaagcttttaagaaatcaaagatttggctggaactatcaagcacagcataaatacaccagtattgtacaaattgagcctccatttgttacattcatactcagtcagagtcagtcctttcatcatcagagttattgttgctcggctgaaggtcgttgttgtggaattgctctacaacgtcacttgcaatcttgtcagccgcattttgagcattgttgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattaaggaacatagcttggacaagtggtgtagcgacattggcaacttcatctcttgctccttcaagcctctggatcttaccaaccaggacgtcaaactgagcttgagatttgattttacggtctacaaaacacatttataataagaatctgctgcattaaaaagaggaaagttcagattgtcagctggcagtaccttcaacctccttcaaggccgagtccctttcagcagctagttctgttttgtcttttctcaaggcttcaatttgcttctccatttgagccatcctggtggcttgcgctgtttgaaatccaaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacggcttcaagagttcccaaatgaggaaccagcttttctaaggttgtggtcttggcctcattgcgaagatggattctctgcacggtggttcatggattagttttgctaacgagaaaacaaagtcattaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcgccagtcggctgactttcggcagtcggctggctttcggcagtcggctggttttcggcggtcggatcagcatctttggataaatttgactctgtggcagccggatcaggattttttccagttggatctatatcggacggtttcctgcaaagtgtcctttcggtattcagcgtaatttctatgagagaagcatgccgaaataaaatggtaccgagaagtttatacctggaagatgttctaatctttggcatttgacggccagccagttttttcctgggcatggtatgctttgggagtttattgggcgtgcccttgtccccagatttgttgctgtcatcgccttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcgaatgctgtgcgggatctctctttgattggagctaatcgacacttaatgaaatgccgagtgatttgctctccctgtaagccttgctctttgagcttcagcatgcgttccatcagttctaaggcttgggcagcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgtttggttgaggcttaaggaaaaagattcggcggaacagagcaaaatgaggtctaatgcccaaaaaagcttcacagacatggacgaaatttgcaatatggactatggagttcggattcaaatgatgtaagctgattccatagaaattcagtatcccacggaagaactttgaggttggaagagcaaatccaccataaaagaaatgagagaagaccacggcctcgtgtgtatcgggggtcggaaaagcctcatcgcacgctggccgccacccgatgatctccttggcagggagaacgccgtgcgccaccatctccttcaggttctcctccgtcacgtcggacggcgcccattggccttcgaagctttctttctcttccgccattgattttccccgaatacgttgatttgattcgagggatggcttgggagagatgaggaattgaggcggtggatcacgggaaggattttgatcactttttgaaggtggatttgagtggaatggtgaaccctagtttgccggcgtagctctgtactgtagcaaggagtggggaaaatggcgagagttccggcggggaagacgaagtgtcgcttggatctcgggttttcttgttaagggtatcggaggtgcgaatgggcctaggcctgaatagtatctcagcccaatacttttaacagcgtggcccattgtgttccttagggacttaggcattttttgctttggcaatttatgtacacaatagtgttgcccaatgctgataaaatcctttttacgcggtcatataattctttggaattattgcaatgcaaattaaaaggtgcccgacagaaaggcgttatgctgtttttgtacgtttttttaggctacaaaagctgtctgggttaacttggaatgacttgtttttatcatagtcatttcctcggtatgttatatgcctgttttcattgtggtaaatagtcatagcctaggctattagacttattcattaccatgatttttataatatttggtgggtaatctttagagtcttatattcggatgcctgtcaagtgtgttcattcgtgaactttttagagtgttaaccacttggatttcttttattatggctaaaaagcagtcggctggaatgcctctttaggcgccgtgtatgcttttgtcatatgatgcataattatgctattattttgttctcaactatatgtttagtttgttaactaatcacatagttggaggctatacctaattaggtgcatctattcgatgcaccatattctttatcttttcgccctttacagtcttcgttttcgctactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactatattttatatgtatctgcatattccgttagggatatagattgtcttttgtaacacggactcctccccatatataaggggggtccgggtgcctctaggggcatatgttgtttttccctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttatcttacacttaagatcgatcgaccgggcacacaggtatcgatcgatcgttctttaaacaattgcattattgggatcaattatttgggaaccatttctcggagaatctgtatatccgatacttaaagaaacagaattattggagatacacactcatagctaagctgctgacaatgcacaacaagtgtcaaacagaaacatccaacagcatctcgactctctctctccgatgactcggacagacactcaacttaacttccttgccctcagctgcttcatcaagctagtgacaatcagtttgctcgagctaattaagaaattgattagtccatttgggctactagctggcacctggcaacagcatgtgccaatcattaggctatgccaagaactcaaagctgctactagctcaaatcagtgtgctagctagctaaactccatgaccatgaccatgagagagtgagcttgtgatgggatgaggttagatgagaggaggagattccggatctccatgagtggtggggctgagcacagccaccagatagaattatttccttggggcctacagtgtcacttttggcccccaccccaccatggctagctgacatggcatctacaaatacagtacaatatatggcgccaacttcagatcagcctcaaactcaacatgtgatgaggatagattgctgatgtgctgtattgctattctagctctatcaatggcagtgctgttttgcaataatgttcatgaaccagaagatccagcagcttagctagctcaataatgctactagttctgaattgcctagctcgatctattggcggcattcactgttggtctactggctagggttgcttcttgtcatgcgagaggccacaatttcttgaagaaaaaaaaaagaacgaaccatccacgtggagtaaaaagcaacgacgacgctttcatcacacaagaggacatccttatttaatttgagaagcgaccattggaatgggtggaataaatcgtatacgttctacctgccaagatgcacgcgtgaatctcactctttaacattattattattattatactaatccacgtgtgttttgaataatgcagcaaaattttcaacaggtctgaaggtaacatatagccacgagtttggagaagatgaggggctgatgagatgtgatgtctagctgcaatcggcgacccatgagccagctgatatatcgctcatcataatcacattcatattaattaaatgactaattggcaggctactactccagttaatagaatgaatgaatcgtgttttttgatgccacgtcgagaccgaagtttgcattattgcaacacgacgtccgttagttaggcgcgtatatgtaactgtcagcacccatgccatatgccagcactttaccttcatctcatcagctttatatgcatcgaattgctgtcacaagtcacaacatcaactgctactatacatactagctagtaacatggatgtctgctaagagcatcccagcagctcattcaaatttgatcctccatatgctcatatggatgaccatctaaaaagattcctcattcatatttcttctcactccaacagatcatctatattgcatctttcatatcacacccttctatattttactaatatttttcaactaaccatacatttgtattattttttaaagactatattttaaacaactaaattttaaattttaaccgtgttatttatcctgataatttaaatgagtttattttaatgaatatatttttaatggtccggaccttttttttctcctcctctctactcgttttctttcctctttccgattcctcttcttctctcctcttctattcctcttcttcttctctccttttctccccagcgtggaggcggaggctggcggccgcggcagcgcgacgggagcgggggcgctgcggcgcgacgggccgcggcggccgacgggggctgcggcgcagcggcgctacgggctcggaggcgcggcagccgacgggcgcagaggcgcggcggcgtgacggccggcgtgtagaggcacggcgacgcaacggccggcgtgggttctccttctagatctggtatgtctctccctctccaccctcactccatagtgaaaaatgcacatccggacggcgacgacgacgacattggggaggtcgcggcggaggggaggtcaatccggactccggatgggggcgggcgacgctggcggttaggatggtgtgaggagagagaaacttcaaatttgacgtttctctctccccggatggaggatagctaaatttggatgctaggatggagtatctgctggagctcatttttcttctcccaacctctattttgtggatagaggactagatggagtatctgctggggatgctctaatatatactatatgcactaataactccaatataggaaaacacgtttctacatacatatatataggagcagtgatagtgattactacatgattacatgtatgcatgtagtactggaaaattaactgaacagagtgacccgtaacaaaactgaacgaaataggcttggtttagttcccaaaattttgttcacaaaaacatcgtatcaaatctttggacacatatatggagcattaaatatagataaaaataaaaactaattgcacagtttgcatagaaatcgtgagacgaatcttttaagcctagctaattagtccatgattagtcataaagtgctacagtaacccacatgtgctaatgacggcttaattaggctcaaaacattcatctcgcggtttccagacaagttataaaattagttttttcatttgtgttcgaaaactctttccaatatctggttaaacatccgatatgataataaaaaaattttatttcatgaactaaacagggcctatggcagattgagcgcatgttctcctacggcgaagcaccatgcatccatgttctcctgtctagctattggcctcaagatgcacgtacggattatcaaactgatccaattcaatgtactgttagcctaactgcctaacactagtccatatatatttctctgcttttccctccaatcttcattcacatgacaaattccggtaagtctttgtgtttacgcgtgcatttctaccatgcttatatgtaccatgtttcgttttatttccagcctggtttctttcatgaaaatataatgatacagatacaaacaaatcttataaaaactcggtttcaaactcttttttatataaaaaccggtgtggctgcatcttaaaaaggattatatcttgaaatagtaacaaaaagaagtataatatagtgtgtattacgggcgacgacaagatgggttgattacattggaagtttatagcgcacgtcaattagggcatcctcaatgtttgtggtgtaatgtaaccttaaggtgggccctataaatagtgagtcattattatagccatacccacaatgctatggttaaaatttagccacaagatggcccacttagaatggaaaaataattgtttcatctcttgttcatgaagtgaatgagagagaaaaaatattttctttttgtttgtggtagaacttaagcataaggtgtaccctaagctaatgctactttccacaatatatatggctcactttacaaatataatcattgccttaaggtgtcgtatcggatggcttgcctaccaatctgcctagtcagcatcgaccaaagcacaaacacgtgtcgcgttggaatcgatcgcctaattaatgtgtggctcccacgctcacgacgacgtggcagcagcccgcctgcctaaatgtccggaagcaatcacagccaccattttccacttcccccatcaatcatcaattggatgatgcatgaatgccttccttttttttaaaaaaaaagaaataaagaaaaggcaaaagctttgccttgtagtaggaggcatgaatgccttctggtatcaattcttcctcaacaattactcctacctatctgcaaataaaataacaatactacaagatatcgattgaagtcatttctcacatctctcttatataggtggtgttcttttcttctaaagataaagatgaagattaagtttttttttacgtaaaatgagatgatattaacatatggtagattaagttttaattattacaaacttaaaaaatagattaatttgatattttagagtaactttcatatagaaagttttcgtatgaaacgcaccgtttagcagtttgaaaagtgcgtcacaaaaatcttaatcttcatctaactcttgttggagaaaagaacacggccaaatgttgatgttcattaacaccatagtatataattcccatcctaggtaagcgcacacatatatatactacatcacattttgtattgttctactccaacttgcttgaactaattaatggcaatttactccctctatcatcattagctaaataaaagacgcgaaaaccaaagacaataaaatctctatggttttaaaattaattctcatcgatcaaagtgctctatcaccgtgtcccgcggattttgcatcatactttaaatattggatggagttgcaccatcagaaattaatcttggatagctgcatatatacggtggctgcatgtgtagcgcattcaacgacgtccattcactctttcacaaatagacgaagagagacccctattatatgatgattattttgagaggatcacaaaaatattaggtaaagattatacttggacgtatttgtataatccgcatcagtgaagctaacaaccaactccgcatcactaaaattttgtcacaaatttaagaacttatggttaatttgtgtttgtggtgttttcgctctttgtcgttgataggctagcaggcattccttactagtcaacatttgtcgattttgaaatttgtggccaaatcattactgcaacgaaagaaagcttttcatttttcttgcgaatacaaaaggtggtggaagaaagaaagaaataaggaagggagaaaatgtaaacgttttactaattaatttgcttgtgcggcccaattaatctgttggaaaccatcgccatcaattcagaaacaattaacaccagatactacacatgcattgtttgtgggccactgaatcatctgaacaaaagcaaattcattttcataccgagtgaaaagagggagaaagagaccgtgcagtgtggttgtgtaagagataatccgataatatagctagtgacttggcacaaatttcaggccggagaactattccaccacgtggttgatctggtctactcttaatttcaagccaccagctaatttgttttggattggccagctactagactggttgatgatttaccactactactttttataaagagaaaggcaaaggattactttattgataaataaaataaaacaataaacattcaacagataattgccgtggattatatacttgattatggggtaaattaaatattttgagaaacaaaccaaataaattgtagcttagaacaagtggtgtaaataatgcagtagaaatcttttcagaggcttggtgcaaataattcatgacaataatttgacaaattagctgaaaagaaaattaataaagggccnnnnnnctgaactttgacctagcgaagagacaacttacggacctcatcttttcacttatgcttatgcttatcagacaaaattttaatttttaaccttaaatttgaggctgattttgaggttttttcatcaaagtttatttttcagcctttgcttttagatcactaagaacacgtacataaaagttttattcacatgttacttttcgttatctcattatggttcttgtccttagttagttattacataaagagagtaaaaatggcttatacacatatggctgttgtataaatcattgtgtttcctgtggtaattatactgtggagtgaagcacagtcacgagttttcactccaccatcgtcgtggacgtacgtgtggtccatagcatatgcgttttgatggctccaatatatacattcagtagtcttctcttccaatcgtacgcgttgcattattgtacttggttgatttaatgccatttcatatccatatcacacgtccgctagctaaattaacattccaagccgccgcttcccccgtcatagaaatgaatcaaatcattctatcaactgaacttattatatttgtgccgtgtgaggcattatacatgcgaaggtaactatagatatcattactggcattgtgaccaatgcaatgaactcgatcgtaaggtgagataacgcatatataatttgtagactatgttactgatgatacatacatattcgatcagcagccagcaatacgtacagttccttttctgaatatgtttgtctgaagattgtgtgtatgaaagtcacaggttaatctactccatgctagcacagcagctagcatgcagcacctgtggtttgggttatcacaggtggacatttgatcgatgtatccagaatgtgcagattaacgaatgaaacagacatgacatctgctcgctgctgctgctagtggtagagatcgatcgctgcagctgcatcgcatctgcgatcgatcgatccagtcggctgaaggcacatgtatggcgatgcgatcaccgaacgaggattctgtctgctatcagtctcagagctagctagctaactgacgacgaaacagcaaatcaataatgctagctatatagctagtgccacttggcataacaacaacgatatgatgcagagataaatcatcatatatccatggccatggcttatacactgcccatacaggaaacggagtatatggtcatcaatcaatccatcgctttctcaagttagctgaatacgaagttggcaattactattaattactagtttctttttttcttaggtaatggatatatataaaaatagtggctggaaatagatggtagtcgttgccctttattagtctgtactattttctgttgtgttgttttcggtctctaacgtgagagcatgtaggcaggatcagggcacattttgtccaatttcaccaatgtgtgttttgcttgtagcctttcgatcatttcatttgcttgctgaaaagaacaagctagccatgcaaggcaacgaaatcaagagagactgagagaaagaaaaagaaattaagaaagaaagaaagaggaaatggagggtttgcttgactactggaccagcagcaagcgatcgacagaagagcacaagatagacttaattggcagccatcgtcgattcgcaagttaagaaaacgccgataaattatttgtgggccatggaatcattggtgcatctcgacaacaataattcactttctttctcttgtccatctcttcttcctcttctctttcagagagaggacagagacagagagtgaagagagaatccaatagctgtgacgtggtgcgaaattcaggggggagaagagctcaaaacttcaccaccattaagtgtcaccttccctccacgtggctggtctgcccttacatccatcatctacgcattggccaccgattgaattgttttggatgatttaagggattggtgagggatagaactgagttcatgatagttattatttcgaggatttaaatgaatgcagtaatgaaattgcggatctcctgcttctttgaaaaaaaaaatgaatgtgtcaaatattactccctccatttcatagtataagttattttgattttttttcttaagttaaatttttttaagtttgaccagtttatagaaaaatgtaatagttttttaagaaaaaacaaacatttcattaaaacataattcatgttagattaaataaaactaatcagtgctttaaatattgctaaatctatctataaacttaatcaaacttaacaaagtttgaccagaaaaaaataaaacgaccaatagtataaaatggaagaagtagaaagttaataggtcgattttaaaggttctttttcatagcgtataaagttctctagctaagaactgatgaggatttttttaaaaaaaacataccgtttagaagtatggaaatcatatctatgataataataaaggagtagttatatttatggcgtcatattttttactgaaaaataattgataggctagagcagtacctaaatttgatggggactgaattgagttactgctagtacgtcctgactcatcaacatctcatagctagtagctaataaggattccggccaattggttcaaggtgtgacgagcggttgatgcaaggcgtagagtaaacgtgatactccctccgtagaaaattatagagcatgtttatttggaaaaaggtatcattctttaactattcgttgtgcataagtatatttataatatttatggaaccaatgttttatgaaagctttttgaaagatgaatctgttggtataactttatgcactaaataaatatacctgtagctagtttggctaattgatcaaaatttacagagtttgactttatacatagcattgtgttccttgtgctgctaattaattaatgagtaaattcaataaaacttcatatattatagtctaaattacacaaaaccacaatggttttaacacgtggacaggaaataaatactataggtgccggttatatcatttccagcacctataatgccgacttgtacgtctttatatagtagtgcaagtatatattatggtcgtaaagttttacaaactacactatcaacaattttgactttgatttaccatgcatacattttttttctacaatcacatgttaaatttataagttttttatctatcatataagtgttgcatctgctttttaaatttggatacatggtgtatgtctaaatattaattgaaggtcaacctataatactcagagttatatgccatatgtttgtgtaacttagattataatgtgcaaggttttatgaaattgacttttaattagtcttctactaatgttgagtaagcagctagcctttttcctcttcattaagcaagccactatataggtaaccaattcgtgcttttgctggccttctgtctatgttactccaataaagtttggtagcgccgccgaccagagcagctggctaataaaattaaagaataacaatatatcatgcatatatatattagtagtagcatattagaacttgcaaattgcaatagattgaaccaggattttggaagggatcgatatataaatatcgaagctagatccggacaaagcgcatgttatataattatattacacacgcatgttgctgagttgcacaagttaaccatgcattcttgtctctgcatatacacatacctgctaactgcaatatataataagccatagtatatacatacatcacatgaccgattctctgttggagatgcaaatcaaaacatgcctgacatttgccatggtataatggtgtgcatgttataatttggcaaggcattgaaactctcattcaggtagtatgtgtacatgaacagcatgcagagaagaaatttaatatatattaattagtataattattatacagatttcacagctgagtttgatcgatgcatgaactgtgtatatctgtcacggtagtgtgatgaaatatatggtgggggcatccaaagccagcccacatgtcagccagctgtagatccatcgatgctatgatgcatatatatggactatatatactcgctcgaattaattatgcgttacttatttttctctgcgcgtttaatcaaacactattaattagtacagtattaaactagctagctagcttagacagcgtcacctccatccatggtggggtagctgcgtacatgtgctcctgctttagctagctcaaactagtgcatctatcaacacaacactaatcatagcatgccgtcgacgccgcatttaattatagaaaggactgcctaaccggccatctcttgacagaaataaataccctaaaatcatgtgaattctaaaccgttagatcactatagatctgtacagctatattcttctctctcttcaccgctaactctgtttgagtgcacgctattttcgacattgagcttctcaatcctctaagatagatccatctgtcaccgcttcgcaggcgccaaaaaagcctactagatcaacctcctctcctcctccgtgagcggggtgtcaccccgttgtcttcctcgtctccaacagctcctacatcgtcacccgcctaataactgattaggatctctcacccccactgtcagccctatctgtcaccctgccactaatccgtggcttagatggtgtggacgttgcctcgtcaccctcccgctctgcagccaccaaacattccctctaaccctagcgaactttcctagctagcccccttagaccataaaccctaactgatcgatccaccgctagttactgtagtgggagaatcgaggagccaccgctagaaatcccccctccgccttccaatacttacggaatgaattaggttagcaactatgaatcacaataagttagagcacgtacttatttttatttataataatgaagtagcgggttttcccgcgtaatttaaaattacgcgctaaattctaaaattaaaaacgatatttgacatataacaatgatttctatttctacaaatatgactagctagcgtttatatacaactataccgacaaaacatctaacattaacttgtatttctaacaaaacaagaaaaaacaccatgaaatttctatgtggcccgggcagtgaagcatgcagtgtgtgacgcgggactccggtgagataggcgaggaatctcctctcgtaagattcacctactcttctctcgtcaaattaacagcctatcgatgatcgattaacggaggctggcaactgggccaaataggcgaaacaaccaatgggcccgcgccacgtgcatccagcatcaatccaccacataataataataactaaataaaataaacaaataaattagtgatggatccgaactctaatactagtattagcaatacaagaaatagaaatagcaattggatcggaggcactataaatacatcctccgacccctcgccaatcccgcacacaacgcaaacgcaaactaatctcctcttctcctctcctccctttttctttcttgtgctaatattatatccatctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcggcgcggcgggtggggaggcgttcccgtggagcaacgcgatgctgcaatggcagcgcaccggattccatttccagcccgagaggaactggatgaacgatcccaacggtacttaatttctttgcattttttttcttttattttccttcttcgatcgatcgattgattgttctcatctcaattcgttcattccttccgctctgttcgttcgttcttctagatctgacaacattcaaatgctattaaataaattcccattttggaggaacgttttatggttaagattcttccagccccattttcctttttttttatttatttttgagaaaagatttaaaaataaaaaaggaaaaccgagatacccttaagattccaaccgcaccaaccgaccaggcattgtagaattcgaattacaataatttttagatagataaaattcaaattacattatataatcaaattaacattggaaatgcaatgcaggtccggtgtactacaagggttggtaccacctgttctaccagtacaacccggatggggcggtgtggggcaacaagatcgcgtgggggcacgcggtgtcccgcgacctcgtccactggcgccacctccccctcgccatggttcccgaccagtggtacgacgtcaacggcgtctggaccggctccgccaccaccctccccgacggccgcctcgccatgctctacaccggctccaccaacgcctccgtccaggtccagtgcctcgccgtcccctccgaccccgacgaccccctcctcaccaactggaccaagtaccacgccaaccccgtcctctaccctccccgcaccatcggcgaccgcgacttccgcgaccccaccaccgcctggcgcgacccctccgacggcgactggcggatcgtcatcggctccaaggacgagcaccacgccggcatcgccgtcgtctaccgcaccgccgacttcgtcacctacgacctcctcccgggcctcctccaccgcgtcgaggccacggggatgtgggagtgcatcgacttctacccggtggccggcggcgagggggtggacatgacggaggcgatgtacgcgaggaacaagggggtggtgcacgtgatgaaggcgagcatggacgacgatcgccatgactactacgcgctggggaggtacgacccggcgaggaacgcgtggacgccgctggacgccgccgccgacgtcggcatcggcctccgctacgactggggcaagttctatgcctccaagaccttctacgatccggccaagcgccgccgcgtcctctggggttgggtcggcgagaccgactccgagcgcgccgacgtcgccaagggttgggcttccctccaggtacaccttcattacctctctaaactattttaagtttaactaagttcatggacaaacatatattaaattagtttcatcaaatcaataattaaatatatttttataatatatttgttttgggtgaaaattttactacttttttctataaacttagttaaatttaaagcaggaatttgactaaaattaaaaacaacttataactcgaaacggagggagggagtatatattaattaatccagctactactagtaattagctagcatgcatgattagctaggcatcattggcatgcatatgtgcacttttactgggctccattgacacgttggatcgacgaacaacacgtacatatgcatatgcctgccggagtgtagcgtagcaatcaaataatggcagccacttgtgaagagcgagagagatgacgcgaacaaacaaaaagcttgtcatgttggttgtcaaaatgtcgcttagcttcatccaggaatgaatgcggatatcctgttggggccccactgctcagctaccgaccggagcaactgttgagatacccttttttgcaataattgacataataaacagatcgtattattattggttgatggatggaattgcttgtgtccaagctatagtcctcctagcaactgttactactagtaggaatagctgtccttgcccataactcatgtgcaaccatgtgctgtagctgcattctgcttgtctttgctgatgctttgcctaactgaaatcatttgcacacacaacttaactgggattcatagattgcaaccttttcttttcaccagaaaaagggctgtcttttttgcttgcttttcaatataattccaccgctctcattttctttgctgtcacagtactgatagataatgcaaaatcgcttggttcatgtgaagcaagctatagtaataataattatgattaacatgtgtaattaaattactggagtagtagctaattagtaaaaataaaaaaattggcatgcagtcgattcctcggacggtggagctggacaccaagacggggagcaacctgctgcaatggccggtggaggaggtggagacgctgcgcaccaactccaccgacttcggcggcatcaccgtcgactacgcctccgtcttcccgctcaacctccaccgcgccacgcagctcgacatcctcgccgagttccagctcgacccgctcgccgtcgacgccgtcctcgaggccgacgtcggctacaactgcagcaccagcggcggcgcggccggccggggcgccctgggccccttcgggctgctggtgctcgccgacaagcgccaccgcggggatggggagcagaccgccgtgtacttctacgtggccaaggggagcgacggcggcgtcacgacgcacttctgccaggacgagtcgaggtcgtcgcacgccgacgacatcgtcaagagggtcgtcggcaacgtcgtcccggtgctcgacggcgagaccttctccctccgggtgctcgtcgaccactccatcgtcgagagcttcgcgcagggggggaggtccacggcgacgtcgcgggtgtaccccacggaggccatctacgccaacgccggcgtcttcctcttcaacaacgccaccagcgcgcgcgtcacggccaagaagctcgtcgtccacgagatggactcctcctacaaccaagcctacatggcctagactcctctcttcttcttcttcttcttcttctccattattacattattgctgcttacttgtaaatcatttttgacgccgccgcctgctgctagctgctggcctggccttcagaattttatctctttgcttctttttttttttgtctctgctttaattttgtatctcgatcgatctcgaccgatcgattaattactatatctccatgaagaaatgcatggatgatggatcatggatggatcgctcccttcgatccaactgtacctaggggaagaagatgccatggtcaagcaatacttctgtaaatgtttcacatgagtcaagatttatgcagagttataatatatatgtttctctctccctccctctttgcaaacaaaaagtatccaaatgaagaatcctctcttaatttgcaccaagatagagacacgcacaaaaagagtttcgcggcccgtgatagactgatgcttcttacatcttgctggcctgggttgtttgcctttttctttttccctgatttctttatatttgttttcagcccgcaaaaagaaatacagaaatgcacatgcttattattctcacatggatgcaaagcctgggacgtggcaaatgtagcacagtacatgcttatacagctacaaacaatacatgcatagatcagatttttgtcttctgctttatgttttttctacaccgtgttgagtttaatatatcatgttcttgacgagccaaaatacaaacaaactgccgctggaactgttaaatgccaaaagctgctatttgcagcatattaagggaactggggaggcagctagctagattggttagcagctcagcatgagtatcatcagtagtatctcagagaaatacatttcaatgcactgtggacacataccttcattgaacaacagctcagcctgacactgcgcatgctcacaaagggaataagggaaagtcaaattgcaacttcataaccgattttgaattaaacccattgaacacgctcatcattcgtgcatcctttctttcattttctgtaaggatcagatgatgaccaaattagatgagaaccaactgtaagattttttttttcgaggggaaggtcaggagttctgccgatttcaattaagtagggggaaaacaaagttttacaacatgcaaagtccagggtttggggatcccttggatacaactgtaactgtaagaatttccagctgcaattagtttttcttaaagaatcagatgacaaagaaatcagatgaaagcacctcatcagagacgtacaaacattatcaggtagcactttctgacaacagaacaaagcatggattaattccctgccaagactggtgccgagtaatttccagatatcatcgagccattggaaggagtcaaaccaatagtaacactgcagatgttagatcaatgatttgaatcactttgttagctgaagcacactgttctcattggcatcttcgttcaacaaactcaaggaagatctcaaattcataagtggagagcctgttcaatcggataaccacatatatcctgcgcatttttacaattcgtaaccaacctcaaatgttcatatagatatatcaatgatttgcactaagaaacgaaaaatgatcagcttatcagtactttgcatctgctgtcaagatcaatatgcaagccccacaggaactactgcaaccactgggaataaatgaaatttgaaactggtccacttgaatcgcaatcacttatctgaccatatcagagtgtggtgtgttcataactacacatggcccatttgccttttttaaaaaaatgcacgcacataatatacattctaaatgagtttttgcagttccaatttcaatcaagattgcctgaactggaatattctaaagaggcataggcagcaaaaaggtaggcagcatgttgctcacaaaaataatgatgaaacgaaaacaattcattgaatttaagtagccaacgattcttttacttctatcatggagcagccgtttagcggaacaaggccagagacagagatgtaccaagccctctggagagtcgcagctttcaaccagagaaatgctctttaccatccaccggtgatccaaagaaaagataacacatatcctgggttatcaccacttcaccataaaaatgaaggatttgggactagcaccatggtctcaaaaaaaagagagagaggctatttctgacaaggtcacttcacaagtcacaagatatcttcatctcaatggtgtatgttcttgtcctctctggcattttatgagatattgtacttattttcaattgcgtgatcttactgtcatataactgcattgtgactttgtgaggtggttcagcacaaatttccatctttatatcaagaagacatgaccgccaacacaaactgctataaagcaaaagggtagtgctgcatctgcatgtcaatgtgtccagttttctaggcagtacacgaatttttcaattatttggtttgccattctccttcgtctctctctcagcagggatttgaacatgaggcagcgaccaccatacttttcttcatgtcaaattaatgctagaaaatgtggattggcacttctgctgtgctgtcaaaacttgcctcccaaccaggcaaccaccatgtaactaatttaacaaaggctaatcagaactaccttcctgaaacacagaattatgatttcataaacacacctcttttcaaccctgcacctgcagggaacatgagaattcttactttcaggtgcagactttcaggaaagccaaagaatctgatctaaatttgaccttgattaacccttttcctttcttcaagtaggctgaaaactctggttcatatttcatactagaagaatgtgggggtgtaagctggattgacaggatgattaccagaagtctccgcaagagcacgtgccattgttaaacttgtgaaatctgacagcatccctcacaagaatatcacggcaaatctggaacgctaggaacgatttgaatttcaaatccaaaaaattgggaacctctgcaggtatgccatgcagctcaggcaatgatttatgcatatgagaaagaagcaactttggaagaaacaggtaatactgccaacaaggaacaacagcaagtagaagtcacaaacttatctcccatccctgcaggtatatttggtgctacgttgattgatttgtgtgtggataacaaaacaggaattgatctttttgtacatgatccagttatcccaggctgccatctggctaaaagctattagtgtgaattctacttccccttgcaggctgagcttacagatctctgggtagccttaaaaatctgcagtcttctcagcttggtgaatgtgatcttctcactgataacacaacaattgctactatcttcaagcaaaataattttcaggagaatctatgatattggagcttgaggccgctcctatcaaaatttcaacaaaatttgcaggatcagcaattgcaggtcaaatggattcctacaagggcaaatgaagttgctgataaacttgcaaatgaggcaagaaggataagttgttatagggctagaactttcagtttttgtcacaatagttctcatgtttgctatcaatctagatgcccaaatacaagtgcccttgtaaacctctgtcttgaagagcaaaacataatgcatgtattataatagaagtcatgaattctaaagaaagagaagacttaaggttgttggctcaaataagaattgccaagatgttaaaagaccaattgccaagatgtctatttgagaccatactcatggccacatgtagtgcgcaagttgcataagttcatcaaaacggcgtagcaataaaatttaatgacggttctagtgtcctgtggtttttcagaagataataaataacaaaaaagggcttatgcttaaaaagcagccaatttacttggaaactaaagtttctaagattcgttttttagggaaatcatccaagaaagcatattagtttattgcaaaggaaagcatattagtgacagcagtaaatagctatatctttatgtatttctgcagaaatcaatgcccaaggtcatatgaaagaaatcagcatataaatgacaaaattgatattgataggtgctggaagcctcaaattactttatcccgttggtgcttctatacaatatgatcctaccataaaagcaaaaaaataaaataaaaaataacagcttgagacctactcttttcattgagtagtaacactatttttttatctcatgggtggtgtgattaagcttatggataagaaattaataagacattgacataaatgtagcacctgagtacctaacaataatttaaaactaaaaaagaagaaatatatgcactaaccgcaattgtgtgtaccaactattttgcatccatgtacatatgcggttgagtttttctagaattcgactacctaggctgctgctgcgagtgtggtgtatcgatcataatttgcaggttttagtccttgcagcctagccaatgtctttgagtatggatagcgacctccttgaactcctccctcgaaagccttctttgaagggtgagatacacaagattaccctgagataaaaaacttgttcagtaaattagcaaatatatcatgaggcaggtgtgtgtggatagacaataaaggtacagtatatttagtactattcagatacatggaaccagtcataatgcagtccttaatatttgtcgtaaatatctgactgattctgacataaacactgtcaagcaaagaagcatatggattcaaagcctctttttttttgcaaaataattcaaaatgatatcaaccggttttgctaggcaaatctgagttgagtaggatttcaaggaacatgtcctctttgagcaattttatagccaatttagtaaaaagctctcatcttatttacatttttaagaggatatttctatgacaggcattacattggatcatagaaggaatcaacgagatgctgacctttcttctcaggaggtgatacttcccttttaccagtgacattttctgctttatgaactacagagtgagctaggaaatgcagcagtagcttccctccctacttcatctactgactgcactaacggatccaagcaagaaaaaaattcttccttggagatattatgatctatatacttggattgaactgaagaaatttacagaaaaatgtcagtgcaaaaaaacaacacacagaaaaactcaattagagaatggatatcagctattgagcttgcaaagtgagaggacctggatggctcaaagccaatggctctgaccggaggagctcgcagcgatcccttctcccatttcaggaaagccaaagaatttgatctaaatttgaccttgattaacccttttcctttcttcaagtaggctgaaaactctggttcgtatttcgtactagaagaatgtgggctgtcagctggattgacaggatgactaccagaagtctccgcacgagcacgtgccatcactaaacttgtgaaatctgacagcatccctcacaagaatatcacggccagttatcttagaaatgaacttggtagcattgtgacaatccacacatacccgtagattcttgacaatccgaattggcatttcttgtggaacaaagattaagccaaaggcaattgctagcttctcgctgtgatggctaatcatgtgaaccttatcagcatctgccacatcatgcagcaccgagctgacatcaggcttgtatccttcttcagccatctttgagttgagccactctagcttttcgtatattctactggagaaggggtgggattggtcatcggctgaaaatatgtgaactttgttcttgtacttgatccaactgcagcctggttccttcttcacctgcctgtccctcattccacgtctaagatgagcgacttcagtccattgacctttagcagcatgcatgctacacaacaacacatagctggcagggttttgtgggtcagtttccaagagattctcagctgcccacttgccaatctccatgttcccacgcagcctacacgagctcagcaatgttgcccatccaaaggcatcaggactgtgtggcatctgctttatgaattcctcagcctctttgaacctccctgatctactgtacaagtcaatcatacaagtgtagtgatcatctataggaacaataccgtggtccttctgcatggaatcaaagtagtcgcaccctttctctacaagtcctgcacggctacaagcagaaaggacaccgataaatgttaccccatcaggcttcaagccatttgccaacatcttctcaaacaaatctatagtttcttttgccttcccaaattgagcataccctgtcacaagagcagtccaggagacttgatcgtggaaggacatctcatcaaataagcggtgtgcatcctcaatgctgccacacttcccatacaaggtaactagtgcattggacactgtaatgtaccgcatcaaccctgagacaagtgctaggcagtggaactgtgcaccctcttccagacttgctaaattagcacaagaacttataacactgcctagagtgaaatcatcaggcttaatgccatccatttgcatctctgagaatgcccggacagcctcctcactgcaagcattctgtccatatccaacaatcatcgcagtccacgatatgatgtttctgcatgtcatcctcctgaaaacagcctctgccaatctgatgctcctgcacttggagtacatgtcaacaagcgcactcccgacaaagacattatcttcataccaagtccgagttatgtaggcatgtatctgcttcccttcttccaaggcagcaagggcaccgcaggctgtaagaatgcttccgaaagtgtactgatcaatgccaacaccctctgccctcattctcctgaaaacatcaagagcctccaactgcaaaccgttctgagtcagtcctgtaaccatcgtagtccaagtaatggaatccctgtccaccatcagctgaaacaaaccctttgcatcctcgatcatcttgcagcggagcagccctgtgatcaaggtattgtacatgaccacagtcttggcctccatttcttgaaacacccgcctggcatccctaatgaggcccatcttggcatacatatcgaccaacgggctcccaacgaaagcatatgccccgaacccaagccgcagtacctggcaatgcaccgagtggccaagcgcgcggtcggagagagccgaagcgaccatgatcatcgccgacagagtaatccgggttggcctgacgctctcctcccggagcagcgcgcggtacagctggaccgaccgggcaggagagccggtgctggagaagccggtgatgagcgcgttgtaggagacggcgtcccgctcgggcatcgaggcgaagaggcgctccatgtccgggacgagccttgagtgggcgagcgccgagaggagggcgttgcgggtgaagaggttggggtcgggcatttcgtcgaacacgcggcgggctcgggcgaggcggccggacttggcgtaggcggtgaggaggtggttgaggaggaaggttgggggagcctggagaaacgtcttgagaatgaggcagtgcacagcgccggccacgcgaaccccggtccggccgccgtcgccggcggcggaggagaggatggcggcgtagcggttgcatagcgcgtgggcggcgtgggtcatcgcgcgtgggctttcgcttactagactagaagtgcccgcgcggttagcagataagttttcgatcgttcgttttattaaaaacttttataaaataggtaaaactacatgtatacataaaaatatatttaacaataaattaaatgatatgaaaataattaataattacttaaattattttaataagacgaacggtcaaatattttttttaaaaaaaaagtcaatagcatcgaacgttttaggatggagggagtactattaaaggccttcacatcaataaataaaagttgggattgtacttgacagtagttaacaattcgggaaagcacaagaatgcatatgcaaacaagcatcaaattgggcaaacatctttgtgacacacaaacataaaataaacaacctggccactagcaaattgacacgacactaaatcaagaggagggaaaaatttcaaaaaaacagggaaaaaggaaccgtaccgatcttggggaattttatgattcgcgagcttcccctgcaagtactatggagaattttttttatttataatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgatttttgcctctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatataagttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtatcgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcagggggggctgcaggaat

SEQ ID NO: 58640 - DNA, 719 bp, Oryza sativa
aagtaattattaatttttttctatcatttgattaattggtatatatacttttatgtttacttttagttttacatatttcacaaaagtttttgaataagacgaatggtcaaacatatttaaaaaagttaatgacgtcaaacatttaagagaaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacaatgggtataaatacaagaccctctaggaggagagggggacgg

SEQ ID NO: 58641 - DNA, 549 bp, Oryza sativa
gactatacctgcccacttaacttctctgaccatgcctgcagtaaagcagcattcttatgcatctcatgctcatcaataagagccttctcgatttcgtttatttgcctatcattcataatggttcgcttccttctcttaggttgtctctcatcatacatgtgagtgtctcctttctcatcatcctgaagaccactttcttttctatctggtgttttgaaatggtccatactgctggatgcaggatcaagatccattttgcagcgcagggatcctgtacttgtactggtacctccccctagaaagcctgaactagttctcgccacaccaagatggactaagtcctggccgactgaattctgcaggaacccaccatttaaagcgacagtgcttctaggagtctcatccctggcatttccctcttgctttgttgaaggtgttggtgcaagctcttccatgtttggtggtgtaagctcctccatgttctgcacatcatttttggtgggatcagatgaattaccaagtcaatggctaatatattatactcaacat

SEQ ID NO: 58642 - DNA, 10071 bp, Oryza sativa
cgtcgtctgcgccttcgccggctgctgccgctggccggtcgccggtcgccggccgccgccgtgtgccatgcccgggctggccttagcgccgcctgtccccagccgcccgatcagccctcggccgattgtggccgtccatcccatggcccgcgtggccagccacgtggtgccacgtcggcgccacgtggtacaccaccacaccggccccgtggacccggtccacggtggaccaccccctttgagccgctgacccgtgggccccacctgtcggcgctgcccccccccctcgctaacatcagccctgggtattattgcgcaataaatcgaataaggatattcctttattagtaaaaacacagtttatcttctaaaattcataagtaattcatccgagctccgtttaagtccattcaagtctcagtaaattcataaaaatccctagaatctattaaaaatggttttgtttcctctttcagtagtcttatagcatgttttgctgtttgtcgcgtagatttcggctgtttcgtcgatccgcggtttcttgaagacgttgctgaggtctcatcagtgcgagagcaaggcaagtcatgcattacaattgatcatattgtacccaatttacaaatatcccgcatttctattaaatgttgcattcttttacaatgtcacgtgggatgggtcctattactcagccatatattgattaccttatgccattgataacttgggtatcaaaatgactagatgttggtttaggaaatgcttagtcatgcttagctcaactagtacacaaatggggatcacattattacagactttgactattagcatagttttggtttggtgccaccgtaatggtgttagttaattaaaatacactgattggtgggctgtgggtgcatggttttgctggtcgcactcatgacaattaaggaccggttcacgggaaaccctgggagacttaccgtgcttaccacaagcgggagtgggtaactgcttaatctgaagtatagctcgaccctttcctaggcaccggtggcgagggtgggcgtaatggagttgggtcagccggggtgtccggttatccagctgccggattcaccatggtgcaagaggggaccgcccactgccttttgaggggtagggatgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtcttaccctagtttagcttaatgaactggtgtagttcaggtggttggttgggcctgttgcaacgtggtgtagcgttggacagtaattggttaatattgattaattactacaactgttttactgctttcaacttctgattttaaatgcctgctttatgcaaaagaacctttagcctcctttggatatatcctgcatcatacctcctcttccggtatgacttgctgagtacagtgggtagtactcaatcttgatctcttttcccccacaccagagctaaagattttcctagtgggagctgttttgtcgaagttggtttcgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcgtttgtgtaccctggctggtcctggacaaggatttaatgcacattcagcttagaaattctggttcgtgaatttctgggcgtgacatttaatcatccatgcattccttacacacggtctcttttcttccacccaagcaagtacctctgcaaacgaaaacacacaacactcattgtgtagcgatgtttgttcaaatatataacaagtaaatctaatatagaacatatgcatctttggttgattaatgcataaggtagtcatggttatatccgagctagttgtgtcctcatcatattacccttccatctggaactagaagagtgtgcttttgataaggatagtgttttcaagtcctagctcgtattcattcacgcttgtaatcatagcttaaatagcatatatagcttcaatttaattatttcccggactgtctcaaagtcggcagatcgattcattcctttcataatatgtggataagagaatccatcaaactagtaccggcaccatataagtgacaccatcatcactagagtgtatgagaagttgagaactccagtgagcaaattgcaaccctcgagtatatagtgaaagaacagcttggacctaccccagctacctagcaagctgaaagtttttatttctcaaacagtgtatcaaaacatttcttttttcacaggattgagtggtggatctgtcagtagaaccttacacttcaatgaatcaaatttcagctcactagctactgtaaatgcatgatcccaccagatgtaggaatttctacctggccggatgagctgatgaacaaacacataggagcagatagatgtaggtgacgaacacatgggattcaatgttgatgaactacaaattccctaaaagttgatgaactatagctctcccaatgacacatgggaacgacagctctcctcattgatgaactaataataataaaattattttgtgtatttacttaattaccttaaatgttggatcgatccacgagctaggagagttgtcgccggggagagggtcactgcctcgccgggggtcgattggtgggagtcggaggggtgaggatcgaggactcaactcagcaccgacgagcaccggccgaagtcggagctagcggaggggcgaggaggaggaggaggacgtacaactgagagtctgatatggtttctcgtggaggagaaccccatggagctgcgacatggaaagatgatggaggcggtgcatccatggaacgacagtgaggagaggccaagttcccatgcagcaaatgaagtctgacttatggttgtttcgaggggattcagtgtttgggaagcttcacaagtatttttcattcaattattgtagatgatggcatgcacattacatagcttatgtaggtagtagggtggatccaacgtgtgtgtggggaggggggacttaagtccccctacctcgttggatcaccattaagagaagaggaaaagagtagggggctggaggaagaagaagggaataagctccccttccattcttttcctagatccgccctaggtagtgttgttgaatttagttgcagcatgtatagctgggagcatatcaacatgttctttgtaacaatactagctacagttttttattctttctccaacgcctaataatagttctttttatttatgggaaatacattcagtgctgctagcaaacaattttttccaacaaaaataaaagaataggcaatgaatgatttggtagacaatatcatggtcagagagccaataatagaatgtgagcaattagggttaaaaagtttggtgacaattgatgagttacatttctagccttacttctaaattcatttttttccgtgaagtaattcaagaagcattgacatgccatttaggccatctgcacttcttatcagtgcccaacggtgtttctaggcaaaaaaaaacatttatctatttggcactttttgttgttataggtagtgtttgtggaaattactttatattaaaactatttaaggtagattcataaagatgaagataatagagccaacattgagtgtgagttgcagaacgcataaaaaccagagtgccatgagcatggtcttgctgtattgatcatggcggtgatgcaactcttcattttatttttgtttatttaccttagtcctaatcaataaatcatgtttgattgcccccataatggaatgtactatgtttctgcattttggtgaattgctgaaatcctcccttatgggcattgattttgtcttcaaggtttatgcatgatcagtttgaacttatctctacatagaagaaaacaacaagctcaaaaaggattgtatgactgaggtgcatatggtgtgctcttgaacataaattaaaaatagaattatttccgatagaccaagctaataggaaatattgatggtttttatcttgttttatccggttgatcggattgatcatactttatctgaatgtaggaatgtttcagatgataacatcatactacatcatgttttaaggcaattgatttattgtgcataatactaaggaacctttcactttcagtgtaaaactgtaaatatgaatgcccatgtctcggttgccttttggcggatgtgttacccattatatattgagtttgatcccaccctgccattcaagttaacatgccatgtcttggtttattagactcatatactgtcatatgtgataatgtttctttttaaaaaaactaaaatttagttagaattacataaaaagtttataaactatatgtttcatccccacttttgataaattccagactctgcacctgctagttactcccttcatcccactaaggcacaatcaaacttagtgcggtctccaaaactaatatttgactttaaattgctcatatactataatgtttgtagcaacaaaatcataatcatatgaaagtaaggccctgttccagaacccaacagagggggagataaagttttggattttcgtggcacgctttttcaaaatgctaaacggtgcgtttcgtatgaaaattttctatatgaaagttgttctaaaatattagattaatccatttttcaagtttgtaataattaaaactcaattaatcataagctattaccacctcgttttacgtaaaacacttaatctccatcttcatcttcaggagattcaaacacagcctaaatgcaaaagttaatctaataatactattttcatcaaataaaatttagtataataaaataattattggtgaaacattaaagtgttgaatcttaaaatatgtgcacgccttattcagtgcgaacaagggaatacaacttaattagaagcgaggtaagctacagagcatattaagtttttttatcacatctctaatcatatatttaagtgattttaccacatcttctctaatcatatcgtagtgagacgtagatgtctgcatggtaacataaaccctccctagttgagtagacgtagccacgtaggtgagatacttaattaccactcaagtcctcaacacggatacatatatagatgtgtacttagagcattatagtcctcaacacaagaagatataaatgtgcatatataacactactagtccttagcacgaggtgacatagatatttttcagactctagtcctcaatacgagaaatctgagatgcaagaagccgtagtatgcctagcgccttgactgcactaagagcgccaacaaatatcgatagcaccacgtcaattatgtagcatttgcatacagccatgctaacatgagatgttctccagcaaacatgacagtggccaaggctagcaaaaatgacagtggccaatgctagcaaacatgacagtggccaagactgcattactcatgccctacgtgcaacacatgagcacctacatggaaacacttcttggggcatatacatcgtacataatcttttctatctagtacattttgagttacaactgagcaaattaaatagtgaacaaaaaatgattatttattatcttgaaggatgaagtctgagaaaagatgtttgcatatggtcgtctggtgcccataaacaccactaggtggtgaggattatcgagttgatcctcgctgcatgaacaacaatctttagatccattgttgcatgttaattgcttgttgtcaatattaataataatattggagcctaacattgagaaaaaaaaaagaaaacaatggagaaaaagatgatatgaagaaaacaaaaaggataaaaataaagaagaggaagatattagtaaaaaaaaagagagtgactccttgtcgagagataatgcattatcaacgaaacaaatatagtttgactttttttgtttttttccttacacagttatattatcagtaaaaatatgtgatgtattcatatgcatattgtgaacaaaaaaatgaaatatatttaatgcgggttgtgtccatagtggctgctaggctacaacatggcgccaacaagtatctaaaaaaaataggtaaacaaacaacaatatatactcatgtttcgacaagtaatgtttattgtgagggcgcggggtgctaggcccccttgtcaaggcagacgggcagacgggtggagctagaccgttgtctggtgctaattcgtcattcaggtgtcgtgcggttgttagctgccattaaacccaatttcgaccactaattaccccaaatagaaaaaataataatatcggtgaagaaaacaaaagggaaaaaaaataagaagaggcagatagtaaaaaaaaaagtggtgactgcttatagagagataatgcattatgaacaaaaacaaatatagtttgactcctttcaaaaaaaatatagtttcaccccttttttccttacataattatattattagtagaaatatgtgatgtgttcatatgcatattgccaacagaaaatgaaatatacatacctaatgtgggttgtgttgctaggctataagatgacaccaacaagtattctgaaaaaataaggacaacaaacaacattgtatactcatttttggataagtatgttcattgtgagtgcaggggagtgggggaggggggcataggcccccttggcaaagcagacgggtggagctacaccattgtctggtcgtagatataccacgaagagagggtgtggtggtgttctagtggaatactaatccgtcattcaggtgccgtgtgttgttagctgccaattaaaccccaatcactaattacccctccaatcctcaacataaggataaatatataaatgtgtactttgagaattatagtcctcaacataagtaaatatagatatgcatatatataacactactagtcctcaacatgaggtgacattgatatatatgtagactctagtcctttgcacgagaaatcggggatgcaaaaagccgcagcatgcctagcgcctttacggcactaagagcgctaacaaataatgcctagcgccttttcagcactaagagcgctaacaaatattgatagcaccaccatgtcaattacgtaccatttgcatccagccatgctaacacagagatggtgttctccagcaaatacgtgctactcatgccctacgtgcaacacatgagcacatacattaaaacaaatagcaattaacgaaattaaggagtcatttgaggaaaaaaatgagttaaaatgagagagaagcacttatcaattgaaatgcatattatagatgagaatataaagtgaaacaaatttatttgagttgtgatcataccatgttcaccatgaccatcgcagtgagcaatgcagtcgatatgggtcccacctcatacaagatcggatctgctgcttggaggagcaactctaacacacctcagattatctcaaaccacatgggcacaaacatcaaaccacgtcagatatggtcgtctagtgcccataaacaccactacaatggtgaggatcatcgagctgatcctcgctgcatgaacggcaattttttgatccatagttccttgttaattgcttgttgtcaatagtaaaaataattttggagcctaacattgaaaaaaaaggaaaacaaatagagaaaaaactgatactagtgaagaaaacaaaagagaaaaaataaagaagaggcagatatcaataaagaagagggttaattgaatccatgccattataaatttgctagttttgaaaaataccattactatttgcataattggaaccatgccactggaaaacattcaaaatcagatctatgccactttgtatgtttgaaacccattttgaatcgttttctatctaccgtattttcatatagaccaaaatacccctgcctcttacaactgaacagcaacacgatacttgctcttgtcaactctgcaatttgatgcctcggatacaatcaaaattttatatctaatatctaaaatcgctgctgctaaattgctgtcgtcggccactccaataaatggttaaatcaggtgtacaaaattacagaggaaaaaaaaggaaaagaagaaaagagggcggtggaggagtcgccgtggaggggtcactgtccacgatgacagctcgagccggccagctgcagcccatccgctacatcgtcgtcagcaccagcaggagcaggagcagcatggaggtcgccactggatctgctctcaccacacgcgagctcgccgccgccgcagggctgcacgtcgcttccaccagacacggccagccgatctcgtgcaatgccgcagacggcagaaccccggccggcagctaccgccctccgccctttctacgccgtcatcgtcatcaccgcagctcgctcaactgccatcgccattgctgctgggcacttgcatcgggcaggatgaggaatcgatttggggctagggctgttggatttgggggtattttggtccatataaaaatacagtagacaaaaaacgattcataccgggtatcaagtgtatagcatgtcatggatacaatttttgttgtgttggaatggcatggttccaattatacaaatagtaatggtatttttcaaaactagcaaatttataatggcatggatccaattaacccagaagaaaaagaaaaaaagatagtgactcattgtagagagagaatgtattatgtataaaaataaatatagtttgacctttttttgtttttccataacacaattatatgatcagtagaaatatgtgatgtgttcatatgcatattgccaacaaaaaattgaagcaaactgacctagggagggatcgatcgtccaacgacacgtggccagaccggtcgatgaaacattaatcactaactttgttaaatgttttagcttacttatgaaaatgattaaaaaagatgcaaaattaaaaagtattgattgcaataccaagcactacaaaaaaagttcgtctatcgactaaatacataaaaaatagtacatttcacaaaactatagattttttttcacaatttatcacaaaactacaaatttaagagcatgtctcacaaaactatagatttattgtatccgtttatcacaaaattacaggtactttgtacaatctatcacaaaactacagatttaagaacttgtttcacaaaactatagatttagtgtattcgtttatcacaaaactacacatttagcgtcgtcatttatcacaaaactacagatttagtgtatccattagcacaaaactacaggttttaacaatgctaaaacttgtagttttgtgataatgaagtcactaaacatgtagttttgtgatatattgtgcaaagtacatgtagttttgtgataaaagaagacactgaatcagtagttttgtgaaacaaattcttaaatatgtagttttgtgatagattgtgtaaagtatacgtagttttatgaaatttaatcgaaaaaattataaaaataaaatttaaaatgtgcaaaatgttcaaatttgagttgaaacattgtttttcataagttaaaacatgaaatttgaatggttgatactaggggtggacaggaagctcgtagctcgttagctcgctcggcttgtgacaagctcggctcggctcggctcgtttgattttcctaacgagccgagctggcattttagctcgttagaggtaacgagccagctcgagctggctcctgagccgctcgcgagccttaacgagccaaggcacatgagctgtgggcatttggaattggattttggcagagattggaggcccaacagcccaact

SEQ ID NO: 58643 - DNA, 920 bp, Oryza sativa
aactggtctagctaccttcaacttcagcacatctgtttccttggtctgtccaacatgagtgcaaaatttaggaaacaacttgccaaacccaggattatacgtaatagagaaaattcaaacttactcttgaaggatttaagcagcaagaaacacaatattcataagaatcacagcactgtaaatcgagtttgcaacccctggttggtgccatgaagattgttaaatttataactgtacccatttattgcggtgcagagctgaaagtgaagtgagcaacaaaagataagaaactcactgacaggaaaaacgtgaccctgttcttgggcaacaccgagaccatggatcgatagataaggaagaacatacataacctaaaaaggaagtaattatcagcgggggaagtctagaaggcaaatacactgcttaccaggcagtatatgtgagcaaaatgagatgggcagggtgtcctaccattatcatctgatatcaggtgccgcccttgcacagtgctcctgcacatgatgggtgctgcaagaccaatgtccttcctgcacaatattcaaaatcaagccgcatcattagatatactgaaataaatactccaacatccatcctatattcaggatggaaagaaagcatgaatggcgtaacagtttgggcacgctaataagcttgacacacatgggtcatgggttcaaaggccacatgatgccatatacaatgaactctgtcccaggctactcccagttccagaattcagttgaaagcacaattagataagacaacccgttaactcgtagtctcgtaccacagtatttaactgaacacctgcacttctataactctattctgcactttgtagaggtcatgtattagtcagcaagaaaatgtaggcacaaaattgcattttgtgcactggt

SEQ ID NO: 58644 - DNA, 7516 bp, Oryza sativa
gatggtctgtttgctttatcctttttctgacgtgtttagtttgatgcttttacaattgtgattgtttgggcaggtgccgatgatccgtgataccagctgatttaatttggcttgaccatactaatgaacataattaaggttgtttaaagaggcccagttacacagtaggtgggtagcataccaaacaccatcagaactttaccctacaaaatgtgctttatctttttcttcacacaaatatagcgtgaattcaattcacgttcacacaaattgaacgccaaacgaaaacaaaccactccttttcagatagcgaatttttttttgggtaataaggcatcaaaacaaaaccggtcctaattggcagtgttttttttttgttttgttttttacggacttaaaatgagccgaagtaaacgaaatcctgaagaacttcaccatgtcattctagattcctagtacatcctcacacagataaacagattccaagtacatccttacacagataaactgcagataaactgttcccatgtgaccttgacatctcccacccttttgtatagcttaaagcaattactcccttcttccctaaatgtttgacgccgttaatttttccgttaatttttttaaacatgtttgaccgttcgtcttattcaaaaacttttgtgaatattattcaaaagattgagtagtagtagtatatttaacaatgaatcaaataatagaaaaagaattaataattacttaatttttttaataagacgaacggtcaaatatgtttaaaaaattcaacggcgttaaatatttagggacggagggagtacatatttacaacaagcgcggttgtgcatgcaacaaagattgcacaaagttgcatctaaagttagtaaattaccaacaaatatgggacacggtatgccaatgatccaagatgaattcaattcaatcagtacaacgccacagatatggaagcagaggattaagcacgaactaccaacacacatcaaatagcacaagcacaaaacaatttactatgcatgtcaaacaaaggcacagaaaacagagcatcaagtgtcaaagccagagtagacgccactccccctcagaagtcgcttctcttcttcaacgtagttcttccccctgctagcctggccacgatctctcttccgcttttccttctgtgagaaggaagcatctttattctctttctccatctgcctcggctgcgggtttcgcacaccaataagcttttctccctcagttactgcagttcttgtgcgctcccgttcttcataggattcagtttgatcttctttgtcgttgcgatctttcccggtggaccaagaccagttaggctcaacctttggagggggcaccgtcaagacagatgggccgccacgatacccatgccggctcaaagcattgaaatccacaccaccaggtttcttcttcttcgacatagctgttgttcagagagctaaaaccaatgttaaaatgaacactaacaatgagaggtaatactcagaaacatgcatcatctggaatccataaggctttgttaggatttaccaaaaccaaactgtgcaagcttactgattacagcaattaaaaagacaacaaaacagacaacccaaaccaacgtcttctactacaatttaattttttttttctcaaaaacgctctactgcaactttatgggagggaacactggatctatgtaggcatgatacattggagctgatgcccaaagactggctaaatgttgactagaggtggtcaacctatggacttcttcagtgatccaaataagggcctcagctttcacaggatggatgatagcatccagaggccggtgctcatcatcactcccaactctctgctgatcccactgtttcaagaggacattggtaaggtaatgtaaaggctgcttatataactgcttcaccgacctgccgagtcccagccatgttgtgcatgggattacagatccacggtgagcaggaactggaatatgcttcatatactcttgatacatttcagccttcctgatcagtgcacctgcatgatctcattatagtaagcatggaaatttgtatctctacgtagaaaggaaaaaaaccttaaaactacatgagccaatccaaagcagaacgctattgtccatgtctgaagggtataaaatccagctcaaagcctctattagtgcttgagaactaaaattatactccatccacaagagttagacctatttcatatttgagttttttttccaaataagttgttcctatttgtagtgtctatgcatccaaaacttaaatggagaggtaaattaaatgtttgattaaaacccaaggagccatcgtaatactcattggttgcatgcgtgcatacacttcttgatctttgttatatgcaagatgagttaatttctctttggtcttggtgacaaaagtaataggtgtaactttttgtggaagaaggagggagtactaatttgctaacttattttgtagtgttggtctctggctcatcccatagggtatatagagaaagcataggactcgactgttgaagctccaaggtaacgggcaactcatgataattctttgaatgacagagtattaattacatacttagttataagagataaatgaaacttagatagacttattatagtggtgttcataattagcacaaaatcatattaaaaactccaagaattttttggccaaatcagcatgtaaaaccaggtacagatataacctgcaagattgtctggatgcaggcactatgagcctgttaatataagtggtatagccagcagtaaataccattgtttgggagacaacttttcttaaaatgtccatcttttaataatggcaacaagtggacaactttcaaactcaaacctcaactgtgaaaataacatgtgggcaatattaacatacagggaaaacagggaattcctccatgacaattgcgataactcaaatatcaacaatatcacaataaattcatgtacttcaaaatactgaacattcacttggtcacatgaaatctatactctatatagaatgctaaaataacatatagcgcgtaaccttgtaagaatagaacactagctaaggtaatgttgcttagtttcaaaagaaaacccatgcttagtttgttctttagcaaagtctaagaaaaatgaatactaccactagagaaaaacacgtgagttcccccagtgtactgctatataatttactgttatatcaatcccaatcaatatgaaaagaacaagccccaaatttccatagatggctggccaaaataatcttaagataacgttaacgaatctacagtaatgctgattctctgatgtgaaaggtacgggtaaataaccactatggctttgcttgagtggaaggggactagatccaatccctttggatagatatagaaaactgcagttaaaatccctggccatccaaatggatagattctgatccctgcatatagaaacaagccctaatttcacaaatagactaaatttacagtccgaaacaacataagctagctaggaaacacagactaaaaatccatactccatgttgaactcatatctcacaggcaacacacaatacagacattcaaaacaatcttgtgagagcatagcgaggccatatagcatgctaacaaaccaaaaatatgaaaaatctcctcgtgagctaacaaaaagacagagacagatcactgggatagctctcaccgtctggtgcggcagctttggtggaattgggcagcccgaaggcgttgtcccctttccccttcccggcttcatcgtcggaatccgagctcagggagtcgtcggaggagacttccagcggctcctcccacggcgccgccctcttcatacctagccgcacccggccaccgccacatctaggggggttagcgtcacgccgttggcgaacggtggagtcgaggccgtggatgatgatgagcgagggggggcaatggacgggtcctcacctggatcacggagacgtcaccggcggcacggcgcgccgagggagaagcggcgcggcgcgcgagggagaaggtcgctggctcgctcgccgtcgcttgtcgccggcggcggggacgacgaggccgaaaccctcgattgctgtgttgggctttggatcgctggatgagggtggagacagaaggaaaaagtacacctaaggtacctcaacttgtccgcgaaaccatatatgggcaccatggtatcaaatgcataaaatcactcaactttttcaaaattttcaaattattagtatataccaagttataagaatttgatttatacctacacctatcaacaaaacaactcaaatttaactttatctcacaatccataattacatacctaactaattatatgtttggatgctatatacatagaatcaaaatctaatataacaaaaacaagtttaaattcagttcaaacttgctttgaactagttagtaaagttgttaatgttaatacctaaatatttgaaaaagtttcatactcatttgaattgggtatatactcaatttcaacaatggtgcccgggcaccatggagcaccaaacaaatttaatatatatatatatatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattcttttttttttgaaaattcggatcactgcgctgtgttctgcatggtgagtcattttgaatgttctgcatgcatggtttgttacccgcacgcatgcacgaccgagcgaccaggagagtagttagtgtggaggctgctgtattgatactctatttaagttgacggtgatggaggacagaaaatgaggaccacaattatctttcggatttgtgaggaagaagattttgttctacaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgcgtcgtcgccggtgagtagtagcaagcaccatcatatggcgaaggcagaagatggaaccattacagttaatggtgacaagcagcagaatcctgccgcagataggtacacattgaagtttagttttagtttatgttctgttgaaattttttctcttgtttgtttgtttggctctaactggttattgcgttatttggtcatcaggaatggttttgtgcgttgcatggatactgctgcccggagtgaagtgatgaaccactctctccagaaatatgtcattcatttcgatggatgtcatcctcttcccatgagaaatcctaggaagagatgcgcttggtgctcactccgtgatattcgcgcggcttgcgacatgaatttcagaagcaacgaaacaacccgggtcaacagtaatggttgcgaacatgtgtccaatgaaaatatgtagacaatagtgtgatgatcaggaaaattgtaataagggcttgctttctgcacggtcgtagattagtcgtacgaactgtctctaattttgtatggtattttctatgaggaaaaagcgagtagtatctaagtttagaaatctgtatcttctgctgtttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcaaagatttcgaattggtttctgtgagtgtagcgttgcgtactcggaatgtttgttatagatgctatttttgtggcggtatggtttcatcagaattcgttaatgttgctagtggctgactttccggagtccaataacatgcttcgcacgtaggagccttgattttcggggaggttgttgaacagctaatggaaaataaaccggaattatttgtcagtatatatccaaccagctggaaaaaatgacgccctatagcaaattctttttgccaaaaggggtagctaccagaatccgtgctggacagaaacaatattcgcgaagatagctatggaggaagaaggctggccggagaaaggtggcgaggatcatagtggacaacccatggacgtagttccgttggaaaggtattttttatgtcagtgtgattgtagtgtacaatttccctttctgcattgttagctgaattctcatttttttgatcctaggatcgtggttgagggggaggaagagagtgatctgctgcctatttcactctctgacccagccattctgttgccgaaaattgggcagaccttcaatgaggactctgatggctatgcgttctacaatctgtactctaggttcactggttttggtataaggagatccaagaacagatacaaagatggaggcgtgaagtccatgcaagagttctgctgcattcgcgaggtaaaaatctttagtgtattcttttttttttgaaaaccatggtttcgtattctcgtaagattggcaaggttctatagtgtgatgcgtaggatcatcatttcataggttttacgtagtaaggtgttcctgtaatttatgcagggtagagataattccgtcactggtccgccgaccaggataggctgcaaggctatggtcaggttaaatcgttcttctgaaagtcaaaagtggagagtttctgcattcgttagtgagcacaaccatgaaatgaaacgggacctgcagcatactaaacacttccggtctcataatttcattgatgaagggacaaagaggaacataaaggaaatggtagataatgggatgacacctacagctatgtatggattactttcaggtatgcacggcgggccgtccttaaccccttttacaaggagggctgtgacaagaatggcgtatgccatcagaagggatgagtgtagcaatgatgtgcagaagacactgaatttttttagggaaatgcaatgccgtagtaagaatttcttttacaccatacagattgatggtgcttcaaggattaaaaatatattttggtgtcattctctttccagattaagttttgaccattttggggatgcaatcacttttgatactacatatcagactaataggtacaacatgccatttgggatttttgtcggtgtaaataaccattttcaaacagcaatttttggttgcgctttgttgagggaggagacaatcgaagcattcaagtggcttttccaaacatttactgatgcaatgcatgggaagaggcctgcagcaattttaacaggtatatgtttatttggatggatcaatggtgtgtttaatgatatgtctt

SEQ ID NO: 58645 - DNA, 600 bp, Oryza sativa
gcccaaaaagaaaaggataagatattccgatgcttgtatacgaagctctaaagactaaaggaaaccagcatgtcagcaagatgttggttcagtctaaaattttgatgcaagattgctagcgccatcaggtatggcatatgctgaatgatcaatcatgaagagcgttggcccatgcatgctattgcatgtttatgtgctttagctgcagtgttatacagtactgtagcgtcaacgccacgatcctttgccataagaaggacgcctttgatccttatacattaagaaacaggaagaatatttttcggaaaaaggatgaaagacagggtgcatccttttctaaggaatgcaactattccatccaacgccatgccttttggtctatcaaacggtgcgatttcgcgaaaactccttatatatgaatttcttagaaactagtatatatgaactaagggcacgacgctgcccatttctatgttctaaccaaggcctacaaaacctcgcacggctgcataggctgggccttcttacacaagtcaagcagcaaggagaaatcaaaattcaataccgtcatgatccactccacttcacgaggaatcatac

SEQ ID NO: 58646 - DNA, 10788 bp, Oryza sativa
aaaaaaaccaggggcaccctttctcttttcagatttactaaagattactctgttttacaggtcattcaacctcacagcctactcaccatcttcccatattcttcctccctgaaataactaaccaacaaaccaaagctcactgattccaatcctcacaatgcttctatccaatctacctagtccttacctgaactatctcatccccaatagccatatacttatcccagataacaacatttgctgaacaaaagctgaataaaattgttacatactatgtctgctgctccacatcacaacctactttccatctttctcatttctctcttacccttaaactaaaggagcatccagtgctgaaaatacctaattcattccttcacctttctgaacaatgatataataagatcagacggttgatgctgcaggcaccataatctgcttacgtgcagcagcgcgtgcaaaactagttcagccatcacattctcaaggctcttgagggaagcatggccccttaaactacctaagccagctctagatcctgcgtgtgtacatacatgtgcaagatccactggaactgcatttagtctgtatacttaaacaatgatcaaaacaatctaaacctagaaaccaaaaaccttgtaacaattcaccacacatgacacaaccagaaaaaaattattgccaattcataatcacattatttatgccaatttagcttgtctacccatacgaaggttctgtcccagactaactctgcaaaccaaatatctgaatcatccaccgtaaactgaacacacatacaatactcagaactcaacatattatgtcgcaaaagttaattcgtgcaacacatcaacgatgccatgattaaatctacatttgccccaccactgacgcgactaaatctgcattcaccccgggaaaaaaaacagttaaccctaaacaatattctacaaccgaatcggaagtttcggaaccttaccgaggattggaggaggcgagcgatccgcttgcagttgcatcactttcgtctcacccctcggcgcactaccaaatgaggtaccacctgcgggcaccgctgctcctccaaccgtcgccccttgaagccgccgcatgtacatccgcccgcattgcaaagcgcgattagggcatcgcctcaaggatccacaagggcgattcgccgcaagctagcgatggaaatcggatgcacctacctagcaaacgcccgcggatgatgaggacgctccgctccgctccgccgtccatcgcctcctctctccctctctccgcgattcgatctcaccggcgccgtagcgcgcggggcggtggagagcgtgggatttctccgcgggtaatcccattggataaacatggcgcgtttgggtggttcggtcgccgcaccacgcaacgcgacgcagtgcgcgtgagcgtgcctaaccgtgtgcgactcggctcgacaaaaaaccaaaccaaaccgatcagatcgcattagaaaatctctccaccgcttgcaattgcaagctagctgcagtggtttagggccaaacatgctgcaagtgtgagtcgttgaccaaagaggacatcacattcggagtcagagatgggagaccgccagtgcaatgctagtcataaccacgatatcaaatgccaaggagttaaagaaatgatagtttgtgaacttgtgagttgtgatggaccgggacgatgagcatgggtgagctaggcattgtctctgcgcaagcactggtgtactgccgctgccagggtagatccaccgtccattgcagtggtccattgcctcaccctcacgccgacacttgtttcacagcgcgcaagtaattaacttgatccattcgagagagatgaggagagaaaacgaacaaggtttggttgatctggcactggggcaccgccaatccgatgttcgttccaccgactgtactacagtactagtatccggcagtctggctacgcggtatactactatacgtgtcattgtctactcaaccaagaaaaattcgctgacgatcgagaattgtgtcagtaacgccgccaagcagaagaacacccaaaatccatctatccaccaccactgggactggattcatcatcatcaattggaagaaatctcaaccaccgttgggccccagacgcacagacacacacaaacacatccgatcccgcggcggcagcagcaagcgcaattcccatcaaccgcaagtgcgtgccggccgaagatttggcgcacgcacactcaaaccccccactccactgcccccaaaacccaacccccaaccagccagaattaccacacacacgcaccgcacccgaaatcccaagaaacgcgcgtataaatcccaccggcttgaggagtcgactcgccgatccatccacccgcgcttcgtccattccatctttctctctctctcgcggaggtcggaggagccatggaggtgttctactacctcgtgttcgggggcctcgccgccgtggtggccgggctggagctcggcaagagcgccaaggaccgggtcaccacctcccaggccttcaactccttcaagaacaactacgtcctcgtctactccctcatgatgtgtatgtcattcttcgattcttggcgcattttcgtcctcccggatctgggattcatggctttcatcaatcttgtgcagccggggactggctgcaagggccgtacgtgtactacctctacagccagtacggcttcgacaagggcgacatcggccgcctcttcatcgccggcttcggatcctccatgctcttcggcaccatcgtcggatcactcgccgacaagcagtacgtttcttcttcatcgatttcctctccgattgtcacagattgtgccccgcgctgagactgacagaaaaatctgtgtgtttcagggggaggaagagggcgtgcatcacctactgcatcagctacatcctcagctgcatcaccaagcactcccccgagtacaagatcctcatgatcggccgcgtgctcggaggaatcgccacctcgctgctcttctcggcgttcgagtcatggctcgtcgcggagcacaacaaggtactggacgctcacacatttcaagattctaccttcaaaacattttgacggatttttagtacaatatgaattaaattttacttgctaaaagttatattattggattgatatttcaatttactttcatagggttataattttattactataaaccttataatatatgagaaattataagataaatattagttttgacgatcgtgtcaagtttgatcgtgtcttatattatgggataaagggagtaattagtattactgtaattatacgcagggccagatctgcttgtcagtgtcccccctcacactgatgctttgcagctgtgtctggtctgactttaactttaatccaaagtttcctctttttttttagttgtctatctagaagggcatgttctagtggtataaagaatacatatttggaatgttttaaccttaagtaactaaaattattcctatctttgttgtgaataaactattagagcgtcatttggattcattcacataatcacatccttgtcatccaagcgagctaggagcataggagtacttttattttgggatgtttgactacttactcaattaggcacataaaaaaaggattttcagtttgagattaggactacacagtaaaaggtcattttgtcaggatctgaaaagagaagactgaaatctagtactccttccgtcccattttgcaattatcggtttctatttcaatgtttatctgtccgtcttatttaaaaatttatgaaaaaaataaaaaaataagtcacgcataaagtactacatattttatcattcaataacaacaaaaaaaatattaatcataagaaaattttaaataagacgaatggtcaaacgttggacacagaaatatataactgcacttaggatgggacggaggcagtatggagtatagctagtagttctagtatagttgcaagctcatagccaccattttttgttttctttctggtcattgtgtcggtggatcagaataagatggttgcatcgtcacaaggataggcatttaacaagcatggcccatttaataaagctggagtatttaggatagcctcacactcactacaaattgtccttttattcggccatgtgccgtctcctatatggatattaatctcggacatattcaataattcattcaattatcaataagaatccaaggatccaggtacagtatctgttgcctgtgaggctgtgagtctgtgacacactactatgcagtgttcttcccgtgacaaaactgtcgttttgattaactaactaataaatggtccttgtcgtttgcaaacttctccaatgtattacagtcaatttcttatctgcgttatcaatttttcactgtaaagtttaaccttggcatttcctttcacagagaggttttgattcacaatggctgtcgatcacattctccaaggctatatttcttggcaatggcctggtcgcaattgtatccgggctatttgcaaacctgcttgccgacaacttgggctttggtcccgtggcaccatttgatgctgctgcatgcttcctggcaataggcatggctatcataatgtcttcatggagtgaaaactatggagacccatctgaaagcaaggatttgatgtcccagttcaaggttgcagccaaagcaattgcttcaggtatgcttaactcatcttattgattgacagataaacagatatgtatcaaagttgacaatcggcattctgacatcatccttgaaatctttagatgaaaaaattgcattactgggagccatacagtcattgtttgagggctcaatgtatactttcgtcttcctctggactccggcgttgagcccaaatgaagaagatattcctcatggcttcatatttgccacattcatgctgtcatcaatgttgggtagctcaattgctgcacgcttgttagcccgaaagctgaaggtcgaaggttatatgcagatcgtgtttacaatatcagccttcacccttttccttcctgttgtcaccaacgtaagaacactgcttatactgcctgtcaatttttctcttataattcagagcctaacatccgtttgctaaatgttgaacagattctagtgccaacttcttcagtgaaaggaggtagcatctcatttggaggcactctgcagctgcttggtttctgtacctttgaggcatgcgttggcatattctggccatcaatcatgaagatgagatctcaatatattcctgaggaggcaagaagcacaatcatgaatttcttccgcataccactgaacttgtttgtttgtgtggtgctttacaatgtaagtgaaagtgttcttactgaatctcatgattctaatctgttgatttccttcaaaaataacatttttttctgtgaattttgcaggtgaatgcattccctatcactgtcatgtttggcatgtgttctatcttcctcttcatggcggcaatcctgcagagacggctaatggttgtttctgacctacacaaatcatcgacaagtatgcatctttcttcattactccacatataaaaactaaaatcgctttgccaatcaatttctttgattcctaactgttggggttaacattttctgcagaagcacaagagatggttgatgaagatgagccactgaatccttaaggattgataggatcatacaaacagatcgaatataagcatgtggcatactgcaattcatttctaccgagctgctgaataagattggacgttgcagaaaagagcagttgtttttgtttgtaactttatttctgcaatgtcgattgaccattggctggtagttcacatctgtggagcaaatgtagtaggcacgagaggcaatacatagttcagcaagcattgagctatagccgagatataggctattcatgttgtcatttgttatttgttattgttattcaccagcatgacattgtatgaaattaaatgctacggatatcctaatcgaagttatattttacacgagagaaggccttctcagatatcgtgttgtttcctcgaaattattgtcccttacagacaatctcttgcagtctcttacatagtcacatctgtgatctggcgtacaggagttttcatacttgtacgcgtccaaacagacttgatccaacatcctcgtaccgggcactcacgactcgcgagataaatttgacttgatgatcagaagggattattgttcttgccgtaacatcaccctacagtaaagctcttgaatttatcacatcttatatgcctaaatctatgctgaatatacatgctagtctgccataaggtgaaatggttcatcacactgcatctcatagggaaatgaaaggaaaaggtcttgtatgcagcaccggattattatccgagccaaaaaggttcgaagctttaagaacatacaagtgataggtgaaatagttcatcacaatgcaactcataaggaaatgaaaggaaaagatcttgtttgctgcaccggattattggacgagccaaaaaagtcgaaagctttacgaacatacaagtaaaaactaggaaggaatataaatggtgggttgcacaagtataagaggatggccacatctcagaaatgcccacaaggaaaaggttcgaagctcaacagaagaacagttgtctgcctaacccaccaaccgaattgtaacatcagaatatgataagagttaacccaccaaaacattatactgaaagaggacaaaaagaactagccaactaggccaacatacagtataaaaagagcacatacgaaggaaaacagaagctggtggtgaaatacatgattcttccataacctaaagtttggtagttatcagctttatcaatagatccgttcaagaccaagaaaattggtgacagaaaacacatcaatttacagaataagaacaaagtacagtagtaacagaacaggataagactgcaatagatagaaaacatgaacattgtaatatgctatggtctggagaatacaaactaaaaaatccattcgtaagggaaaatacggtggaagtttgaactaaaatttggaccagtaacattcagatatcactgaacaagaaataatgtgctttcaacataaaccggcagcttacaaatgccaaacatcaagactggcagtgtgttttacagatgccaaacagaaaccttacaaattcctaatgaatatcttacattgaaacatcagagcataacaatcaccacgtaacatggcaatatagcatatcagtacttgatactagtacttagtactacctccatccccaaacatgagggattttgcctatgcagttacatagacaaattctcttatatttgggaacgcaggtagtagtcggtagtgtgacttgtaccaagagtcaaatgccaaacatgcaaacaaaaacattgttgtatagttgcaatagagcatcaaatgatataacaatatgcaaagatcatcaatatccattatacacaataaaatgcatgtggaagtccttgagaactacgggttcagacagacataaggatatatagttatacataggaagcaacattgggtataactaaatatctttatgtccatttgaccctgcaaccggaatgcattacttggtagaatgtaaatcgcagcacataatgaggatggcatccatagatagattagaaatgtgcaaacattagcctactcttttatggcatattgtttcatcgcaagtgaaacacacaccataataatctaggaaaactacactacaatgaacattacatttcacattgtcacggactcaccatcagcataacgtaaaagtatgtattattgtgttggtaccagctaactagctactcgagaagacgttacattgcaacataggccaaaaatttagtgatctgatccgatcatatcgattacatgtaacataacgctaaaatataatgtcgagaagaaaacccttctccaataataaattaaccaggagagcaaaacgaagaaatgacattccttttggcgaccaattgattcgaccatttcttatcacagcagagagaataccgtgcggacgaatcagagggcaggcacatatctcttcgccgcctgcttgcctgccatggcggcgccggcgaggaccccaccgatggcgcccgcgacggcggcggagcgcggcccgttggcggcgcggaagagcgcgccggtgccgagccccgcggtgacgctgttgatccagtcgtcgcggtcgcggacggcgaccatgccgctctcgatcccggcgtagagcaggccgatgaccccgagcgtgttccccatgcggcggccgttgctgccgcacgagttgaggacgcggttcgcccggatcttggcggtgtccccgggctcggcgttgcgcgcggcgtcgcggaggccgacggcggcgccggcgacggcgcccgagagggtagcctatgccggtgtagtaggtgaggttctcgccccaggagcggcgctgggcgagcgactcctcctggaagaggaactccggggaggtggggaggtcgtagagctgcttgtaggggatattcaggtcctggtaggggttgtacagccgcctgccggaggcgtccgtccggtcgtcgcgggtgccggatcccgacgagaacagccgcggatcagccatggcggcggcggcggagggcggcgtggagcggaagaaaggcagagaggaagaggaggagggtttcggcacggagctgactgcgcgtattccgcgtcggcctctttattattttacacaactttctggagccccaagccacttgcgtttgcgtgtgtgtgtgatgtgatattttcgcggtcgccgaccttgcgattcatgggccgcaattttgatggcccgggagttgattaggcgacccattaacccatcgaccaaagtggtggatgatggcccatcaaccgatcggcccatcacacactttagttgtgcttcgctggaggcaaacccaacacggcggaggcgaattgggcgcccgattcttttttcaaaaaaaaaattggacgttgtttcgttaagtagatcgaaaaatttttagttaatagattaaaaatgttttaatcttttaaaaagctgaaacacaaccaaatcactttataaaacattttgctacaatatatgaagcaacggtttccaaaaaatcggacgttgtttcaccttatataaaaacaatgtttcagtaaatagcgaaagaatatttcaattcttaaaaaaagcaaaaaacggtcagatcgctagatgaaataatttggttcaatatatgcaacaaacgtttaaagtcattgcaacacttaaatcctatatacataaaaaaacaaatcatatgtccatcaagataaaattattaaatagtataaaaatctactgtaatatttgatttatatataatgaaacatcgtcagttattttttttctcacccatcatgcgcccgacgaggaggattcgcgctacacggcagaggcgacagtaacatggactgtggtgtggtacacacacggtatgtcagagcaagtggttagccaaaagcagcaaactgttttgtatacaagggcgagctgcacgagctactgtctccatgagctagcattgcttggaactcccattcccatgtctcgaccataccaccactatagctaaggccgagtttagttttaaatttttttttaaaacttctaattttttcgtcacttacacagaaacatttaactttttcattatattgttccaattttaatcaaacaagtgaactaaacataccctaactaatcatcgcaaacacagctgctatagctatagacgaatacgataatctagcgaagaaaaacaaaagctcagatctctgaatccacgtgctcccctccactgacccacgtgctgcgtctgatgagcagcaccaccagcccactcccaactggagccaaacagacacaggtaaacacaaaccctttcgatccattcccgagttactaacactaacagtatatcattagttagtggctaacgatgcaatggaccacatgcttagtgcccactaagtactaatcctgccgttttacgagcacaaaccaaacccacacacgtctttacatgatgattttaggccggggattccggccgacacatggctcgatcgatcgagccgcgacatctctctctcggtcaattccgcccgttagcctccaacgatccaaaccgcctcgtcataaataggcaaagaaacgaacaaggaggtggcagagtgtgagcactggtcgcttgcttgtgctttgctttgctaggacgagaagaaaagaaaagcggcgagagctaagcgaggaaggatgcgtggggcgtcggcattggcatctctcgtcgccgcggcggcggtggcgctgctcctcctcatcgacggctgcggcggcgccatgtacaaggttggcgacctcgacgcctggggcatcccgccgccgtccaagcccgacgtctactcgcgctgggccaaatccatccacttcgcgctcggcgactccatctgtaagcactggatcatcgcgattagaggcctcgtctttttcttatgtttgtacttatcaaccgaaatttaaatttttcaacttcagatttaaagctgattttaaaatttttttcatcgaaatttatttttcagactttgtttttagctgatataaaaattt

SEQ ID NO: 58647 - DNA, 681 bp, Oryza sativa
tttgccacagtcaccgcttagacttccacggcgacaatatctgcaacgtcgtggagctccctctcagccatgatcacatcttccttgcgtacggccacgacggtgtcgacctcgctcccgaccacatcaacaatagcgtcctggagcttgctctccatcaacccatggagctcgagctcggtcacggccaccgcttggacgtccacggcaacttgggtatcaggaaattctgtatcaccggcaaaggagtcctccacgacatgaacctcgtcgaaatcatacaaaatcacctcggcaccatggtgttcgcttagagagttcacttcctcgcaagtcatggcattggaaacgtattgctgtggttattaggatggagcgaagcggagaagagtttgtcttgtagaagaataggaaggagcaattgatctactcgatgatctgttgctgcgcacgcggagcaatggtgcaatgcattggccgggcaacggcgcgtagtactcccgagacacatgtgcagtgatggattaactccatgagcaaactgaaatggcgagcacggagtactattttaaatttgcattctcgaatacctttgaaatttcaatcgagatctacttccgtcctgcgttaaaacctcaaaatttcgtggttagctatatgcggtataactaatgaggaatt

SEQ ID NO: 58648 - DNA, 812 bp, Oryza sativa
atgtatgcctttgttagtataaccctttcacaagtgaagaactaattacattagtcctctgatactgtagtcctaatgctctttttaggtgaggatagttgtactctaactcttgtatattactgattttatttttgtggttgtatgctaagttatttatttgctcaagcatgcagtttgtttttttttttgacagaaacatgccgttcaattttgtatatgcggccggcaaccctgtgaaagaatatcatgaactgactgaaactgaaatagaacatggctgaatgctaaaacaaggattaccattacaaaatccctgaaatgttgattatgcattcatgaatcatgtagttggcatatgacctcgatcagtatcctatttttgtatgtagcatcttcgtagctttattgatctttacaaatatagcttcaatgatcttagctcgtacaaaagaacaacattttcatggtcatgtaaatctcttgtgattttagttgggtgaatagttccatatttcattaaatcaagaaatgaaacaagttaaagagtgaattgcttgcaacgatttcttaaccttgctacttttggttctgtagatgttctgatctaatgatgattacagttagcgtgtagctggacggtgtggtttcctgtgaaaatacaacagggactcggaccttgatttatacatgtatttgcttcataaaatttatacgcccacagacaaatattaaactttcatatggatgaaattatatacttcgaatcctactgaaacatcaatttttctagccgtcgtcgacggaactaa
